United States Patent 8,781,750 (CELL-TYPE-SPECIFIC PATTERNS OF GENE EXPRESSION) - sequence listing, part 43

SEQ ID NO: 37792 - DNA, 84732 bp, Homo sapiens
cccccttgtcattaatacattaaaaagattcaatctttaccctgaggtaaggtactttttccaattgtgatttttcacttttgtaaaaacttttttgtattaaacgctgattctaaatctaagatataattcaatatattaaattgtatttaattttttaaaagaaaatatgtatcttgtggaggaatatgtaaaaaagatcattactgattttgaggagagggctttaattctgtggggaactgttgatttgattgcattgtttagaaaatataaaaactagatttggtgtgcttacagggattataccaagggagcgctgttacttttacatgtcatttgttaaatgttttcttccctttcctcatttaattgagtgcactttcttgagtgggagtggagggaaggtgagcccaatccagcaagtggagatgacatttggcctctcctttatcctccttgcaaaactataaatttgttgatgtggaactctagttcaatagaatatatattttaatgattttgtcagaaggctttccagatagatattgaactatccaccagcagtgtttttgaaactacttatttacctgcatctttgttaattggatagacaaattggtcacgtgatgtatttcattcattgattttatatatatatatcagtgttctctatatatgtatatataacacacatacatatatacataatgcatttttacttttaaaaataattgccaattcatgcctttcatctatatttctgttaaaattttataagttcatttattatatactggatattaatataatgctatataatgaaacattttccccagttgtttgccctttagctttgtgtatgatgtctatgtatttttttctatacagaaatatatctttgaatcttttttgtcttttatacatacatgtaaaaaacttcatttttataatcataattttttttaatttacatttttaatttatctggaattggttttgatgcatagtgtggggtaggaatctaaccttgaattgttttttgaaaatgtattgtgtgtaacctaacactgatgaggtgtccatcctctctccactgatttgaagtaagcttttttctttatatgcaaaattattatacatacatgcttgcacgtgtttctggattttgtgctcagtattgccttaggttgaggtcctggaaagtggactttgagatggagatttgcatgcaggaagtagtcgagggagtgtccttagggccaacacctgaagggggatgaatgaagcagaatgaggtaggaggaagaggagagctttgatacagtcactgtgaaggcctcatccagtccctgggcagctctggatctgggatggctttgcagagttgtcctaccttgtgagaagggcccctggccttgatgtctttccctattgactagtcggtcatcagatgcagattgcccgtgggtaggggatgtcaccttgagtgaatttactttcttcagccatgggcagttcccatggagggacacagcttcaagctttcaggcaccagtcttctaaccagctggaggaatgagtgcctcagcccggaagagggaatctggggtggcttgccaccgcttgtaccatggttattgatctgtctagccattcttgtgccagtatcacactattttaattattaaaagtggtaagacttaatatctgttaaaacattccctttaattttcttgttagttttctagatacattttagacacttggaattttgactggaattattttatgtttatgaattaatttgagggagaattcatatcttaaataattcggtctattccagtagacccagtatcttttacttgtgcaaatcttcttttgtgtctcttagtagagttgtagagcttttgaaaaacataaatttagcacttttttttggcccatattttgtccttacccatggatgaacaattgaaaactgaccagtgaagaatctgcctaggagattctgagccttgttttactacatttaaagggagccaagtggatggtatggaaagggaaaatatggtaattgtcaaagtatctcaaaagtattctagtaatgaaaattgtttagtatattttcttaagatgcctctgtattttttaaaataggtaattttggccagttggtaccggatttataccaaaataatggacttgattggtattcaaaccaagatatgttggacggttaccagaggagaaggactcagtcctattgaaagctgtgaaggtaagtttctttctgtaatattgtccagttatctgttgtaacataataaacttatctagcataataaacttacactgtaaacttagtggtataaacaacacccattttattatgcatatatagattctgcaagtccagaatttgggcaggctttagcggggctggtttatgtccatgatttcagggacctctgctactaagactcaaatgtctgggaaggctggaattaactgagaggctacattgctcacattttggctcctgggcatggaggactgtgaggctgagctcagctggaactctcagctgggacacctacatgtggcctttcggggtgacttgggctttttgaaagcaaagtacctcagagtagtagtaaggcttttcctatggcagctgaaggctccaagctggacactgtatgacctcttatgacctagcctcagaagtcacatagtgttgcttctgccatactctgttgaaagagtcacaagcccaatgaaactcaaaaatgggggctatagaccccatacctccagaggaggcgtatcagtgaatttgcagccctgttttaaaaccatcattgctaattaccctggtctcatctatgttctgcagtagtgttgtgttttcatgtgggaaccaaggcagctatttaatatatctggcaaccattttcaaaatgaacacaatttaatataaattgctagacacgtaaggtaatttgggttaatgtgattagaacatatgttttgtttatttttaaaggattgggagatcctgcttgcttttatgttgctgtaatttttattttaaatggactaatgatggcattattcttcatatatggcacatatttaaggtaagaatattttagtatgtgtttataagatatactaaaataaaatagttgattagttaatagttaatcattgattaatttatagttcagttttatgaaaatatcctaaaatatcttattatcataaaattcattatttgcatgatttcaccactgccatggcccatcacacttaagatagttttagagatgtaaatagaattgggaatacttgataaatttaattacttttttttttgagacagggtctcactctgtcacccaggctggagtgcagtagtgtgatctctgctcactgcaacctccgcctcctgggttcaagcgatcctcccacttcagcctcctgagtagctgggactataggtgcacgccaccaaactcagctaatttttttgtattttttgtagagacagggtttgctatgttgcccagactagtctcaacttcctgggcttgagtgatctgcccatctcagcttccaaagtgctgggattacaggcatgagccacagtgcctggcataaattttgaatattcataggcatttgaacataagcaatatatattccatatattgttatggaatatctaatatattgttatggaacagtatattccatttgctgtatgtacgtgtatacgtgtgtgtgctgagatgtgtgaagtcttacttcttactgtagttttggtgtaaaaaaagtctgtagactactgcttaaggtaacatgagggagcagcttttaccttagagcatttgggtctttctagatggctgtctgtggttcttcttccaatgtcaatggctgtagatggtttcagctccatccagtatatattgtttacataaaatataagggaaaagaccactcattatcaaatgatattaatagctctttattaatgttaaagtagaagtatcttctatgtaatatttagaagtgtcttctgtacaatatttagtatctgacctgatttactttacagttgagcagcattcctaaaactaaaagactaattttttaaggctttttatgtttacttcttttttgccaatttattattctgtatatatgtttgaagtattttaccttgagattatctttagaattttcttccttgctgcttattgattctttgtagtacagaattatgagaattgtatatgattttcaatttgggataatgagtttgaatttgctattatcgcattatctcctttcctttggaagtgtggcattttcagtttagtacctcaaagatgtgttgagtttctagcccaccgtttgagtatctagcagttacttgataagcatttgtcaaaagaggaagctgttagaagatcaatgtaaaatatatttgcatatagatttaagacactttgatgttactatttctgacttaggtctaagaaaattcttttgtttaattggggagactaaaataaaaatgcatgattaaaagatgattgtgaaagattttgtttttgaaacaagatgcagggaaataagttaaaccaaaagaatatggtaatgagaaaaggaggctgacttgagggaaagtgggcctgtgtgcttgcatcgtaatgagccagagggagagaaacttggtggtgtctattcattttgctgagtactgcccatctgtctatgggtagctttattacatttgggagattagattttacataagagaagttaaaatatgaaacatggcattactgctaagctgctaatctgcacttatgctaccctttttttaaaaaaatatggggtcttgctatattgttacccaggctggagtctagtgactattcacagatgtggtcacagagcactatagcctcaaaccactggcttcaagcagtcctcctgcctcagcctcccaagtagctggaactacaagtgtgtgccaccatgcctggctacttttttaattgaaagaagaatttgtaaacatccgttaaagcattcacattttcttgtaatgcttgttataactgttttttcaaaggcagaaggcacaacatctactgaagagaataaaagttcctggttttggttgaggggtttttggtggttttggccctgacctgacctaaccctgtggtgcctggtagacagttttttgtctacatgggagatgcatattcagttgttcagtcaacacacactattcataccaagtagtttcttaaaactctgggctctgagagcatgggagtgcagcagggtgtgtgtgaatggaagatagacaggaaggaaaaattaagtgcttagaacttcagaggcaggagaaatttgttctgcatggaggggctactttagtgtgaccttgtagaatcagaggtatttgaataggtggaaataaaccatgaagataaaagcataccagggagagacaaaggccaaaatctagtatgtggaaagcaggtaataagcagatcagttttgctgggatgcatgttcttcagggagtgttgtggaggattcagattggaacagaggttgtgctggatgatgaaaggccttggtaactgactgggttgaaacctattccaaagcaagtgaaataagtacaaaaattgaccagtataagaacaggattcaagctgaagtatgatctcatagaacacttgactttccccagtccccaaagtcaagcagtgactacttcagcacagtgtttgtcaaattgcagggcatcacttattagagagttttaaaattgattcagtgggttgagcccatttcattttagatgaagaaaaaaaaatgctgcaaagtaaataatatcatataccacactaataaggatagatactatttagagaaacttctatttgctataaatatatatatacacacacacacacacacacaccacacgtgtgtgtgctgagttgtgtaaagccttcttactgtagttttggtgtaaaaaagtctgtagactactgcttaaggtggcatgagggcagcttttaccttagagcatttgggtctttccagatggctgtctctggttcttccaatgtcagtggctatagcttgtttcactctgcccatttgactgctttgtgctttagctggccccttctgtgttacccaactcttggaccccatggtggtctgcactagcagcacatgttttcatttttccagctttccttttgtgtttgtgggctttttcttaacccggaaccatctctttagctctattcaaaggcatcgttaactgaaggttctttccaaaattgatcctgatgtatattattttgaatagagtctcttatcacttcttttctatcagtgtttttcattgcatttttgtatgttttttgacctgaagtacatttagaggtttcagattactagttagttcttaatattttcttccttgatggttagtcacccttgtaattttatgaaagggataaagctgcagacttcttaaaatatgggttaaaaataaagaggagggtatctaaagttgtttttaggattaaaaaaataaattgtattatgtactgagaaataaaagttgagatttgtctagcaggttagaaatttgcaggcagattgactgtgacattttaaattcagaagtatatttgttttgaaataatatacatataagtttttagaagccaggtaagccagtccatttcgccagaaatggaagaagggaaaatagaaaacaggcaaatggtgaatggagccaggctgccaagctctaacttgaggagatgaagtgagatctgttttgcaaacacagcctactcatggtataattctttttctggaattctcagtattttagtattttttttaaaatactcattgttaattattttttgaagctgtattgatttatacttacgttatgtatttcataagataccctgatatttcttagccacagactaacagtttctgaaggccagtttcttaagacccagtgtgtggaaatctctgttctgcaagtaagaaggagcattggttgttggacagttagaactttccccctagtttcttctggaggaaattcatatatgcttaagtttctcttattgataaatacaaaaaacttttggtgttggactctaaggcagatatcaagcaggtgatactaaaacttttattctttgcactttagtgtgattttagtattattttggagttcggggttagctaggttatggtgcattgttgaggaagaatagattggatagtgtattaagctgttaaataatgtatatgtttaacagttctctggaaaaatacatatgtctataaagtttattataaattttactgctatgtaaggatgagtgcaaacaataacagggtttataagcaggagattttttctttctcttttgaaaagggtgccagaaatactctgactagctgaaataaaagagggagtacaatactgagatacagaggcctggtggaatcagagaatcatcgaaaaaagtgcctttgtttaaggctcattcctttgtaggtattagatttatccctactggctgccagttctttgcctgttgctgtccttcaggcttgctttcctggttccttcccatccgcctcagaatgtgttcatcccttaccttctctctcacatgacaaaattaagacaaaactttttttttttttgagacgaaatctcactctgttgcccaggctggagtgcaatggtgcgatctcagctcactgcattttccacctcccgggttcaagcaattctcgtctcagcctcctgagtatctgggattacaggcgcgcaccaccacacctggctaatttttttttttttttttttttttttttagtagagacagggttttaccattttggtcaggctggtctcaaactcctgacctcaggtgatccacccaccccggcctcccaaaatgctgggattacaggtgtgagccactgtgcctggccaataaaactttttaattggacttcccttgggtccccttgctacccccatctagtctcccaccccttcctcctctccccagcagcgaggccctggtcccattcacctctcccactgctctgcttgtgcagctgcttacttagcagccctgcctttgattgcttgatttgttttgaatcttaggatggtgaaatgatgcctgaaaccactcagggttttcacagaccaggcctgtggctggccagagaggactctggtgctgtctttttgagcttcatttctttgtatcgttctcccctgattactgctgcctctgtcttcagagttcctactactctccttaaaactggagctgaagaatagacaaaaattcctttgcctaaaataagagaaatatggtagaattataaaagtacttaagttgatttttagatcttatgttagactctgagttctttcccattcagtatcctatctgaggttgcccccaaaataacccattagatttttagactcttcagcctttgattccattctagaacaagtgccatctgaggaggtcttctggagaaaacagtgggcagtgagtgtggctgatgagtcatcctgggggagacagaacaatgcccctgcggagtgtctcattattgactgacagctgcccagtcactgctgcctacttggacttttgtttattgtatcccatgcaatacttttactggaactttacttttaaattatcccttcagtttatattgaggatcttataagaaacagctgtgtgaaatttcttactttattttatgcattgctatcatatgagtgtattatctatgacccagtaaataaataaccagtaaaatacttttttatgtgtaaaatgttatgactatggaattgtgtaaaatctttatatacatgtttaaagattagtaaaatgaatacttatgtacccatgacacagattagaaaaataaataaattatcagagctttcatacccttaaaattccttcttaatacattctctttccttccctcaaccctcagaagaaatgacatcctaacttttggaccaatgttttccttgtttttctttatgattgtgccactcatgtgtttacccttaaatatggtgtgtttagttttgaaaaactgagtatcaggcacaaacctagctgcttaaggggaggacactattgcccttgttagatgaaagttcccagaagaagagaatttctgagtcatggtctttaggttccctgagggaactttctgaggctgtcaggagcgcagctgagctaggggagggagctgagctgccaggtattggagtggctggttaaagcgacaagccaaaagtgagagttaagcctttaatcatttactgtaatggtatacgtgagatgtgacgatcaggatgtctcacccccatcaaaagggaacaaaaggctcctgtagtttatggttcttgaagtgatggggcaaaggagaagggctaggagccaaagagtgcagagtctgagtcagagtggggagcggcctgttcaaggagcccctctccgccaggccacagcagagaaaaggaccaggaaataaaggtgcctgggctaggaaggcaaatataagaagagctttatcacccagaagtggctgagtcattgactgcaactcccctgagagactacagtacactggctctgcaccaagcctggtgtgtgaagggcttcttttccctgtgaggcctgtcaggcaaagccttgcatatggccaggcctgagaaatcccatataggttttcaaccaggagcctgattcctcaggacatcagtaggcaacgtcatgagcctgggataaatgtaggactcagtcggtagggacatctggcagaaatgtagtggccaggtactgaatatccagcagaaatatcatgaggggaagagctgttccctctttctaaattcaccactgtttaccctggctctctggagcatatcaaagcagaacaatttctgtgagtgatataagtgtctttaactgatgccagcagtaaagtatgtggagccaagataaaatacagacaagaatctggtccaggctcatccaggctcacacaaataaaatgtggagattttgggcatgagtcagtacttggttctggactggctaccttccatggtttgtgtacatctgtccttttggcatcccattgggatttccttgactgctctcccctgttggatcccctgtgcccttatcctgtttgttcctctttcttggtttattttccctctttggtagacctcatcttctagtaggtaggtcttgagagtagatagctgggaagtaaacattttatgaaactttgcaaaatgtgtttatttgctttcgtatttggttcactgtttggccgagtgttgaactctagacttgaaaacattgttggttgctggccgggcacggtggctcacgcctgtaatcccagcattttgggaggccgaggtgggtggatcacaaggtcaggagatcgagaccatcttgactaacacagtgaaaccccgtctctactaaaaaatacaaaaaaattagccaagcgtggtggcgggcacctgtagtcccagctactcagtaagctgaggcaggagaatggcgtgaacccaggaggcagagcttgcagtgagccaagattgtgccactgcactccagcctgggcgacagagcaagactccgtctcaaaagaagaaaagagaacattgttggttgcttcagatgatgctattcagatgttcctaagttattcaaatttctaaacctttgtatgtgacctttgcttccccttcctctctctggaagattgtagaatatcttctttgtctctatggttctgaaatttcagagcaatatgtctcagtgtagatctgctttcatgtgttctcttggacacttgatgggttgtttcaatcatgcctttgatttctgagaattttcttgaattatttctttacttattttattccctttgttttctgattcagaacttttgtttggatgtttgtagtttccagtcctctaattttcttttttttccccccatttttaagctctttggctttgttctacattctagaacattttatcagccttattttttccaaccttctactgagtttttatttttcattatcatgcttttaatttccaagaagttttgtttgttctataaacattcctttttaaaaaatagtattttatttttgtttcttggattcaataaatattctctctaagggtattaatgatgtttttaccctcccagaataaccttggcatcttctagcttgtgtgtgtgggttttttttgttgttgttttttgttttgtttttttttttttttttgagctggagtctcgctctgttaccaggctggagtgcaatggcacgatcttgactcactgcaaccttggcctcctgggttcaagcaattttttcttgcttcagctttccaagtagctgggactacaggcacgcaccaccacacccagccaatttttgtattttttagttgagaggggtttttaccatgttggccaggattgtctcaatctcttgacctggtgatccgcccgcctcagcctcccaaagtgctgggattacaggtatgagccactgtgcccggcctagcttgtttttttaaacatcctttggtctctaccttccatgttaggtgccttccttagatgtctggcaaacttaggctgtcatgattaaggctagaagaccaaaaaaagctgtatagaagctctaaattgtgggtggaatctgttaaggttgagtttttatatagtttgaataaatgatgtgagcagaacttagagtgactgccagttctttggtttgcctttaaatgtaaaagaaaatataaagtaacagaggtcttttagggttgtaaaagggaggtgcagtgttttattaggttaactgaaatggaagattatagatgatttttaaagaagtgattgagtagagggaagaacacctaaatgagtttaagagactctgtcttctatgtgagaatggaataaggtagtgtttgcaagtgacccagaagaatgcttgccttccaaaatattttttgattgaataaattaattaataataaaatattgaaagaaaaacttagcttatggttgccatatatgaaaggcacaataaaaacatattatctatcacataagctttactagcgtttaccaatttaggaagtatttttccaatggactcattctgaagctttccttctgcagattccaatcttcactgaagactgtttttgattgcagaagttcagttcatgtatgacgcttatgtgcgaggctctaaactctttactatcagaaactcatttaatccatatggttttcccatgagataggtaaaccgctttatagatgaggaaactgagacacaaggatattaaataacttttccgaggtcacagagctagtcactggcagagtagggatttgagtaccaacagtggctccaaaacgtgtgctctactgtctctgagaatacattttaagtgttctttccacagcaattaaattgtctgcagctttagttaatttttgtttaaagatcctgcataatgaagaaaaaagtgtttatttcattgccaaagtaagtggtatttatatttcataaaaagttttacttaaaatgttttaaagatacatgacactaagaaggatctagactttccgttctcttttctgttctgatgttccagaatattactgttctgtaataattcatttccgaaggattctgaggtcccaggattttgctgttcttcagctgatatttctgtatgcattgttttggtttgataggtggaagtttactctttctaatattgccatttttcaggatcctattgtgctccatttttagctgtcatacatgtaattttataattattctaatagtttcctcagttaattttacttagactcatttattgaactaacgacacattggagggaaaggtaacatactgcatgttggggggcggattcttaaatgtctgcttttgtgattacacatttccccgactcctcattctccaggtaagatgactgtaactccataccttcgcatgatctggtagtttgtagttggtaatttcagtatggaaagtttttcttttttttggaaggtttttctttaatggttttcaagccaaggttaaaatatactgtattatttcttttggtggtgaatacgaacagctattttaatgttatctggaacatttttatgatttgttccttagaagtattttttggcaaagatcaagaggtctccatgtaagttaattgaacaactttctttctattaatgtgctctacaatgggtatgttagttattagtatgtttttaaactgaattttcactgctttgtatatacatgcatatcttttggcattattcaactttttataatcaagtacgtcagtggtcccttgccccatctgtcttccccaccctgtgtatccctttgtctagggaaagccactttcagatctttggaaactcagcaattctgatacgtaaaaccatagtccgcagttacattattatgactgtaaaaatattgcttactgctgaattaagtggtataaataattgtttatttggtaacttaaaatttttcctgtggttaattattgctaatattttgttttccttggtgttctgtatgctgattaattcctctccagatctacagctgaactgtaaacacttattttgtactttgtcaaatgtataaaatccattatttcaattctcccactcctatcccctggggcctccctcctggagcctctgtctctggttccatcctagacccgtccttccctgggcttccgtttagcgattcccttggagttttgtttaccaccatcctgagaattcccctttcctctcttgcattggattcattgtgttttggaccccaggttggtctctttctggtctgtttcatccttttgaggatcatatcctcaggtaatttccaagagagtcacagagataattttaaaatacatttgtctgacatgtttgaacatttccttttttatttttgtactcaattactggtttgcctggttgttgatttttatttttcctcagacttttaaaggctttgttcgactgtattctaagatggagtgtagcttttcaaaagtctggtgctattctaccattagttccttttgtgtgtggctagttgttttcctctggcaccttttgggttcatctttctctctttagtcccgtaaaaggtcatgatgtggtagatattatttcatccttctcatcgcatactttgtgcgctctatctgggcacttactttcttcactttggaggaaaactttttttagtattatttccctaatgacattctcttctccatttcttttttcctgttttcttgaaagttagtgattggatattggacttcttgaagtcgaattttctcagggtttttctcccttattttatttttacattttattgtcatttctgttagatttccaacttaaagaatcttgagtttgaaaatttctctgcctgttgcattgtctttgttacctctaggtcccccttcaatttgtattagtttctatttttcacattggaagcttccatccccacagcctgctgattcctagcttgacatttgtatctaagaatgaggagctggttggaagattgcaaagtggatgggtcttaactgactagtggcttttattacagcatgatgagggtgtaaactgctttgtttggggagacccaggctcctttcatcttgttgctttttcgtttaccagcctcagctgcttctgcctgtggccagagtccgggagacatatctgattcttcacgtcagtgcagaagtgacacccagtgccattgactactcctccccctcacccctggtcatatgcagacacttatgcatgagggctgagcacacactttctgaggcagggtcagtgttcccttttccttacttcatcccctctctggcgatgaggtcgctttttgaagagaacttaaatgatctttttcacgaactctacatttaatgggggctgcccagagttcctgtggcccctctgatctgttcctgatctcctccccctcttttgaatttttaccgttgtctctacccagttcttcattgtttctgagcttttgtgagaagagcctggacgtccttttgtagacataagtagtcagcagaaaatgccttttcttccacataaggaaccagctagtcagaggacaataccttcatcttccaattttctgttctctgttatcttctttggtcattggaggttcagagtggtttctctgatatctgagagatttttttaagctgctttatttctagatatgttccagaagccctgagggcctggatgattagtctgtatgtcaaagccctttttaattttgcttgatgtccccctttacatctggagtgaatagtcatcattaacacagttaatcttcctaccttctcttcccgtgatccaaccaagttgcctatgaagtattcttaggctctgtagcagaatggaatagtgttttgtattagttttccactcttccactgccctctacctgttttaaggaaaagttgaatttcttaaattttatgccagttttgcttccattattttgcatgatattttcttattctttattttaaaaaaatcaagcatttgctgcttatacaggctggatttttggccaaaaaacacatcttaaataggctgtgaatctaccatctcaaagttttccagctacttttttttttttttttttttttttgagacggagtctcgctcagttgcccaggctggagtgcagtggcgcgatctcagctcactgcaagctccgcctcctgggttcacgccattctcctgcctcagcctcccgagtagctgggactacaggcgcctggcaccacgcccagctaattttttttttttttttttttttttgtatttttagtagagacggggtttcaccatgttagccaggatgatcttgatctcctgacgttgtgatccgcccgcctcggcctcccaaagtgctgggattacaggcgtgagccactgtgcctggcctttttttttttttgaattaatattaacttggcctgctaacatatctttaatcaaacccatttggtctagcagttgtgtatgaatatttaaaagataagtatttttatttagtatgcataaattgatgaaagttgttggttggcaatattggcatcttttctccaaaaccttcccctttttatgtcttcactctctcagcaaatgacacttctgtctactctaatgcccagcctgacctctaagagatagccatgactttcctctttcctctgtaatccaaggagtcacaaaatcctattattactgtcctgcttcagagtatctctggcgtccttccacttctctgccagcccatcctcctgggatgactctgcatcagctcatgtggctctgctccccaccagtcttgctcccaggctgctctgcacactgttgtcagtgtggtcttatcatttgaggaactgtgatgagggcagtgcagctggagagcagagtgtgggtaggaggaagaatagtgaaaggagttgaggtgtatgcaggggccagatcctgcgaggcatttcggatatgttttggtgtttggatttgaccttgtgggcagggatgccattgaagggctgtgtgcatggagtgggattgggtccattcattgttaaagacaacacactctgcagtgtagagggagcaggctttgggtagggggtgtcggaggctgtagcagcccaggggaagacgatgggagcctgagctggtatgatggtggtgggatggagggaagtggacagactctggaatactaggagggaggctccaggggaagcatttgttcagaggagagtgatatttctaggcaggagaaggaggaagcatctgggaagaggctgcagttgttggataggtagttgttcaccatggaatgaagggcctggagcacacagtggagaggtctgcgtaggagttgaggagtgtggtgtttgggtcagagcagaggctcacctgaacacatggtcctgcctggtttttgggccagtaccaagagcaacaatgacatgaggtgtggtgtgtttggctgcaagctttcaaaaaaggaatgccagcagtcttttgattgaatagttctattttcagataccctttcattttctttcatggacaagacttggtgctaggcaccatgggtgaattgaggagttcacaatctaataagtaaataacttcagttagaatcggcagatagagagttaaattaacggcgttaatcacttgcttgaaacagactggaaaggaccaagctgagaacttttctcacccttcccgattcttatcctcattcctcatctttctttcctatctctttacttagtaaccagtgaatcccccccaccgccccccccaccgccgccatgagtataggggaaggttctcagctctgaaccaggcctgcttggcatttcttcattgggctaggaaggtgcccaagccttcagtctccaatttaagattggaaattatcttaatttgattatttccaaatttttctccattttctctttcttaagcatttatacaataagaaaatcgtaagagttatttaatatagttttgaattaactctgatggcttttttctcttcaaaagtttaactttggatggttcatcatttttgtaaatagagataaaaatctcaatgattaatgaaacctatcaaaacttgataattgatttaaatctatacaactgtagtaggtaggaaagaagataattatagaattcttaaattttagaactggaaagtattttgaggtcctttttaactttattttttattatcccttcattttatatctaagaaaaatcaaggtttaggtgaatgagatgtatgagtaaatgtggtaaatgtttagcaagcttagaatgttttaaaatttgcacagtaggaggtttcatattttctgacagtcatattgcagaagagactttttttttttaaccactagggaatgctaaaatatcaactgatcaactatagtggggagaaaaatttaaaaattttaggtattctgattgctgcatcttttctgtttagcaaaataaaaggacttagtagcctctatggattggggcgagagggtggacatggagaacaccattttagatttgtttcaagtcacatcatttcacagtgtttctaactcagaacattccttggagataaataaattttattctcctcctctagctttgcagttcccaaaagtgtatagaaaaaaatcggcctcttttgttagttaagtaaagctgggcccatattcatggaagatgttggaccataacctgtattttagtaatttggtgaaaaaggaatgttgtcaccgtggctctgccctcaggaaattgtccaacctcagagcctcccaggttgtatggcaactgagtgagggtatgcgacttcttaggcaaacctcatcctgagatttggtcggggaattggatttttttttttttttgagacggaatcttgctctgtcgcacaggctggagtacagtggcacagtcttggctcactgcaagctccacctcctgggttcacgccattctcctgcctcagccttccgagtagctgggaccacaggtgcccaccaccacgcccggctaattttttgtatttttagtagagacggttttcaccatgttagccaggatggtctcgatctcctgacctcgtgatccgcccgcctcagcctcccaaagtgctgggattacaggcatgagccaccgcgccccgccagggaattggatttgtgagtcttttgttctttctctacctttactctgccatttagaaaattaaagttattaaatttccattttgattcctcgttgttcagggaatttttaaaaggaaattttacattaaattccccaagtgtcattttttttaaaaactcatctttcgtgttttaggttgttttagattctaatcagagaatgaggtgcctttgcaactagatgttccagtgacataagaaaatgatgtgtaatctctgtatagtcacgacattgagcttgttgattatctccttcagatccctaatatgtttcctttagcttacttgacctgttagattatgaaagaattaaaattttctactgtgatcagattttatcatgttctctttgtatttctagaagttttaacttttagtacttgactcttacattggttgtccaaaaaaatttttattttttgagacagtttcactgtcacccaggctggagtgccacggcgcaatctcagcttattgtagcctccaccttcccggttcaaacgaatcttgactctcagcctcctgagtagctgggactacagttgtgcgccaccacacggctaattttttttttttttgtattttcgtagagatagtgtttcatcatgttgggcaggctggtgtcgaactcctggcctcaagtgatccacttgccttggccttccaaagtgctgagattacaggcatgagccactgtgcctgaccccaaacatttttatttaaaggaatacagttagaattgagtaaatggaaagagatatactgtgcaactgaatgaccatcatataaatgacagcccttcccaacccaaattatatataaatttaatgtcattctgatcagaagtctgacaattttttcttgggtgggggggcagggttgggagactggttcagatgttatatgtaagaataagttggtaagaattacctaaaaaatcttaaaaataagagtagttgggggtgggtagctttttaaaatcatgtgttaaaattaccataatgctacagtaataaaaatagtgtgataacaaaaaaaaaaatacagaattaagtcagttgaatgaaatagaacagagtctagcattgtaagaaattaagataaaggctgaatttcatttcgctggtaaaagggatgtttacttgataaatgattttaatataattggctatttcaaagagaacaaaattagggagaaagagctaagtggaaaatgcaatttataatattagaagaaattttaggagactatagttttaaggtgtggaagaccttcagagacaagacaggaagtgcagaagaaataaaggaaaatatcaacatatttaaatacataaaagtttaaaaattctttctgatagaatacgccgcaaattagatcagaatactttgtcacacatatgtgttaacttaaaataatcaaaaggatcagaatctaaatagcgtttattcaagcacaaagtgtgagggtagaccactcaggaacacgaactccaaaggaatgaagtcagactttggaagtaaggaagtttaggtttcatttatataggcagaggcagagacatttttagcaggaatacaacattattcatacaggttggcacatagtcacagcagtttgattggttataggtgttatttcttttggggaagggtacagttaaaaacattttttttttttacagagagtataataatgatgggttttctatagtctgatctaagcaaagtaaaacaacacagggaaaattaatctttaacaggggttattaactacgaaggcagggtcacacctgtagtttcagctactctggaggctgaggcaggaggattgctggatcccatgagttcgaggctgcagtgagccatgattgtgccactctaccctagcttgggtgacagagtgagacccagtctctggaaaaaaaaaaaaaaaaaaggcaggaaggttttgtgcctgacattgtttaattctctagtcattgtactgaacaggaaaaataagaaagcaagttaatctataatctgagaacggaagttgtaaccatatgtgactcagatcacagtcacatctctctcaaggcttaaaggggttgtttttttggacagcttttaaatgttattttcacatttgacagtcagaggtttgataaccttaatttttaagtagggaacagtcaaatagaaaaatagacaagaatatgaataagcagttcacggaagagaaaatgcatgttgtcaaaacaaaacactaaaatgctactgcatacaagtaggcagtgagaaaagggttttcacctatctaaggagaaaatttgaaaagcacatgagtctgcacgaggggtggagaaacgacctcctgcatactctgtgacaagagtgtggactgctgcagtgcttccgggcacagctcacatcctttgactcacgtgtctcacagttaggtccctcctgccgaaacaaacgtgccagcatttacatgtacgaggatgtttaaccattttttattatagcaagaaactgaaaaatatttatatgcccggtaatatggaatggactaaataaatatatttgtactatacagtatttgccatctataaaaataatccctttaagtttacatacattgattaggaataatctttatgctagaataattagaaaaggaacaaatttcagagagatgttatattgatcacatagaaaatatatgtttgtgtggttagagagagagatttggaagaacagacacatactaaaatgttcttaggtgaataggattgggagagggtagtgagaaaatcactttttttcccctataaacttctatattttttgtcttgttagagtaagttcaaaacactaaaatgtatttatttgttttttaaaccgttaactctatcttaacctttctaatgtctaatcacttgtgatgaagcctgggcctagcctgtgtgcttctcttctgaagaagatgtggtacacctttcaggagagaaccctggcgtccacttcctggcctgtactgctttctaagctcctctgtctgatgctctcatttcagtgatccatcacttcagacactttctggcttcagtttctttgcccctttatatttcatttgtgctgtctaggctgataatcggtaggcaaaaatcacacagtcttatgattactgaccctgtagatttgtgttctgcagcctcagttgttcccctaagatatcccagcagcactgtgttttccccagttaccactctcctgaaatgtgagtggtatttcagacatttctgtctttcctcaaacgtttaatgctgccatcgtttcactctggcagcgagtggctgtgtcttctgctctgtggggaacatggaagctccacaaagtacttaccactaatatgcagtcttcctcctcttttgccaaggcaaacaggccacctgtgctggggtcccagccctacctgtctccttctggatactccctacatggattatccctgctggccattgcatctcttcctcttttcctcattgatacatcacaagagtaaatacaaggcctttgatgcctataccatctggttctttgtttcctctctgacctctctgtggtatacttatagatagagaaataaaaggaaggtagatagagaaaaagaaggaaggatatttgggtagaataatgagaaagcagcatgagctaaaatgagtgagaagacctcaagagtaaaaatgcagaacatgatgaaataaacctaaagatagccttatgtcccctacccagacttgggggacaatagggaacatatttcactctcatctgagcaaatgaaggttaattgttagaactaccagattataccattgtaatttcttacctagagttataagcctgattgtcatactttgatatttgtgttctattccagtttttgaaatcaaatgaaacataaaactttataaattggtattcctcaagtgtattctgcagaaaagtagcttggggatgggatttgggaaatataaaattaaatctttaatgtgtggaagtgccttgtgaatttctaggagcaggtaggcagtgtggggttttccatccttatgaccatggatccctttccttgcacgtctttctctccctttttcctaatgtatgtcatctgtcccaaggaaagcagtttgagaaatgttgaaggacataaataaatatgaggtactaaagaaaataaaaagaaatatcaggttgcgtgatgtacagtaatatgactactaagaattttctattccctttcagtttgcgtgcttttctgagtctatacattttgaaggtagcaaatgatttttaaaaaatgagaaaagattattttgactaatgatcttttggaggaaataaactattttgtaaataagcataggagagttctagtatgactataaaatcttatataataccagtggttatgatattatgtgttttaaggtttttcttaggattgacctgaatttttgttatttgagttatgttttcttcttttccagtggcagccgattaggaggcctggttacagtgttgtgcttctttttcaatcatggagaggtaggtaatcaaaaactattctcagaattacttctggaaatgcagttttcttctttaaatttaatctataatggcattctttaaatgtttgatcttattattttgattcaaaatttaaacactagcattcatttgagttaacttttcatgaccattgtacttcttatgtgatataaggcttagtaatttgatgaaataatgggtctgtatcaactgtatcaattctgttttttttttttgttgttgttgttgtttttgtttttgaggcagtgtctttttttgttgcccagtctggagtgcagtggtagatcatagctcactgcagcctcaaattcttggggtcaggtgatcctcctgcctcagaatcagcttccagagtagctgggactacagacgcttatcaccacactcagctagttttttaaattttttatagagatggaatctttctatgttgcccaggctggtcttgaattcctggcctcaagcaatcctcctgccttggtctcccaaagtgttgggattacaggtataagccaccacgcctgccctcaagtatcaattgtttgtataattttaaaactgtgaaagctaacaatttagttataatggaagtaggtggtaattgatacaactttcttttgtagggataactttttgttgcagaaactacacagcatattcttattttaatgtattaacatttgatactcttttaagtactttttgcaaaatattttagtgttcaagggctttctaaagacaacagtattgtaaaaaatatagactctggatccaggttgcctgggttcaaatcctgactgctatgtggctctgtgacctgagcaagtcatttaatctctctttgccttagtttcctctttgtaaatgggcataatgatgttacccacctcataggattattgcagagactaagtgaattcatatgtgtaaatgcctagagcagtgtttggcacatggtagctgctatgtaattgttagcttgtgttattactgttattgactaattaacttagtttaaattctactataaattcagaatgtcaacgtttctagattaatcatagttgtaaatgaatttctaatacatctgtctagatttctttcatgataaattttgtatgagggagaaaagaataaaggtcagcttgctttgtgtgaagtgactttgtccttccatgcattttatacactcagtgcctgctgtatttgaatatgcacatgttttaacatgtgctataacagtaatcatctccaaacataatgcagagtcaatgctggacttctttttagtcagcgagttactaatggatacttagctaatatgttcttagtatttagaatcacagaaatgtaaagctagagtaattgacaagtggttgcaacatgacatcagttaattggtatagtatgtgtttaaaaaaaaaaaaaagatttggtttttcctgactgtggatcctgcacattgtgatagtgtggaccatgaagcactttgagccacagattctgagggaatgacctaagaaacagggaaataaccatttaataatggaagaaagaagcattgtgtgttaacaataaggtgtcagaggaaagaggttattcaaaattttggaacctagaccaccaggaagaccactgtttgtaaagtgcaaaggtctatcgtgctaccctcagtgtatactatggtttttaattcttcgtcttacgttttcttataattttgatactcatgtggcatgaacatcattccttacaaagttttcttaaattttaacaatggaattcagactattcaactggcttttcaggctgatgaattgtctttttgatacttttcagctacttggtgtagctgaaaagcatgcttagacatcacttttttaggaaaaggtaaaccgaatatcattagaattagaatttcagttttactgaaatagtcaagtagataattttacttacatgtaaaattacttgtgaaaatacaggtaatggcattaaaattgagagcataaactgcagttttgggtaaaatattggtgagaactcaacatattttcgttttaggtaatgagatcttcagaccctatttttttctgatttttaagtatatactttttctatggacagaaatatttactctggtagtacctatttatgtatttagtgagcttttgtagagcattgctcactggaaatgccactgggttactaaccggtaccttactttcttaggagagttactttgatcacatgagtgattggtttatgttgcaaagaatagttctcaattgttacttgcatttaagttctatttccattatgtagtttgctgtgcactacatgtgaagatagcataggtttacttttttaaaattttctttttcctcatatggttttataagggaaaatttttgcctgaacaaattatttataaaatgtgtagcatgaatagcttaatagattattaaataaattatttaaaacacatttaaaaccttcaaatccgaaacttgtgaaatgcagtaaaagggtttataataatgatcagtaatgttgaggttatacattctataataaaaactatgcagatgttttcattgatcaagcttctttagtaaatttcattcagtcacaattgagaatttttgcaaagatgaaagctagcaattttgttttgcctttaaaatgttttcttttacaagatgcacacaacatgtgttgatggtgcagggttttggcatgctgatagaaaagcacatgaatgtgtattaagaaaaacctgaatactgtatttttctccaattttttgattgttagaaattctttttttgtgaaataggattgtttagctttttcatgataagattaaaaaaattattatgaagcatgattgatgctgttttatgtaaaagatgttcacatatataaagatgtacacatatgaagaggaaattccttactttgtgttttttaaaaataaatacattttaaaaaagtaattcaaagtaaatgaaaggattgcccccgaaagtacttcaaagtaaattaacggattgcctccaaaagtaatttaaagtgaatgaaaggattgccttgaggttcatatctaattaaaccatttttatgacctacaacatatttctgacccatatttcttaaatatttttccactgaactgagactaaactataaacatacatgttcctaattattgaaatagttatgccatttatataagatttggaaaagaattcttagagcactttgaaaacaatctcattaattcttattcttatatggtaggtatgtagtgaacattccaatatcataaaaatggaagcacttaaacattaagtgattggctcaaggttacccagcagggagatgattttatttatttgtatttttaaaaaattatttgttttaacttacaaataataattgtagatattagtggggtacagtgtgatgttttgatttatgtatacattgtagaaagagtcaatcaagcaagttaacatatctattccctcaccaacttagcattttttgtggtgagaatgctaaaaatctcttagcaatttcgaaatatgcaatacattaactgtagtcaccaagtggaacaatagatcattaaaacttattcctcctgcccaactgaaactttatatctgtggatcaacatctgcacattacccatctctcccctgagcctctggtaactacctttctgttctctgtttctgtgagattgactcttagattccacatataattgagatcatacagtatttgccttcctgtgcttggtttatttcacttagcatagtatctctgtcagttccattcatagtgtctcaaatgacataatttccttctttttttaaggctgtgtcatattccgttgtgtatgtatagcaaattttccttattaatctctttatggacacttagggttgcttccgtgtcttggctattgtgaataatgctgaaatgaacatgggagtgcagatatctctgatgtactgatttcagttcctttgtatatatactctgaagtgggattgctattctatttttagtgtttttgaggaaacttacatagttttctaaaatgactgtataaatttacattcctaccaacagtgtgcaagagttccctcttctccacatcctctccaacacttatcatttgtcttttttgataatagcctttctaacaggtgtaggtttctcactgtggttttaatttgaatttcccctatggtttgagaagctgagcatttttttttttcatatatctgttggccatttgtatctttccttttgagaagtgacttcagattctttgcccattttaaaaattgagttgttttgttgctattgagttatttgagtaccttatatattttgaatattggccccttatcagaggtgtggtttgcagatattttctcccaatcctcgggttgactgtacactctgttaattatttcctttgttgtgcagaagcattttagtttgacgcaatcctatttggctatttttgctttccttgtctgtgcttttgcagtcttatccaagaaatcattgcccagatcaatattgtggatctttttgcagagagaggattacaagtttcctgattccccattagtctctccaaatacgaaattcttaggggagtagcatttcaaagaagacatcactataatttatcttttacaaatgaaaggtgcagagaccttttcttgccaatttgtggacctcttacttcgtttttctttcattctttcttcccttctttccagtgttggtaaggttttggtaaggttggtaagaaagaaagtcccttcttcccaggtactttttgatgcttgagatgtgcaagtaaaacaaagactcctatccttgtgaacaatcatgtgaatgaagtgggataatcttctaccttaaagcaggagaatactgggcagtagcaaggatgagcagaaagtgatagcggataaggtcagacagttaataattggaggtaggatagagtgggagcagatttctgtaggtcattatagggtctatttggagtggatggaatgccactagaggatgatgactagtagagtgacatgatttaaattatgttttacatgaatttgggaaacagtgtaagtacaagatgtataattttatgaaggctattcactggtgtgtctatggatttgtgaacttattaaacctacagtaacttcaaaagttcaataaaaacagagcatgttaatcttagcagcatatctgctgatgtaaatttgaaaagcaatctacaatagaaaagtagcctacaacatctgttatgaccttgcccagctggatttctgattttgtctcacgtcactcttcaggctatttttgattgctttgcttcagccctattggcccttctttcttctgtttccagaaaggactattccttttccttcctcagggcctttgcacatgctgtttcctatgctttgtatatgcctctgcgcccctcatcttgacgtgtgcctaattaacgcctagtcatccttcacaactgggcatttcagtttgcatctcaatggtgttcttaatttcttcctgcagatctggatttccatctgacataatttctctttagttttaagaattttatttagcattgtgataaagatctgccaataagtcccttagtttttgtctgtctaaaaatgttatcttgccttcattttttgaagtatatgtttgcttaataagaattataggttgatagctttccctttcagcactttaaagatgctattccattatcttctggcttccaccggtttataagaagtcagctataattcttattgttcctctgaatgtaatgtgtcttttctctgttgttcagagattttcattatatatttggtttttattggtttgatggtggtaaacctagacgtgctttgttcattgaacacttttgttttctgggttggtttttatttttaatcagttttggaaaatttctagccaagatcttctttttaaatactttattttccccattcttcctctcttcttctttggggattctaattacatgtatgttcaacttttaaaaaatactatctcacagatttttgacactgttcctttttctcccatttttttttttctctctattcctccctttgggtattttctcttgccatgtataggagttggcggtgctttattctgatgcatgcagtctgctattatcactatctggtaaatttccatccctccctccctccctctcttcttcccttcttgccttcctttcttccctccttccctcccttcctctctttccctttcttccttcgttccttcttagaatttccatttattccatagagcctccatttttctgttgaaatttcctgcctcttcatctcactaatatttttctatacgttttaaaatctaattattgtagttattttaaagtctgttttctaatgccaacacctacattatcttggaatttaactccattgactgttttttttctcttgataatgggtcatattttcctgctactttgcatgtctcatagctttttattttatgaagacaatttctgtaaaagaatgatgaaggttgaactagataatcatttttgcttcaatttccctaaaaagggaacatcttttatgtcaagcacctaggaagagagactgagaatttggatcccacatgaagccctgccaagcagggcagtagtatagttttaatttgttttagtttacttccagtttcaaatgaattacagtgatttcttttttctttgtctcagtctccaactttccaggtgcttaactcaggggatgattcctttgatcttaccattctttaaactgggaaggggttagttttcagctttttagttaattttaatccatctccagattcagctgtgccaaggccccgaaaccaaatgctgtgtgagattgtgatctcacagagttctgactctcccccactcctctttatctgccagattcatgtgtgtgtatgtctgtgtgtgtcccaggttgggggaggggtggctgtcacaacaaatactcatttttgtgtttgtacctttttcagattcttatttatatggttagaagttgtttggttccagcaaagactctctgcctatggcagatccttacctaaattatgcagttgttcccaggtgtgatggtagagccaacagctgttctgtatcttcacttgggctatatctagtttcactgtaaatcttgtactaaaaaggcagtacaacaaaagtgcatttttctttactgttttttctccggctttttattttgaacaaattgaaacttacagaaatgctctagattcagtttcatttaccagttttaatattttgacacatttgctgtctctcttatacaaacactgacacagacatttttctaatccgtttgaaaatgagctgcagatatgatgctgtctcacccctaaatacttcagtatatattgcctaaaagcaagacattctacataatcacaatactgttatcatacttgagaaatttaacactaataattacacagtaataccttaatacagcccatattctcattttcatagtttattcccataaattctttgatgattttattttggatccagaatctgattaaggatcgtacattgcatttagttgtcattttatttggaaaagtttatctcaaacagtttctctttgttttttcatggcattaacatttttgaggagtctaattattttgtagacgtctcacaatttggatttgtctgattgtttcctcgttaatagattcagattagaagactattttattttattttattttattttgagacagggtctcactctgctgcccaggctggagtgcagtggcacaattttggctcactgtagcctctgcctcccgggttcaaggattctcatgcctcagcctcccaagtagctgggattacaggtgtgtgccaccacgcctggctaatttttatacttttattagagacagggtttcaccatgttggccaggctggtcttgaactcctggcctcacgtgatctgcctgcctcagcctcccaaagtgttgggattacaggcatgagccaccacgcccagccagattagacattttaatgaagaatatggcacatatgatgttgtgtcctttgctttgcattacctctggaggcatgcaaaaccaatttgtcctgttattgaatttacaaagttaaatcacatggttaaggtggtgtctgtcatgtctctattataaaaatgcccttttttcttttaattaataggtgaaatgagggatgatactttgagacacttgaatatcctcttcccccataacatttaccaactgattatgcatccactgatgattcttgcctgaattagttattacattagccattgcaaatggtaattttctaattctgccatttcatctacatttaatggtgttctataaagataaatcccttctcctgccattttattttattatatttgcatagggtttttttaattcaatgttttataatccattgcagttctttttgatgctcccattgtcacagatttggctggtagtagtctccccacattttaatgatatatacttttcacacattaagatttgtatattttaactgttcagtggatctttacatatgtatacaatcttgtatccaggaactagatcaatgcatagactatttccaacccccaggcaggctcacctctgttcctgtccaatctgtatccctccccatccttcaaaactcttctatctctatcactattgattagttttgcctatttgggggcttcatgtgagtggaatcatactttcttatgcctgaagtctttctctcaacatatgtctgtgatatgtatccacattgttttccaaagtgcttgtaccagttttcactcccattggcaatgtacgataattccagtttcttctatcaatacatccttgtcagtgcttggctttggcagtcctcttaattatagtcattctgatgagtgaaatggtaccttattatgggtttagtttgcattttcctgatgagtaatgatattgagcaccttttaatatggcttatcggatttagatactctcttttgtttaatacctaagtctttacccattaaaaaatatttgggttattttattcatatatgggaactctttgtcaattctgtggagttctttatagaatatatgttctacaagtaccttctcaccacttaacgacctgtcttttcctcttttttcgttttttgatttttatctttgtgtacacagatctttttgaggttttttgatgaagttcttaattttcatgaagttccatttatcagtctcttatgttgagtcctttttgtgtctgattaaaaaaatctttgcctactgtaggtcatgaaggttttctcatattttcttttagaagcttgaagaaaatataagggaaaaccttggtgtagctttcacattttggtttgtaatctgtctagaatcttgtatacagtatgaaataggttccagattccttcctcccctaccccaccccaaataggatgtccagttaacctagtaccacttgttaaaaagaagatttttccccgctgaattgtagtgggccttgtatcataaataaagtgactatatagttttggatttatttttacattctcaattatgttctattagtctgtttatcttcaagccagtatcacactgccttaaatattgtagctttataagttcaatatctcatagtgaagatctccaaccttgttcttcgtcagtattgccatagctattccaggtcctttgtgtttccatataaattttagaatcagtttgtcactacttccctctctttcaacacatacacaacttgctggttgtgttttggatctctagattaatttagaatggacattcctgaatatactaaatcttccaatccataaacagatttatattcgtctcctttaatttctctcaggaatgtttaatgtttttcacatattttattaatctctagatattttatgattttggcactattttctgcccttttgatatatctcactggtgtctgaacacttcctttcaaactcaaaaaggttccagaaacaaattattctgtaatacacacaaaatagtttcaaagttactacactaatgtcattaccaataacaatcctaccaagtatggttcagtatttctccagttatttttctcctaagagtatattctactaaggaggtatagtcagaatataaaggttaaataatttagaagcaacctgaattgtttttatttctccatgttgtattatcattttgacagtgcaatttgaatcatttgtttctgtttctatttatattgcctatatatcttggttaatgctttcattttgtagtcagaattttggttatgttgataaccttgagcagtgtagtttataaccacatgataaaggtggtagagttgatactgataacatcttgccagatatattttctattttagatgaataagcaatggtcaagttcgagtcattgcaacaatggatggaaacatggaggtgtactcaccgctttttcaacaaagtttcacaaaggttttttgtaaatttggataggatatactgatatcttagattttcagagacaaaaagatcaatgttttctgtcatacaaccagctgaaattctttataaagatagtacagtttaaaatagcatttacatatcactgacacattaaatcctgtgtgagctaaaattgtattataagttcagattgaaatatgtaactggttaattgagcagcttatcagtacaggctgtgcataatatgaaaatctgcagtctgaaatactcaaaaagtccaaaactttttgagtgccaacatgactctcaaaggaaattctcattggagcatttcagattttggttttttggattagcgatgctcaatcagtaattaaaatgcaaatattccaaaatttgaaaaaatctgaaatccaaaacacttctggtcccaggattttggatgagaaatactcaacctgtgtatggtacaaaaatagaccaaaactccaagaaagcaaccaggcttacttattatcaagatacagtgccctgagatgcacaaagcttactccaaactaagggtcttcctaaataatggaactgccctaagtagcatcaaacaagagatactcaagccatgtctcttaaacctagcatgtttatggttactatgtggacagcaggattcttaacacctataacattctctgaagagaggtagcataaccttcatggtgccagcagtcttttaaggaagcactcataaatatagtgtttaaagcattattatagttaatattaagcaatataaagcaatagtataatcagtatagaaaagcagcaggcagaggtgggtaatttgttttaaacctaaacattatagtaacaagttaggattgatccagcaaatggcaactctagtaaaaactcttggaataaatcttaaacatgatctgtttgatactaatactaaccacaatttataactcactagtcaattgttcttctatttattttgaagttatgaagataaatcaattagatcatactgtattcccaatattataagttaatagtttgaaaatagagattggaaaattaagctacttttgagattccttagttattgattcttcagtgaatgattaaaaattattaagcagaaaataaaagcctattaatatctacacagtattatgttgcagtataatcagtgttatgaaatgtgtgctaaaaattatatactagatagaagtttgtgcaacataagatttttattgaatttattttcacaataaatgtatttcttatacttagaaacaacatacatttgtataacccttttttgaagcagttcacatgtatatttcctttaattctcaaatttcaaaataatgcctttaaaaagcattggcattttaaactgtcacactttttattttacatttaaaatgagataaagaaaaaatatttattttgttgaaacgtaaggcatgactaaaccaaatctcttcactattttcaaattatatggcatcatctggaatggcaattatgtttgtaccagacctagtaaaacacgttgtgttattggagaaacaatagaaagcactttcatggacatttgaattcatgtactcagaattttggagggagaagaccttgcccttcattacagtcctgtaattgggttttcttgtccctgctttcagaggatataattcagttttggtgaactgagtgactatagctattaaaagcaacgaattttggagaaatgataatgtcattgaatgtgggtaacaaatgtgggggaactgtctgcatgaagaaaattctcaaattgtacattacatggttggaatacttgcttgtttgaatacttgtttttgtacagagactgatgactttacaaattttgatcatacaggcatacttcagagataccgtaaaatgaatatcgtaataaatcaagtcatacaaatttcttggttttccagtgcatataaaagttatgtttacactgtactatagtctattaagtgtgaaatagcattatgtctaaaaaacaatgtacataccttaatttaaaaataagtggctaatcccagcactttgggaggctgaggcaggcggatcacctgaggtcaggagttcaagaccagcctggtcaacatggtgaaaccctttctctattaaaaatacaaaaaaaaaattagctgggtgtggtagtgggtgcctgtagtcccagctactcgggaggctgaggcaggagaatcgcttgaacccaggaggtggatgttgcagtgagccgaaattgcacagctgtactccagcctgggcggcagaatgaactccatctcaaaatgcacaaacaaactgccagtgatcacctgaaccttcagcaagttgttcagatggagggtcttactttgatgttgataacttctgacagaggggttgctgaagattgggatagctgtggcaatttcttaaaataagataacaatgaaatttgctgtattgattgattctttctttcacagaagattcctctgtagcaagtgatgctgtttgatagcgttttacccacactagaactttcaaaataggagtcagtcctcccaaaccctgccactgctttagcaactaagtttatgtcatgttctaaatccttttttgtcatttcaacaatgtttacagtatcttcaccagtagtagatcccatttcaagaaaccactccttttgctcatttaagaagcaactccttatcctttaaattttatcatgagattacagcagttcagtcacatcttcaggctccatttctagttatcttgccatttccatcacatctgcagttacttcctccactgaagtcttgagcccatctaagtctcccatgagggttgaaataaacttccaaagtcctattaatgatgatattttggcctccttccatgaatcagaatgattttaatggtatctgaaatagttaatccactccagaagatttaaatttcatttgtccagactcatcagaggaatcactatagcagctagagccttatgaaacatatctcttaaataataagacctgaaagttgaaatgactccttgcttcatgggctgcagaatagatgctctgttagcaggcatgaaggcaacattaatcacctcatccgtctccacccgagcacttgtgtaaccaagtgcactgtcaatgagcaataatattttgaaatgaatctttttttctgagcagtaggtctcaagaatgggcttaaaatatctggtcaatcatgctaaaacagatgtgcagtcatctaggcttgttgctccatttgtagatcacgtgcagagtatatttagtgtaattcttaagggtcctaggatttttagaatggtcaatgaatattggcttcaagatagtcactggttgcattaggtctaacaagagagtcagcctgtcctttgatgttttgaagccagccactgacttctctctgactaggaaagtcctagatggcatctttttccagtagaaggttttttcatctgccctgttgtttagtgcagcaacctacctcagttatgttagctagatcttctggataacttgcagcgtctacatcagcattgctgttgtaccttgtacttttatcttacggagatggcttctttccttaaacctcatgaaccaacctttgctagttcaaacttttcttctgcagcttcctcacctctctcagccttcatagaattgaagagagttaggatcttgttctggattaggctttgacttaaggaaatgtggctggtttgatcttccatccagaacattaaaactgtctgcgtatcagcaataaggttgtttcacttttaatttccttcaataatttttcttttgcatttctgactgttaggcataagaggcctagcttttggcctctctcggcttttgacatgccttcttctctaagtttaatcatttctagcctttgacttaaagtgagagatgaacaactctttgtattaattgaacacttagaggcccttttaggcttattaattttcctaattttaatattgtgtctcagggaatttggaggcccgatgggagggagacagatgggagagtggctgattggtggagcagttagaacacacacatttatccattaagtttgccatcttattgggcatggttcaaggcacctaaggcaattagaatagtaatatcagagattactgatcacagatcaccgtagcagatatagtaataatgaaaaaggttgaaatattatgaaaattaccaaaatatgacacagagacatgaagtgaccacatgctattggaaaaatggcactgatagacttgcttgatgcagggttgccacaaaccttcaatttgtgacagacgttatctgtgaagcatggtaaagggcaatgaaatgtagtttgcccatgtatcttactgtcaatcatactgaactctccagttaatctaataaactaacagcttttaaaaattgcattctagtaacaacagtatacattatcaggggaccttttcaatcttttcagcattctcttgtgtgagtagttcattcataaatagatatgtatgtcagtttcataaaggatggtgagcttgttagaaaagagcagtaaattggctcagtctttctatagcagcactagaaatattcagtagtctgaggtacagcgaaaatataggaaacacttatttctgacatggtctttgtcattctgtggaatctttttaggtacccgtgcttgcattgaaagacatcattattttagtgtgacttaataatatcagattgcttgcatttaattgtatgcggttttctgtcgatggaaggatgaacttactaatatgtttagtctatatacagtaaaatgacattattacaactgtgatagtacattgcttaattatgtccaaagtgagcttttcagaaaggtttatacttaacaatttcaggacttttgttacttaatttgattacactgcctacttttaaatattttgcaacccagggcagcttaggcaaagaagtaaaaccaaaaatggaatattcctttgtagcagcacagtgaatgaaaatactaaaattgatgactagaaagagttctcaagtactggttatggatagttttgctgaaattcatgggaaagaagacaaacaatagataaataatcaactcaaaatattctaaaatttggcagaacgttttcttgctggtactttcctccctttccttttaagatgtagttgcatcttttttggtattttcttcctgacaattcatgatattaatgctttacatgatcttaagccacatgtgtctctgtcagtaatatttgtcacatgctagttttgctgtttatggaataaagtccagtagtttgttttacaacacaccgtttaaattatttgttaaaaataattttatttataaatagcaatttttacttggaatgtcttagtaaatttagcaagtatactatactacaaattttttttttcagtgtacccgtgtaatgtggacaccacctctccgtgaaagcttctcatatccatttcttgttcttcagatgttgctagtgactcatattctcaggtaactttgacttaaccttatttctttttgcattaaataattttaactaaaatttcttaagcttccataataaagtgaacataataaaataattaaccaatatgatgctgttattagtaaaaatattataagagtgtaacttaaaaatagtatcaaaaacatttcttctatcagccttctgttcctcctcctttttcttggtagtctacagtgattgcttgagaaggaacaaattgctttcacttctcctgtcatttccactttctcaagtcttcttctgttaccactgtaacctcttgaaaatgagcagaaagaaggtaaaggctggtcatgctatagtgtatcctgtaagatacaatcctttggggcaaaggataattcacagaattcacacttctctccctttctgctgacaaatattgaatatagctgccttgctccagagggtaaaaaggaaaccaaatgggggctatggaaaaatggaacaaagcatgataaaaatctgaagatgactcagactgataactcccttcagtgatcctccgaattcagaagaactttgttgaaggctgttatgccaaaccctttgggcaatctatttccctctgattgttacagcaagtatagaaccatcacatggcttttagtctcctatgtagtagtgtctttagacagacccttcatagaacatgggatgggtaatgtttttgcattagctttttaaagtctgtgtagctccagctttattgctgtcccctaaactcctcttttatagggtttaaaacttctttagcaccttcaaataaggtgaacctctatgaattcataacctttaactgtgccctgttggttctgaggcatcttgagcaatggtcccttctcaaacatctctgtaagaagtgttgtgctgtaggagtctttgattcaccactacagatgctgtttttccacattcacattcttgaccgtggcttttttctccagtatagtgcagacagcagactgcccatcagtctctagttccttcctgcttttctacctctgctcctgtcttaaatccagcaaaggcaaacctttgattcttctttcactcactgatccgatctgtccctaagtgggcatggggatgctgctccggggactgagcgctgcttcctttagtccatctgtaccatagaaggtagtgttagtttcctgttgctgtgtagcccatcaccacaaactgggatctactatcttggagttttctagctctgaagttttaaaatcagggtattggaggtgcaaccctcttcctgaaggcacagagtgggaggggagagaatcaattttcttggcttttctagcttctagaggctgtctgcatttcttgggaggctgcctgcctttcttgggagactgcctgcatttcttggcttgtggctccttcatcttcaaaaccagcaatggtagattaagtccttctttgtcagttcactccaaccttctcttcagcctctcttctgcttttaagtaccctgtggttacattgggtccacctggataatccgggatacattccctactgtgaggccaggtgattagtcatcttcattccatctgcagccctagttcccctttgccatgcaacatgacatgtccacaggttccagggattaggacacaggtatctttggaggccattattctgcctaccaggatggggcctcttcagttgctgtttcctgccttcaagagctgccttctgttgggttcttctctgtttttggctccaggtgcttctgtgacaagctttttatgttttctttagtctcttatcattgtctttttcagccttacccacgtcttaatacctgtctttactttttgctgagaagttttagagaactttcctttctttagagccttcttcattgtctctgtttatattccagttggcatttctgttctcatattccaggccatctgaagctgcatcagctgctgctttcaccactcctggttcagatccatcccatcttgatcttcctcgccatcttcattggcagcttatgacttctgattgcgatggctttcctggttatgccccttagttgtcatggctccctgcttgcctgctgtggctatctatgactggttgcttggaagtgtgggctttcattttgctttcttggacactgcagtctttttaggagggaaaacctgctaaacctcctttcttgaaattttggcagacatcttgtcttttttctgaaggatagtaaccttctctctattggccatcttcatcttctgatatttcatccttattactgacattgtctcctttggaagagcagccatttcctttaggtcttggtttctacctatagttgacatattgtgacattagagggaggtggtgggtggcgatggcttggtggaggcaagaagaagctgagcagtgttgatgcaggctgcagtgctgaggatactgttacaaaaccagaaaagagactattccttaatgctaggaatcatttataaataaggttagtggtatgttttaacaaattggttttgtccagttttgaattttaagcatttttagaaattcagtttatatacccacctaatagtagcacagcttagctttttcttggttgttcttagctttttttttttttttcattcttggcaatatttatgtttccatttctgttgtcttgggtcagagctattttgatcaccaattggattttctttgttttctgttcactcctatctccccacagcgcattctttatccaactgccagattggtattaaattctgcttggaaatcttaatgtctcttgttacccataaaatgaaaatcatatttagtattcaaaagcagtagagaaatgctttattttagatagtggctttcaaacttttggactatgatctatgagaaacaagaaataagttttacactgcggcttagtatacacatacatgtatgcacacagctgaaacaaaagtttcacagaatagaacccctcgtaagtaggatatagtcatatatattctgtttcactctgctgatctgcatttttaaatgctgaattttattccataagttgatttcataactcattaaaaggttatctggagtttaaaagtacttttgttggattaaaatagcagagagggatgtcctttggagaagggatacttggggaagtgaagaaaggcatgtcataatggtgctctatgctccaggtaggtttatctagccaggatgtctttactgtatctgagctgcatacacctcatcacctcagtatatcaacatgcacactccacttctgtgaagatggacatgtgtgggggctttgcgttggctcacaggtttagaggataaaatcatcttaccctcctaaaaatctcctaaattacaagtcagtaccaaaatgagatctctaaaggttgcttcagaatggaccccatatcttttcctccacttaacttttctgtgttctcctacctgtgccagacccaactttttatctcacatgcttacaaaatctctctcagccgcttacctcttattctgcattattgcagtagttgtctgcctaatacttagcacttagaatatgctgctatcatctttttgtaggcatcttctgccttcctaatgaatctgttgaatcagtatttttaaatattcagtcatggattcaccaaaatataatttgaaaaaaatgttcatggatatactgacccaccctccttctctctgtgttattgttagcaaatgggtatttacctttcaaagaaaattgttgtaattgagtatcaggaggtataatttctaacccattggttcattttatgtttaggttgtgttataaccagatcatatatatttcgagattctaatttgcagcagtttggagccatgctagactatttcgtgtttaaacttactaacacttattttatcttttcaagggctacaaaactttatagaggaagcttgattgcactctgcatttccaatgtatttttcatgcttccttggcagtttgctcagtttgtacttcttactcaggtgaggtgattatattttaagctgttttaagcttagcatgtttgactatgtgagctcatttgcataaaattacaactgagatattctatggttctaagtcctaaaacactaaaacattttctaggaaaaatgtttttctaaaacattttttagaaatattgaacaaaagaaagttcagggtagagaaatatgttggattatttattaatgattgttaattatttacttcctaacataatgcatttattgaactcaaatttgtaagaatgcttatctttgttattcagtatcgttaagtgcttaaaagaggactagtgctataacttcaagtatttctcttaagttaactatagtatttctgttacctaaaatgtttcttttatgaatagttgtgtacattcttgcatgtagaataaagacacataggattacaggataaatagctaaccagttcatctcttataaaattctctctaccagtctggaaatttatctattgtctttccatgtactcttgcccactataaatggaggtagcttgttgagagagggagtaaattacatattcatttttctccctgcgtactatttttttttattgtactgatatatttgtataaagcagttgaagagttgctttttttttttttttttttttttttttgcgatggagtctttctctgtcgcccaggctagaatgcagtggcgcaatctcggctcactgcaaccccacctcctgggttcaagcgattctcctgcctcagcctcccaagtagctggaactacaggcacgtgccaccacacccagctaattatttatatttttagtagagacggggtttcaccgtgttagctaggatgatctcaatctcctgacttcgtgatccacccgctttggcctcccaaagtgctgcgattacaggcgtgagccactgcgcctggctgctttttaatattttttagaacatcttgcttgggaaatgaagttagacttggatttgagtcctaattctattcactagcctcttaacttggataaaatagttaacttttcttagtttaggttttctcatttctgaaatagagataataaaagaacctactttattgggttgtggataggaccagatgaagtaatgtatatgattcttaacacagtacctggtacttagtaggtgtcagtaaggttagttggttttatcattattttttaaaataggctctatttgtacttactttttactttgatcttgtcttgtagactcctttgtctaacttagttcgatgacattttcaatcagtttctggtttaaaattgtctctgagattgtctcttgaaaattctaccctgtaaatgtactgtgtgttgcttagcccttggggtgaaaagggagcattctcattgcttcctgatagtggagactgcctgcttttttgtggaggtaagggtcaggggaggtattttgcctccctgtggggcttatgttgaataataacacacacttccccacagttgttatgtcatatcaggcaccctaagaaatgcagtgttctccatgggtaactctgaataaagggaaactttgttgtttttctcactaatggaaaaatttgttgtagattgatttagagattaaaaacttgatgaatgaaacttaagttatatgtttaagtattcagctattttgcaatctgtttatgctatgcttttgtagtaggacgggaagaatttaatttgaattgctttctctatgaggaagggtgtagaggcattgtctgctatattacctctatgtaatagatactataccatcatttaatcaattaattcatctaaataattccagtactcttagaattattgatatataacatacaattttcttccaaatggaaaagaaagttaaaaatacctttgcagcgaaagtactcttaatttgaaattgataaatttgattataactaactcttgaatatttgtattaatgaaagaacattaatggagatacttgtaaagagtgactagcaagcagaaattgaggtatttttatgcacacatgcattgcataattatttttcagttaaatgtaccttccccaattatgtattagttgtcatgttataattacattttcatcttttttgattggacaaggcactttttaattgtacatgttgacagtagggttgacctgaagttaaaatgagtattgttttggacagttgacaaagtagacaattcacatgattgagaaagctgtgtgtcagagagaaaaatcaaccaatattttctatactaatatattgactatatttaataataaattgtcagataaaaggaaaacagaagaactcactctgtgtgtagatataaatcagttgaaacaacagtaaatatattcttcattcttgtagctattcattttatcttttttacttctaatttctttttaaatttcagattgcatcattatttgcagtatatgttgtcgggtacattgatatatgtaaattacggaagatcatttatatacacatggtaataattttttattgttcttttccatttagtttgcccttaaaactcctgattaatattttatttgttcatggttgaaactagttgtaacaatttcataactaaaacaaatgttgttcaaacattgtgatataatcaacagacctcattttgatagaccactcacaaaaatttaatttgggtcatattatctgattgaagttgtgcccaacttatgcagtatcagtaaaagaaataatttatgaaacggaaacatggggctgatatattatccaggagctgtctgttaaaatgaagtagaagggcccgacatggtggctcatgcctgtaatcccaacacttttgagaggccaaggtggggttcacttgacgccaggagtttgaaaccagcctgggcaacagagccagatctcatctctacaaaataaaaaattttagcatggtgatgcatgcctgtagtactagctacttaggaagttgatgtgggaggattacattagcccaggaggttgagactgcagtgagctaagatcacaccactgcactccagcctgggcaacatagcaagaccatgtctctacaaaaaagaaaaaaagttcattaactgagcgtcaactgtcaaggcatgtggaatacaccagcattcatattactacattctaacagagtgggggaaagagggaagacagaagataaataataaacatagtaaatgggtaaattatgtaggatgttagaaggtgataaggatttgaggccaggtatggtggcttggggaggctgaggcaagaggacatttgagcccaggagtttaagaccagcctgggtgagaccccatctctattaaaaaaaaatacaaaaaaagattttagaagaaagaaaaggtaagggtaaggcagatcaggagcaccaagatcagggggtaggagaatggaaaaatcaaatgaggtggtcagggcaggtcttcttgagaaggggagtagaacaaagattggaagaaggagaaggagttagccaagtagatatcaaagaaactgatctctaggttggtggaacagctggaacaaagaccctaaagctggttggttgatgttcttgaatggttatcctttaaaaacaaacattgtcttctctcattagtttttataattttgatgttttcttttcctgttaattttacagttgtcataatatcccattattttcattttcttaataatttatacatataaaagaacatttataatgtgtaaggaagttataaacacggtcataaaataaacaaccaggagcctactctccaaatggataatagaactttattgttacttttaagtcctgtatgccctgagctcatcccctcactgttcctagaggtaaccactattctgactttttgaattgtaatcaatttgcttttctttataactttacaatatgtggattactaaatagtacatatttttattattaaatgttcacattctttgtaaggtttatgcaaatggcattattttataaataccattttttcactcagatttctgctacttacatgtaactagaattcaaatattttcactgctttatattttccatcatataaataaagcataattcatttattcattttcttgttgaaggacatttaggttctctcctctccccccagcttcttattttagttataaataatgctgtacattcttcacatatctcctagggcacatatgttgagagtttctctagggtatttacctggtagtaaacttgttgggtggtaaattatgtacatgttcaactttataaatactaaattgtttttctaaaatgattggactacttccaacagcaatatatagcagcttatgttattctacatccttttttattttatcaatctggttcgtgtaaaatggtatcttgtaaccttaatttgcattttctctgattcataatgaagctgagcatcttttggtttgtttatatgcccttcatgtttccattgttgtaaattcctattcagatcttttaccagtttgtcttgtgtccaaaagaaaatgacatctattttagtcaatgcagtgtaatccattatttttgttatttatgttgatgctccaattgttccacacttgtccaactatttaagctgacttctctttccttttaacatgtcctcatcatgctttgagcacttttaaaaagaaattaataaatgttaagtttcatgaaatgctttactacatctgtttagatgaatcggtgtatttccccctcttcaatcggttactataatgaattaacattaattaactttctagcattaaataaacttgcttttctgggctaaacacaatttttgcatgtcgctggattcactttgctgtcatgttgataggatttttacatccttgttcatgaatgagttagacagtaattatatattttttagacttggcttattttttccccaaactatttaaaatagttttttattttgtagtataaatcagattaaatgttaagccttcagagttggctggtcacataggcaactatggctgagggccttgactcaaagttatagttataaaattataaaattacacaatgtagtttgcagcaaaacctactttgggtaaatgatacatactttattatatgacttactgttttctatcttcttccattatcgttttataaattcctaaattcttatagttataaaaagaaaaaaatatatagaattatttccaaaaaattatttttccattttttattgtggtaaaatacatgtaacttaaaatttaccaccttaagcatttttaattatacagttcagtgatattaagtacattcacattgttttacaaccatcaccaccacctatttccagaacatttttcatcttgcaaaactgaaactttatacccattaaagtccttattcttccatcttcccagtccctggaaaccaccattctactttctgtctttgtgattttgactactttatatatgtcatgtaagtgaaatcatacagtatttgtctttttgtgactggcctatttcaattagcctactgtcccaagttacttctatgttgaagcatgtcagaatttccttcctttttaaagctaaataatagtccatggtgtgtacacagacacacacacacacgcacacacacacacgattctgcttatccattcaatctgtccatggatacttggattccattgtgtgtacacacgtgtgcacacacgcacacacacacacacacgattttgcttatccagttcattcacggatacttgggttacttctgtgtttcagctataggaaataatgctgctatgaacatgggtaaacaaatattttttgagatcttgttttcagttgttttcagtatgtacccagaagtggaattgctggattgatcatatggtaaatctattttttaaggaactgccaaacttttccatagtagcggtacattttacattcctgtaaacagtgcacgaggttctattttctccatgtaatcaccaacatttattttctgctcttggatggtagccatcctaataggtataaggtgatatctcaccgtggtttttgtttcttaattaaaaatctttatttttcagagaagttttaggtttatagcaaatttttttttttttttttttttttttgagacagatctcgctctgtcgcccaggctggagtgcagtggcacgatctcggctcactgcaacctccgcctcccgggttcaagcgattctcctgcctcagccttccgagcagctgggattagaggcatgtgccaccacactcagctaatttttgtatttttaatagagatgagggttcaccatgttggccaggctggtcttgaactcctgatctcatgtgatctgcccacctcagcctcccaaagtgctgggattacaggcatgagccactgcacccagccaggtttatagcaaaattaagcagaaaatacaaagttcccatataccccctgcccccaaccatgcacaacctacccctctattgacatcccgcaccagagtggtacatttgttacaattgataaacctacatcacacatcagaatcacccaaagtccgtagtttacgttaggcctcacttttctacgggtggttgttgtgttttgttttgtttttttgatacaggatcttgctctgttgcccaggctggagttcagtggtgcaaatatggctcaccacagccttgacctcctgggctcaagggatccttctgccttggcctcccaaagtgctaggattgcagatgtgagccaccacaatcggcctggattttgacaaatgtataatgacatgtgtcaaccatgtagtatcttgtagaacagtttcacagccataaagctcttctgtgctccacctattcatccctccttccccctaacccatggcagccgctgatctttttactgtttccatagttttgccttttgtatagtgtcatgtgtttggaaccatacagtatgtagccttttcgtattggcttctttcacttagtaaaaagcaaataagtttcctccaagtcttttcatggcttgatagctcatttagatcttgattattattaacattttattaacattatatggatgtaccactgtttatttatttgcctattgaataacttgttggttaactccaagtttgggcaattatgaataaagctgccgtaaacatctgtatgcaggtttttacatggatgtttcagttcatttgagtaaataccaaggaaagtgatatttggatggtatggtgagagtatgcttagtttttaggaaattgccaaactgtcttccaaagtggccataccattttgcattaccaccagcaataaatgagagttcctgctgctccacatccttgtcagcatttggtggtgtcactgtggattttgggcatccagtagatgtgtaatggtatctcattgttttaatttggttgaacatcttttaatatacttttttttgccatctgtgtatcttttttggtgaagtgtctattaagatcttttgcttatttttccttgggttgttcatttccttattgtcgagttttaagaattctttgtatatttttgataacagtcccttatcagatgtgtcttttgcagatatcttctctcaatcattgtcctgtctttcacagagcagaagtttttaattttaatgaagttcagcttatcaattgtttctttcataaattgtacctttgttcttttatctaagaagtcatcaccatacctaaggtcatctaggtttcctccaatgttatcttctaggagctttatagttttgcagtgtgcatttagatctgttgtctgttttgagttagttttcatgaagggtgtaaagtcttatgtctagatttatttttttgtatgtggatctctagttgttccagcaccgtttgtggaaaggactatttttgctccacagtattgcctttgctccttggtcaaatatcagttgactatatatgtgagtctatttctgggctctgtattttgttcccttgatctgtttgtgtcttctttcaccaatatcacactgtcttgattacagtaactttatagcaagtcttgaagtggggtagtgtcagtcctctgactttgctcttctttggtattgagttggctctatactgggttgtttatatctccatataaacttcagaatcactttattggtaacttgctaggctcattattgggattgtgctgaatcaagttgggaagaactgacatcccttcaatatggaatcttcctgtacatggaataacacttcatgtatttataaagttctttgattagtttcattgaagttttgtagttttgctcagataggttttttacgtagttaaatttgtatctaagtgcctcattccaggaatgcaggaatgtgttgataatagaaattctattaatatgatttatcacattaggaagtttaaaaaatccataataattgcctttgatattataaaggtatatgataaaagtcaacatctatttttggtgtttaagaccataatcaagtaaaaatagacggatatttcattgaaatttaagatacccacacctcaaaagaaaaactagtatcacataaaatgatgaagccatagaacaatttcctatttccattaatgccagaagcatggtaaatatgcctactgcctctctcattacttaacattattgcagaaatgtcagctaatacaattgactgaaaaataattcaaaggaaaatgtaaaaatatcattgtttgtagttgatatcattttgaatacttgagaaatccaaataaactactactggaaacaatgaaatcatattcattgatgcatatttaatataatttttctgtatacaaacaatcaaaatatgaagattcttgataaaacagcagcaaaaataatatgctttagaataaactcaagaaaatatgcaggaatctatacaaagaaaactatacttgctaatgcatgtaaaagaagatttaaagaaatggaaggaacatgtattgctttgggatctgaagatttgatgttgaacagatataactataaataacacgttattgaataaagtaattttaattaaaattttagtttttgaagcttaataagttgattctgaaattcacatggaaattgatatatatggatcaaaaataaaacttctagaatatggattattttatttttagtgccttttaaatgacagataaatccaaagacctaaaggaaatgaaagataaatttgctaacataaagatttagaaaataaccataatacaaaaaatactacagaggtcaaaaatgaactgagaaaaatatttacaatatgtttacttgataaggggctaggttcttttatatatatatatatatatataaatatatatatatatatatatatatatttatatacaaataaacatatatattaaaatatatatatatactttaagttctggagtatatgtgcagcaagtggagttttgttacataggtatacacgtgtcatggtggtttgctgcacccatcaacccgtcatctacattaggtatttctcctaatgctatccctcccctagccccccagcccccaacagtccctgatgtgtgatgttcccctccctgtgtccatgtgttctcattgttcaactgacagttatgagtgaggacatgcagtgtttggttttctgttcctgtgttagtttgctgacagttatggcttccagcttcatctatgtccctgcaaaggacatgaactcatccttttttatagctgcatagtattccatggtgtatatgtgccacattttctttatccagactatcattgacaggcatttgggtttgttccaagtctttgctattgtgaacagtgctgcaataaacatatgtgtgcatgtgtctttatagtagaatgatttataatcctttgagtatgtacccagcaatgggattgctgggtcaaatggtatttctagttctagatccttgaggaattgtcacactatcttccacaatagttgaactaatttatactcccaccagcactgtaaaagcgttcctatttctccacatcatctacagcatctttgtctcctgactttttaatgatcgccattctaactggcatgagatgttatctcattgtggttttgatttgcatttctctgatgaccaattatgatgagcttttttttcatatgtttgttggctgcataaatgtcttcttttgagaagtgtctgttcatatccttcacccactttttgatggttttttttttcttgtaaatttgtttaagttctttgtagattctggatattggggctatgttctgtaatatatgaagagagctgttaaggaaaataatgaaatcccagtagacagatgggcagtgggaataagcagttcacacatacacacaagacaacataaccagcaaatagaataaaaggtgctgtgtctcatctactattaaaagaatggaaaagtgaaacaatgaggtaacattttttccctactggattggcaaatatttaaaagaataatacagtgttgccagaatatatatccataggaactctcctgcccagttggtgggaaagtgaattgccacaatctttttgtaggccaatttgtcaatatttgtattgaatttaaaaatgtgtatatccttgatccatcaatttcacttctagtaatttattcataaatgtactgacatgcacataaggtatacacataaggatgtctatcatagcagtgtttgtattgggaagatccaaacaaaacaaaatagaagtggaaagcacttaagtgtttcgcagtattcggaggactagttaaataaattaggatacatctatagaatagaatacttttaccagttcttaagcagaatgtattagattggcttgcatgtgtatggaaagctctctgaaacatattacgaataaaagcaagaaatagtacagcttgtggggtaagtgtccatttgtggttttacaaaatatataaactagaatttatacatgttgtctggaaggataaacaggaaactgttgatgatggttatctctgggagtttgaagtgtgagatggagaatgggctgttttatagtcccttttcaacagtttgaattttgtttattatgggcatgtgcagttttcacaataaaaaacaaaggttttttgttttatgtgcattacttatatttttttcttggatttttccagatttctcttgcactttgttttgttttgatgtttgggaactcaatgttattaacttcttattatgcttcttctttggtaattatttgggtaagtattccttaacacttatatggctgtttttgaaactaatggtttaacaattttttcttcactggcttaggattcatcagggttttctgtaggaaccatcttaagtgtcttactgaatattctagatgtatggtgttcaagtactcaattctaaaacagggaaaaaaaaaacaaggaaaaattagtatcatttcagaaaagtttctatgctttcttctcccttcctcctttgcatttttaatcctactcctgctccactttttgaacccctttcctctcattgcaatcttgtaacagccacccctcttcattccactgtgctcagaagatcaaggccttggttactttttcttctgttttttgttttgttttgtttttcttgttttgttttttgccccttgtctacttgtatggactattcagatggtttaagtaaggtgatgattcagttttattttgctaaatcactaccaagaacaactttagattatggagagattattttacagaattagaacaaattgatggaaggtcatctaattctttctgctacatatggcaggatgactttgtttttttgtttgtttgttttgttttgtttttttaaggtggagtttcactcttgttgcctacgctggagtgcaatggcgcaatcttggctcactccgcctcccaggttcaagcgtttctcctgcctcagccttccaagtagctgcgattacaggcatgtgccaccatgcccggctagttttgtatttttagtagagacggggtttctccatgttggtcaggctggtctctaactcctgacctcaggtgatctgcccacctcggcctcccaaagtgctgggattacaggcgtgagccaccatgcccggctggcaggatgactttgtaagtctaaaagtcttctgaaattttaagactgccttatttttggtggatttccattaaaatgttttgcagacttgttattccttatgtttaaagtacatgtgctttagtttccctgtgactttaaaagcgtattgcactgtcgtaattggaatatattcgacttcttgagtaattaagttactcagatcatttggggtttcttaatttctagaacccattacatttgaaacctccattttcatttattttacaaatgatatttatttaaaaacccatttttcggccaggcgcagtggctcacgcctctaatcccagcactttgggaggctgaggcaggtggatcacgaggtcaggagatcgagaccatcctggctaacaaggtgaaatcccatctctactgaaaatacaaaaaattagccgggcatggtggcgggcgcctgtagtcccagctactcaggaggctgaggcagaatggcatgaacccaggaggcggagcttgcagtgagctgagatcgcgccactacactccagcatgggcaacagagcgagactccatttcaaaaaaaaaaaaaaatacccatttctcaaaaatatgcctcttcccagtgtgggccgccacccttttcaggttgtgccttgagtatacttagctacagaaattagcaattagcatgatgctatattttcaacaacaacaacaagaaaaatcataactttgggattaataagtatagttcttcagttctgtgttctctgtttattattaggaaaggtgacaaagtactcagttgtatattttacatatgtattttctcatgtactgctatcacccaggataaagtatatgaatcttggtactatggacagggaaaccattgaatcgaatattacatacaaataaaatctaatttaagtacattttgtaggaaatttcttttcagttctatatgtcaggtatgctgctagatgcttcacactgaggtgtgccttaggtacgaattaagcatatttatgtatattccatatattttggtgtataaaaataaatgataacagggaatacagcatgtttgtgcatatttaactataaacacacatttgcatatatttataatttcactttgaaacctgaattgtatcacattttgtattctcaggtatttagaaacttccaaaaagatttaatttggtttgaagtatttatgttttgatctctaatcatatttttgccatgtttgaagtagttttagctccccaagggtaatacagtttggaagcattaccacctgaaaatacttcagagaagtatttagttgatccattaacatttcatttgctgtttaccctaagagtcagtaatttttagctaaaggaaaatcttatgcctgtatgactactgtccaaaattctgaaaatgttatatacctcatggctcagagataaatcagatatgtcaaatcagtcatagacatttacatatggtgattcctttttcaactttaaaaagtcacgcattcacctaattgactttggataatagggctataccttgaagtcactgactctagaaatgagcatgtggatggtatgtggaaagtcaaccatgtgctaaattttagatacttgagaatcttattatttagaagaattttttggtacttgaatttatgtctataagtattaactgtgtatactatgttatttttctctactcagggtattctggcaatgaaaccacatttcctgaaaataaatgtatctgaacttagtttatgggtgagaatcaatctattttaatgcttatgttttttcttctctaaaatatatcattggttttatgttttacttttaagaaaatgatctatgcaactcaggggatccaacagttttatagtattttagggctcagttttaatgtaccaaattgccctttttatgaaacaagttaaagttaatcctgggtatgtagtttaaaaattccagttttatttattactcatgtttcatctgagaaacagtgcatgtataagaaactgttaaagggaatttaactgcagtggttgtgtaaatcttctataaaatatattaattttgataagattgtatgattatatttttatttttagttactgtcccttgattttgagcaacatgcttgattttaaattgagatgcattttctagcattttctcttgtagatagtaatatgtatttcatgtatgattaaagcatttatttttttcttcctagcctatgtctgtggaatatgaagcatcaaagttatttttgttttcttttgtttaggttattcaaggatgtttttggttatttggaactgtcatacttaaatacttgacatctaaaatttttggtattgcagatgacgtaagtgcattttttacttaaatttgaaagacttgaaaagaatcgaataggctaagaataaattgagttattcaagtatcactattaaatgaaattctaggatgaagtctgttcacctattattttatttaatataatagaaagtaaatgtaattgtatatagattttcgttctccaaaattagtttcttaatctctttttttattggtccttctatgtcactaaaattttaacgcaggaaaactgtagataatagattaaagatcgaattttaagctctatacagtcatttttctctagcttctttgtaactggtaaagacaccatctttagagccttaattggagatcgtattatagtctcattcttttttctctccagttttcaagtcattacttgtaaaaggcttttataagcctttatagataatgtaatccaagtgagtcttatttagagaagatttttgtttatttttggtattagggtagaagggaagataaaatggagaagtctgtcttataattttaaagattctctctgtccataattgctttgcctattttattttggtgttttaatcagcacatcctaagtcaggaggctatcaaagatttaatttaaaaaagcagcacaagaaccaacatggaaaaaataaactatttttttcctatagtgtatttttattggtgattttcttctttctgtactagattaatgctatggttttgaaactgggttatgtgaagtcctaggacttcccaggaatcttccctgagggctgtctactcccctgtctcctagcctctcttttacccagggcagtttaacctcaatctctttcatacaggttttcataagaacaagggttatttttgcttaaaagattgaaaacacatggaccattaaatggttggtctacaatctgtggaaagatttttaaaactataaaactatagttgaaaatgtatttattcattcattcattcattcagtacctcctgtgtgcctgacagtggaaagtatgctagagataccaaactgagtaaggtatggtctagcggaaaattcggaaaataggaacaattcctagcagttacaatacagtgtaataaaggctatgataaaaaatgacgtacagagtgctgcaggaatacacaggaggagcatcagggaaggatcctggaagtcagctctgaggatgagagctgaaaggtgggtaagtcagccaatatgcagagcgtgatcaggaagacaagtgaaataaccctagtcctgcgtttatagaatctgttttactcactgggggaacatgaaccagttaaggtattaattcaggttaaagctattattgtcattttctgtcatagcctaaaattatgcagggccaaaaaagatgctataaactatgttatttgcaaattagaaataacttagttgtaactttagtatttttagaaatacgtaacgttgattaagggcattggctcataaattcttaattttgacattggttaaaggaagatagtggcaaggctacccagccttttatttcctactgagttctctacttttactgatagtgcctctgagcgtaggtttttagctgtccgccccaaatcaggtcagcctgttccagtagtacaggttctttttatgagtagccacactcggtcctgcccccttcaaaagaactgttggactaacagtatgggggagatgggggtggtgctgaggtggatgggagcaacctaggtaaaaatgccacagactcccactgtttttacccacagtttctcagttttttatgaatgaatgcttcccacattgttgcttccttttggttaatctctagaacctgatatgagtgttttttttataattttgtccaattttaaagtggttttggagaatgggagttaccagtttcttcactctgccgtatttggaagttgacacatttttttgatatatgagtgttgatctagtttgtatcctgggataaacctcacctgctcaaatgtagtatttcttttctatattgttggatttggttggctaatatttttaaggtgtttttcgtctattactcatgaggaatatttgttgtagttttcttgtaatgattttgtctggttttggtttcagggtaatgtcatctcctaaaattatttgcaagtgtcctgtctcctgttttcagaaagatttttatgtagaattggtattatctcttccttaaatgtttggtagaatttaacagtgaagccctcatggcctggagctttctttatgggtaggttttttactacaaattcaatttcattaggaagctctccagttcatctggagtgaactttggtagttttatgttcttagaggaatttttcccattttatatatgtcatcaaatggataatgctttttaaatttagtcagttaaaattcttattggaatttttgtgtatatgcatatttgggaagtgatctttttgttctttggttgacttctccttatttggatttggaattaatattggtcttctattaagagctgttgtgggttttttttttgtggtctttttttttatttttcctactttctggcaacttaggaaagtttttttttttttttgaaagtttagtaattcaatgttaaccatctcagtctagggctttttgggagggaaaatacttgatttctatttcagatatttgaatgctttttgttctattcaagttttctatttctttttgtgccagtgttggtgttttatgattttccagaaatgtatccattttacctaggttttacaatttattagcaaattgtgtagcctattcttcttactatgttgagtccatagttatttctccctttttcattttgctttttgtttgcatcatttatttccttcattagatttgctctagaggtctattgttttaatatttttaaagttatatctttttttagtcctctttggttttattgtgtttctctttgtcaccaattcctgtcctcattcttattcttacttctttttgtttcctgtcttctgatgcccaagggaaatacttagctctgttgtttttacctctcttattttctgatcaatgcttttaaagctaaaattttctttgtaagtatgtagtactcttttatgtatcttatagattgtctatttgtgattttttaaaaggttaagttttatgatatttaacttctaatcaagaatttttaaagcaatttctaggtattttctagttgtattgcatttataatcaaatatatacatatttttggaatttattgttacatggtatgtgaatattcaaaaatatttcacttgtgttcaaggataatgtgtattctctttgtgaagtttatattttctgtttgtgagctaattgattgtattcaccttttatgttaacttttgtcagcttttttattcaaggaggcagtgtttaacatttgcaatgaacactgtcaacttttctatttcttcctttagtttttgtcagttcttattctgtgtactttgaatccatatttttaactgcagatatgttggcaatatgtataatcttgcttttttgttaattttactagcatataatatttattgtctcttttcatatattttttgcttaaattcagttttgtgagacattataattgctaacagatttctttgttttaaacttacctggtatatcttcttccattcttctgttttcaacctttcagcatacttttaagtatttcttttggtgacaatataatattagattttttcccttaagtccaatttaagcatctgtcccttaattagtgaatttatgctctttacatatatggtaattgtcataatactaggacttatttctttcattttgtttgggatttgttttcttatgctattttaggtgctgtatattcttcctattgatttcttatgcttatcagcatacatttcttctcccaacaagacatagtattttgaaatgcttcatcacatacctgccaccatctagttcctactcttaccctgttccttctgcttcatgtagatatcatatagaattttagtcatggtttgtcctagatataatttctcctcttttctttggttgttgcttttttagactataatgaacttgaacatttggcaaatgttttatgtctttgtgccctagttttcttatttataaagtgaaaatccaccttcctcacatggctttttgtgggaggtaaatgtggcagtgtgagtgagaatccttgataacatgtgaataattatatgagaggtgattatcagtcaagaagtaccttttattccagtacctgcccatttctacttcactcaagtactcttttcaatctccttttcagaattcgtatttctttttctttaccccatagtcctttgtgcttttatgattaaaagaagtctgtgtgtgttcccaagcccagagctgctggtaggctccagcaagggagatgctgtgcggcctgtttcaccaggtttagcacagtaagctgggaaaacccaagggaaaaagcctttgggatgtcgatgagtgtggaaggtagggtgtcattggagctatcactattcagcaaaagaagggaactgtgaaggtggaggatatagcatttccttctttaacaaaagcaggcttggtgtgggaacagtgggctctataatgtaatgaaaactattttcagatactattgaaattaaaatatattattgcagtgtatggcttaatataatggtaactttatttcttaccaggctcatattggcaacttactaacatcaaaattctttagttataaggattttgatactttattgtatacctgtgcagcggagtttgactttatggaaaaagaggtaagatgtgatttctagttctgtttcctaaggttttggcccatacatttttcataaggagtgctcctcttatatcagactctttatgtgctgttatctcagtttgaaggaaaaggaaaatctggcagcttagaggaagatttttctgtttactttagtgcagctccctgaaatatatggcctttactcattttgataatttagaaatacacattcagactagcagtggttttctaggtgagtaaacacagaggcatttcaagttgccatttttcagtgatagcattaatttagtcaagctctcaaactcttacatttccactcattttgtggttatttaaatagatatttgctttgaaacatcaagtccaagcttttcattccaacagcatttttctttctaaaactgtattcagagatttagaaggaaagcagagagtagtttagtggattgtgagacagaagcctgtaattttgcttgatgttcttgaacaagcaactctcattcgtcgtgttatagtttactagtttctagtagcatgccataaacagatattgtgaagacaaaatgagataatacaaaggaaagtactttgatattttaaataagtaaatatttaaataaataaaatattaatttgcaatactttatgagctggtttagttcgacaagcatgtatatatgtgcatttttaacaccatccatgtggtactgattaattatattatctgtgtcactccttcagagtggtatgtgtatgtatatgaaactggccaacaatactctattgacatgttagtttccctcatgatcccactgtgttagcccagtgtccagagttccagaccagtggatgagagggcaccacacaggaaacttttatctaccggccatttggagttgagtgtgttctgcagaggtactgtttactccagtggcctgtcagtcttcatttattgtgttccggcaaatggttttgacacacagtggctgacaaaggtatatgagttttagtgttaaacctgctgaaacaaacaaaggaagcatatcttgcaagacattgaaatgcatgttcataggggttcaagactccttcaaatattagagaattaggatgtggtgaagttgtttaatgttattgagaacatcatacatactgctacagtctgagagtattaaacataagctatgtgatgaaagaaataatttattgagacatagcatgacttcagctaatttgaagaaaatagcaaaactgtttccagcataccattcctcatcactgtaagtatcttaattcatagggactgtgctgtagagacagagtactgtcagttcagggaacatatgttccaattatggtacacctatacagtggagaagaggggaaaatttaacatggtatttcctaatatgatatcatactgacatggaaagatgcttaagatatataagggagtaaacaaaatgatatagtcttattaacccataattaacacacataaaagtaaaaaaagtataaaagcaaaattttaacagtggttttttgggtggagagataattgagaggtgcacaggctcacaatgtgtagggctttgttattaaacttatttctattttttttctgctactaaagaaaatgtaaaagccttttgttcccctcaaacatagatcattattttgtttatgcgtgagaaagtgtgtgtgtgtgtgtttcaaggataatatttttatcccccacaaaatatacaggaaaagcttattccatttaaggagctttacataccttagatgaatattaagttggtctctctagttagataagtagcatgcaaaaagtgagcagtaatctcttcagtgacatttcacacttacaggtgtttgggtactgtatttttagtgtttcaactcagcattttggggaagttcatttctatggaaatgcaccttcctttttatgatggcagtcagtgagtagattggtgaatgttcatatttctctactttcagaaatttacctatttcattatttgaaatgaaattttgtttggttaaaatgtttccttctaacaaaacatctctttgaatttcagactccactgagatacacaaagacattattgcttccagttgttcttgtagtgtttgttgctattgttagaaaggtatgtctatcacttaagagctctttcttataatagaatattttcttgtttttacatagtagtcgcatatacttggccacatttatctgatacaacgttttgtatgggcttactgtaacatattctatgttttcttaatgatagcttttgatagacatttatatagcttcaaaatattctatctgctagcataaaacagacatcagaaaaggatggctcaagttccgatagtcatgtattttggaaggcatgatcagagaccatattgacccagatacaacttgcctgtgtaaattattactggcttttacctttaatgtaatatttccctaaaatatttaaaatatacctaagtgatttgtgcagtgtgcaataactcctggattgtgtttattattaatcagaaagaaaaaacagagtatttgcaatgtgttgatgaactagataaaatgtttaggtccccaagttggctttgacgataaaattcaaagcccagatataaataagatcaaagcaagtgtgatattccctctctttttttctttaagaattgtgcactctgtaaccaaatgtgtcttaagagaatgaacagaagttaatctgtgatggaaaaagagacgacagaccttaaaagtttcctgatacgtggccagtgatttctgtgttaacacaatgtcatttatttgtagaatattctgtattataacaattgttcatattatatatttgtactctgctttgtatagaacattttcacatgagtatttaaattggttattcaacagccctatggggtagacaaatgttatctccattttaacatacagaactgaaagatcaaagatgttgttaggagcctcgcatcatgtccacttaaaagcaagggaagagtgagactcgggctctgcaccttcccctatcgttgggctatgtctggtattcagctgtgtactccgacagcacttttaatctctaatcagttaagagtcagttcctgctgtgtgctaggctttgtgtgtgctttgcacttttgtatagtttatgtgggtttgcacctagtgggtactcaaaaaatactaagcattggccatccagaacatatgcaaaagacagcaacctgagtggtgagagatgatgaaaactattagctaggctgtttcgtttaaagaagaaaagatgtagatggaaagcggataattactttgaaatatggtaaaagcctgtgccttgaaaataaggttacacacaatctggctccttagaatcatggccaattccaggaggtatgacttttgaccagaactgatctcgactgataaggaaagtgttatagattcaagcagcagctggtggattctaagggctggattacagcctgtcatcagtgttgtagagaatatttgtactggagatacgattttagattagatgacctcctcattattgctgaatatgaaagcacagtgactgtgttttgaatgcttccagctgtgattatcaacctctgagccagctctccagttttctgagtgcactgttaagaagaggtgttgccaacaacgttggcatggtggaagcagcgctgaatgtgaatttgaagccagaagatctggtttcaagactgcagtgcttcttagtagttgtctacctacagggcaatcatttaatccatatgaacctgttgctcatttacaaaacgaggatgatataatctacccaacagggttgttgaatattagctttgatcagatactatacaaatataagattatgttgttgtgattattattttctgagttatctctatacttatattttcattaaaagttattttacagtttagaagatactttatttaaaatatcatttttcccaacacagcttttctaaagtgtttcaaaatctatttacagattattagtgatatgtggggtgtcttagctaaacaacagacacatgtaaggtaaatatgctattaagaattttattacctcctctgttcatttattaaatagatatttacagtgtattaattgtatacttacatgttgtgtacctaatatttgataattgatgtttttattgtggtcatttcccttcctggcatttcttcttatttcctatctgtgcagaacacagcacatcacttattcatccttcagatgttatccagtacagtctgacagtagccctgcacataatctacactcaaaggacacagttttgtacttcatttcagcagggaaagtaaattattacgtgagtggttttaggaccagtggactgcctttttggaaatgagcagggaaatataaaactggattcatacctcactttttacagaaaataaatttcagatgaaccagagaattatgtataggaaaaaaaaaacccaaaattaaccaagagggtttgtttataacctgagagttagagaggcctatagcatgcttggtattttccaccatcacaccctttgtcttactctcttaccatttgtcaccctttgtacttaaatgttgatgtgtgacccgtatctcctgaagggagcgatcatttttgttcaacagtttatatacagtgcctgcaagatagtaaaggatagtagttgaatgagtatttacatatgactaatgaacatgaaaaggtagtcttgatcctatggtaaagccattcaggttaaagtgaagaccttttcacttcttatatttctaaaaattaatagtatatccaatgcttgcaagagtgggaggtagtagatgggagggaagtttggcaatacacagtaaaacatatagtgggcctgtcctttagccctgcaggttccaccagtgcaagtgtaccctctagagatgctcacagaaatacagagatgatggggagagatgccttttgtagtattgtgtgttatgtgagaaatggaaacatccaaaatatctactatgatacatagagtggaatgttaggctatctttctggaaataggtccagtatacattattgaatttttaaaattgccagtgtgtgtgtgtataggataattatacttctctttaaaatttagagatttttatgtgtttgtgcatagaaatgatccggaaagataaatcctgtaattattaagagtgggattagaggatggagtgaaggtagttttaactctacttttattcttttgtgggattttggggggagaaggattgtcgaatgtgtatgtatctatattttcttttttttaatttttctttttttttttttttttttgagacagagcctcactctgtcacccaggctggaggagtgcagtggcacgatctcggctcactgcaacctccgcctcccgggttcaggcgattcgtctgcctcagcctcctgaatagctaagactacaggcgaccaccaccacgcccagctaatttttgtatttttagtagagacggggtttcaccatattggccaggctggtcttgaactcatgaactcgtgatctgcctgccttagcctcccaaagtgctgggattataggcatgagccactgcgcctggccctatattttattttataatttgaatatacacacccttgtattattccctcacctccaagtctctgccaacataatgataaattattgcacatactcctgagagaatccttgttctcatttagaaacaatttactgtaacatatacaggtatatgtttatacctgtaacatttgagttgagggctaagggggaaagaaaaacgttctggtttacaatgccgaaatttttcatttgaggtgaaattatttttgaagagctcaggaagaagctacaaagtttcagctgtagtatgcaactctggaagaggaaggtggaacttctcacagaaacaaagctgtcccttcaagagtaataactcacctatagaagtaattataggaaaccattgagcttcatggagttgtcagttcaaataggatcagagctcttttttggaagaggagtggcatgttgacattttattttgcatagctaccaaagccagtgtaaaaaggagaagagtaggacataaattttaactatcaaagacatgaatgccaatattctctttactcaaagacccaggaagtaaagtgggatagagacagcatgatgtagtaaaaagtatattggctctgaagtcagtcagaatatagtcctggctgccacttactagctctgtgattcctttccttggctgtaaattggggtaataaatggttgtaggattagagttaatggaatgtactaagcatattaacattgtaagtactcaacaaatggtaactgatagtttttacttggtgtgaaagaagaataaagaactgtttcatctccttcactagccccttatgtgtcctgagtttgctaatatatcagtctttttgaggctagattctcaaattagattatatgctacctggattaacagtttattgatacacttgttcattcattaaaaatgttgagctctaagtgtcaggtattactctaggtcttgggaacatatcagtgcttaagaaagagaaggtgtgtgttgtcaactcacacatttctgtctctgacccagacttctcccttgaactcagatttacacatataaccacgtatttgttatctctacttggttgcctagtgaaaatctcaaaggtttttttcattccatgctttgctggggtatcaccagtgagggagctgggacaccaccgtgtgcctttgttgtcctaataaatacccatgtagtcaaataggatataatacaacattgtcattcttcataaattttcttaaaatagtatagcaccagttttggcatgtgacttttagttattttgatttgcctgtgtgtgtcctgagagaatgttatagaagttgtaaaactcctgtttgcaagatgaaaatgcaaatatatgacgtaagtgcttcaataatgaattgatggcaatatatttttttctgttccagaaaacaccagtttgatcatggagaggtaaagacttaatatgactataattttacttatcttaaagttgcatgcatttggactttcctttctagttccagtttctaactttgttggcaattgtcagcaatcatcttgaaaatagcctgttatgtgtttttatgagaatgctatatgcagattcactgactattcatttgttaaaattaactaggaaactcatatgttctgctctgatcatctttacactaatggcagttgatttctggagcccatttagacatatgtatgaggtgtctattgcatgattggaaatcactttcctctctgctcaccttgcttgaggcctcagagatgtgattggttactgctcccatctcctagttgtccagtctggttttgagggcagttccaaggtggagccctcagatcttgaggcagcagtcatttcttttaccactgtcttttcttggtctgatggtagcatcaaggttgattaaaaaatgtgggctttattaaccacaggtttgactctgagaatcacagaaacacttgccttaatgactttataattttagccttccactaaaatggaacagtttgaaagtgaattttaagaattgttttcgaagtttcagaaaccttagtagtattttttgttactaaggagaacgtacccctttctgcatattgccagtttagtattcttaaacttcacaaacagtaggagtaaaaaacattttcttctttctttcagctggtttaccatgcattgcaattgttagcatatacagcccttggtattttaattatgagactaaaactcttcttgacaccacacatgtgtgttatggcatcactgatctgctcaagacaggtaacatgttatgttggagtatagctactatgataattttagcctttattattgagtggccctaaaataatgaattacaaagtcttttaagtgattatagttaaagctcttcatggttttgtacttatctttcttaaagggtaagggccaaagctgatcattttctatctttctaaagatttaaaatagttgttggtgtacaactaataccgatttagtacagactgagttcatgagtgattactgcaggtgctgatagaaagcagagcttaattgtacaaataataactttttttgttttgacattcatatcacaaagaaatctaataatttcaggttataagtgcttgaaaattatatgttctttttttagtatcaaacttatttttttttcagttggtgcaatttgtgtgcacattcttgacttgtgctttttaaaatttagtttaagccttccttggtggtttgctgcttatttttcctggatagctgcctccttgttctgtattcacagatttatgcttctccatagtgtcacctttccatcagtcaaccagcctaggtacaacagcagcacctcccttagacgtagcagatagtcactaagcacctacactgcgcactctagggatggaggagagagtagtagacagaaaagtcaaaagccagtgtttataagccctcaagaaacttgaaatctagctctgtagacatgtggagaaagatcaagagaacaaagtgttgttatggagtgtggactatttggatgtggaaaaaattagccagccttgaggttcccaatcagtatgttgtattatgttagaaaggcactactttctacctttctgaccccttcaggctggcacaggaaaggaggctggttggaagcctttaatcttgagtcttatcccacagcatgactgatgatataggttggtgcaaaagtaattgtggattttgtcgttaaaaatagcaaaacccgcaattacttttgcaccaacctaatagaaagtgtcacccagggcaggttttccaagtgtggggttcctgctggtcacacaggacctcacattcaggaccctgaacttgattgaatgtttgctgctgctgttttgaacgtcttaattttttaacaagagaccccacatttttgttttgtactgggccttgtaaattggttgtggctttacttgaatctgggagtagtgaaagcaggttgagaaaagagcttcctacattgtgttccacttatatgaggctgatggtagaatccttttgatcccaaagattattattttggggctttttctttaggataattaatcctttatttgggactctagcagaggccttattcttctctgggaagaagttttgcataacagatgcatactacttatactaacaattaccaatgtattcttaatttggtttcagctatttggatggctcttttgcaaagtacatcctggtgctattgtgtttgctatattagcagcaatgtcaatacaaggttcagcaaatctgcaaacccagtggaatattgtaggggagttcagcaatttgccccaagaagaacttatagaatggatcaaatatagtactaaaccaggtaaaaaaaaaaaaaagaaaaaaaaagtcatattatttagctgtttttcccacaattttatataccactgcaaactcttaaaccctagttacttccactgatctcactctttctatgcaatgttgcttttagaatatctaaaacaaaggagatatcaatcctgtttaaatggtttgcaggggaaatgttatacatatgttcttagtaatttattctgccattttttatagattttaattttttcaaaatttattcacagtcataaatgccacatttaaaataatttttcctgtgcttattttcttaatgaatttttaatattagtccttcacattccttcttgaaataaactcatggaatgtgacattttattcatgtgtggaaagggagactttgttgtcatctgagtatcaaatgattgaatactaaatcatcttccagaactccttgttactgtaaagctttcctagtccatttgatacttcttttttagattcaggaaagatttctaagattttttctttaaagaaagaaagaaatctttaatgatgagatgatgaagctctgttttccaaggaaaatagtttacccaggcctggctgccaactgctactttatcagccatctgacttcatgctagttctgccattgaatcttgaagtcatgaacctgctgggcttccgctctgttacctgtgaaataattgatttacacttgaaggagacaccttctcgccttcactgagtgtcttcctgagacattcctcttgccttccagatgcagtgtttgcgggtgccatgcccacgatggcaagtgttaagctctctgcacttcggcccattgtgaatcatccacattatgaagacgcaggcttgaggtcagtgcacagtcttgcatcatcaaaacaaacctcccatgcaaacagacagtgagtggaggacaccagcaaagtaataaggaatgtttcaaaaggatatgatgaactgaggcttatcgagtcagggagcagaaagctgaaataagaccgctaagctctaaacaaatccgttaaagcttcacagggcaggaaagtgacaactttgggggctctcttctctaccaggcatataaacgaagtcatactatagcactttcccacaggttaacagggctctaaaatgtccaagtccttttcatcctgtaactccctggggagtttagcttagagtgtttattaaggttttctcataggtgatttttcttgagtttggagaagtcatttgaaatagaatcccattcaaagaggagtttattctggttttcaccagtatagcctgttagaatgatcttgggtgttttatgtttttttagatttttttgagactttaaaaaataatttagagatgtgttgtccaaatttttttttaaaaatttaatttttcttgcagtttctaaggcaggtgaagctattcattttctaagtgattaggtgaatcttattagcatcttctttttcataacaatggcatgtacattcacaaataagctttttcattaaaaaatcaatctcatcaagctaatttccagaccaattttgttaaataagtttagtttttcttaaatctagaaataaaatgaagaaccatttaatgtgaattattgttgatgtctaagttgggactgttgcagcttcacagtagtcctatagttgtgtttgttgtagttcatccctgttcacacacagggtaccttactcttacatgtgatagcgaagtgaagaatttaagacaaataaataagtgaacaaacacaaagagaccaagtttgggaatgtaggggtgtgttaaaggtcaccctcttctccacaacttgtcctcctcctgccttctgcttttgacctcactgatgccccttagcgggaacttccatggggaatttcctcctgactggattcttcttcatcgtcttctagtctaattcagtgctttcttccaaatgtgttattgtatcgttttagtcttgaaaattttatgcccaattatttttctttaaagagccagaacaaaaatagtatactcaatgtatagtcggaaagcagccgaagaagtgaagcgagaactgataaagttaaaagtgaactattacattctagaagagtcatggtgtgtaagaagatccaagtgagtatcaacacagttaacattttataatcataagacatgaaggttaattcaagcacatggcacatgctttgctggtggcgggggtgtgtatataacataaagtatacatggaaaaacttcttcttttttttttaaacaggctctcactctgttgcccaggctggagtgcactggcatgatctgggctcactgcaagctccacttaatttttgtatttttagtggagatggggttttgctgtgttgaccaggctggtctcaaactcctggcctcaagtgctactcctgccttggcctcccaaagtgctgggagtacaggcgtgagtcaccacgcctggcctgaaaaaactttttagataatgatttggagactttcttttatagtctttataaatatcttttttttttaaataatgatttgtatgtgtatactaccttaaagagattttattggcactagttgataatctcccaaattgttcatatttgcctttgatgttttaaaagaaacttttatttaaagttggatgtattttctttcaaaagacttccagggtctgaaaccaagtaatggggagtctcttttggtgaagtcaggcagctgagcaccaggggtcacattatccttactgggtctctgtgctacaccatgtcctgtcgatggatgggataccctgtcagcaaaaactcagaatgaaatttttctttcctggtgtttcacatcttacttgaatgggaaaatgactctactgtgacccactttctcttgggtttatagtttttaagtttctatttccacagagatgtttactaagctgagtatagctccaagtgacagtaagatcttcaaagcagatgtgaatctaaagctatctagaaatgtggcacgtaagtgactggacaccaggtgacagtagcctgcttttaaagtaccaaaacattcacttcatgaagagcacagtacaggaacaattttatcagaaataaacactattttatggaataataatattttttaaattcttactattctgtaactaaacaaaagcgttcaagagattgctatatttgtggcttgatcacactttcccaccatatatttcaatgacacatatggtattaagacaacattgttaaatactgagtcgtgagtgaaaaatagttctgtgacatagtatctacagctttgctcacaaggaaactaaaataattgttgattatagaatgattctcctatgaacgtgtgctacgtggtttgaattcagtcaggatttatagaaaatgttattttgtaataattcagaaaatgttttaagcgtttgtgaatatgtatatgaaattcacatactcacctttaacattgttatataaatttaggacagaaaagttctaagcatctcatgacgatcttaggaaattatatgaaatgaatgataggctgacatttgcaataggaagaactcagttcttagcatagctttctaccagaatggggatcttctttatttctttgggcttcactctcttgaaacaactgtaagttactggaacataaaaataattttcgtaaccttttttctccaagctaacaatgagcctttgagagttcatattctgcctagacccctgcatagagtttgaatatgtgaaagttgcagaggctttgtgctgtagagtgttgggagagctccctggatttgcatagctctaacagtctcatgtttgggtaggcagagcactgttttacccacacaagaagggatatgaaggcaaattcaggatgtatggcaataaactttgcacactaaacaaaatcagcagacattgaactgacttcaagtcacttacgagcaatcagactgagagttggggtgcagaagagggtgtgctggatttccccatctggaccttgacttgccatttattgtgtctgtcacagcaggagttgagtgggaggaagctacgaaagtgactctctcatctgttttccccactcattaaaacaacactctccatctagtacaagatctaagccaggctgatgacacactgtcaggaaaccttggacaggtccactctgcttcaaccttgacacaaaacaaaagctgtgctttctgtcctgacagggaagcaaatggggagttcagataggagaggaaagtgaagaatgactaatatttatctagtgtttacatttagagtaggaagtttcttgacaaagctttctgcctggtttgggaccttccttatttccttggccttcactctccatttcagttatgatcagcctgaaacccctgtagattgctgggacgtgaaagtatgttggaatgggggaagcagatggggaactcagttaggagaggaaggggaagagggaccaatatttatctagtgcttaatctgtgcctggcaattggtgagcactatgtttaaatgatctcatttacaagtggcttaattgtatggcttgattattccttaaatatttgacactgtgtttaaatataaacactcaaatatatttgcatgcaagttgtagattagttttaaattaactacagttctctgctttcttttactccaataatagagttgacatagaatacatgtatttagaaggaaattattcagattttcactaatgctatttgcagatggctggcctggggaaaccttgggaaactcagatgaggactaaatagtgttgcacaaggcaaacagagctccccaagacagctgtttgccctctctttttcctaaaagctgttgaactcaggaaaactgtgggtcgttctctactttctgtgtgtctcactctctgccaccgtgggccctcagtgttgtaacagttcagccttgacgtgtatgagaaaattacaaggtagaaaacccatgcccagccatatgatcataggtgttccatgtgagtagaaaccagtgtcagcaaaggtgtgcaaaaagtgtgcacttgagccctcttcatgggaacactcactggcaaaacatttctaggggatagtttgatgaagggaaggtaagaaaaaaattgtgcagtcctttggcagagtgataatgttgcctctagagcaggggtctccaagcccccggccatggaccagtactggtctgtggcctgttaggaacccagtctcacagcaggaggtgagcggagggtgaacaagcattacagcctgagctctggctcctgtcagatgagtggcagcattagattctcataggagtatgaaccctattgtgaactgcacatgcgggggatctagggtacgtgctccttatgagaatctaatgcctgatgatctgaggtgaaacaatttcatcccaaaaccatcgcccccaccctccagcccatggaaaaattgtcttgcaggaaaccagtccctggtgccaaaaagaccggggaccgctgctctagaggtttagtttgcagaagggagctctgcacaagactgtttgtagctgcattgctttataatggcaaaatgggaaacaattaaagtatctgtctgtaaagaattggttaaatagtacatatgagaactagcagcttttaaaaacagtagaatagatctttatgcactgagatggaaaaatggttccacgttttattgttcagtatacagtcccagaataattccatttttgtaaaaacaactcaagagcatctgccagggttttccagagggacagaactaataggatagatgtggccgggcgcggtgggtcacgcctgtaatcccagcactttgggaggctgagatgggcagatcatgaggtcaggagatcgagaccatcttggctaacacggtgaaaccttatgtctactaaaaatacaaaaacttagctgggcgtggtggtgggcacctgtaatcccagctactcaggaggcagaggcaggagaatgacgtgaacctgggaggtggagcttgcagtgagccgagatcacaccactgcactccagcctgggcgacagagggaaacgccatctcaaaaataaaaaaaggatagatgtatatatgaaatggagtttattaaggagtactgactcacacgatcacaaggtgaggccccacaataggccatctgcaagctgaggaacaaagaagccagtctgagtcccaaaacttcaaaagtagggaagctgacagtgcagccttcaatctgtggctgaaggcccaaggtcccctggcaaaccactggtgtagacccaagagtccaaaaactgaagaacttggagtctgatgttcaagggcaggaaacatccagcacaggagaaagatggaggccagaagactcagccagtctagtccttccacaattcttttgcctgcttttattctagccatgctggcagctgattagatggtacccacacagattgagggtgggtcaacctctcccagtccactgactcaaacattaatctcccttggcaacaccctcacagacacacccagaaacaatactttgatccttcaatccaatcaagttgacactcaatactgaccatcacagcatctatgtatataatgatatctgtgtctgtatgtgtgtctgacattggagaaagatacagcagatagcaaatattgtatgttctcacttataagtgggaactaagctaccaggatgcgaagcataataatggtacggactgtggactcgggaagcgaggagtggggtgagggataaaagactacacattgggtacactttacactgctctggtggtgggtgcaccaaaatctcagtaactgccactgaataacttatccgtgtaaccaaaaaccacttgtttcccaaaagctattgaaataatttttttttttttaaaaaggtccagcaggatatatgctggattgtttatagaagtcacctctgagaaatgctattggagatgatggtgactttcatttcttaaaatgtatgtaggtctatattttgatacttttataatgactgattattataaattaaaggtgttatttaaaaagggaaaatgatgtacatacctgctacggtgtttgcctcatggtggagagtgagggagggactgctactaaacataagagggacttgggaatttttttctcttatttaaaaataaaaagggatgcaattatgacaaacatgagcagttgtcaattctctataattttcccatgtttttctgttttttaaaattcctcaaaaggtagatagcagcatccaacagttatatccataaaactgttcttgatttaagataaatggtactgttattttgaaggacttatttaggcaaatgtcatatgccaatttataaagatatgttgcttttgagatttaattatgtgtttaagatgtatgctcaacactaccagaatttctttaaattgattcattctagaatatcgactgtccaatttaagatgttttgacctactgatttttttactttatgacagtgttaaagccatatgcattcagtagaaagcatatttcaaatacccatacaaccattctgtttttcagtgtcagtacagcattcaataaattacatgagatattcaatgttttgttgtaaaatagcatttgtatttgatgattttgtccaactgtaagctaatataagtgttcctagcatgtttaaggtaggctaggctaagccgtgatgttgggtagattaggtgtattaaatgcattttcaacttatgatgggtttattggaacataccccattgtaagttgaggagcatctatacaattaatgcagcttccctgtgaactaagcatatttgttcattataattttttaaatcaatgtcatacgtttttctgtgtgaatggtgctagatacctggtctctcataatcctcacaacaaacctatgtcatggttgtttatttccccattttacaaatgtgaaaactaagaccaagggaagctacctgcccagaaccacattcttgataagtagctgaggcagagtttaactgaggtgtctctttccgcaacacctggatatatgtatctacaggtctgtttctttccttatagtcacctttgctgcattgaccttgtcctaaggtgagtcatggcagcttataaaaacataaatagctatgtaacaggattgtttaaaaactaaagtaatttaaggggaaaaaaggaattgaggtcaggaatgtaagaagtgctctgctttctctgcagttatataatgcatattgatttttaacatgtacattcatttttctaggcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttataggtaactgttttcaaatagaaaacgttttatttggtcaatttgaatgtcattctaattataaaaatgacttacacctttatcaattggttactatttcaatgcaccctttaaaatttgctatgcaaatgagtatatgcttgtacttgactttaatatttgtgctaaagtgagcaaagctacctgtataaagaaaacacagtgggttgtgacaaggatgacatgaaaatacaggacaattctgacaatgtaggggctgattttatagtgtaagaactattaatgccccttgcttcttttttctgcctcttgctcttgtcttttggacatttcagtgattgtaagttcttcggtcatgtcagcccctgtcatcaacttgagttacagtagatggggcagacatggagtgtttgctatatagaactatctgtttgttttacttccttgtgcgctttttgttctctgttctcttgttaatgaagcttttcctgcccattattaatccaaactcttggaccttgtggttaggaaattcccttaacttccagccatatggcattatcgtgtctctttctctctctctcttgctctctctcttctcctcttccccatattttctgtcaaataagtactgtttactcatttagttgcttatcaagtacttattcttggttttaaaaaaaattaatggtaactgtatttttctcatttttagcattattcaaatgtttatattttaatacctttaaaccactttaaagttttttcatgtttaattatagttttaagaaaaactattttgaacaaccccaaatatagtgcatctagaaactaatgtatatttgattagacatcatttatagtggaacagtagactgtagtacatggtaatttttcttttactattaagatacaataaaacatgactaattttgctgtcaaaaatgtaaagaataatgataaatggagtttttatattttacttttaagattgcctgtctttaataagacaaagccttaagccttatgttataattttggttctaaaaaccatcatttcagtataaggaataagtatatttcgtcctcctctttagtttttttcttcctatttatttttattttgaaaaatttctacaccttctttgaattccttgtatgaatttttgtttcttagaagttaatttgtgtgaaatgagattcttcaaaacgatgaaacctcatagctctgagaaaaggttttagggttttaaattctaagcaaagcgtgactatggctgacagactacacatttaattatacagcttctctttcttaaccacaggcagattaacctcattgtggattgtccttcagaccttagtcctcaggcatggtttctggtgcccactcctggaagccgctgttccctttctaccttcttaccagagcccaagggcaggcctggtcccggggaagcagcagcttgctgacataagtcagctgcaaaggctgaggagtgtgccctcagagaagcaccgccccccagtcttgtgccagcgcctagagccgcagctcccagggatgctccttccctggaggcagcccaggagagggactctggcagcgttcttcagatttgtggccactgtttctcatttgctggttgactgtttttatttcttaggcttttgctagttttagaaaatagggaagcagcccttgatttgtggattaaaagcaacatttgagcgatgatgcacaacagtccaggaaaatgggcggtggacacttgaggctgaggatgggagttgacatgagcagggagagggaggtgcgcgctgcttatctgtgattgttgctcacctgagtgtggctgattgtgtacatccagcagttacaatttttaaaaattatacttttacatttattttatatttttctcacccccagtaatttccttccaaagaagttcacatgtaataagtagaaattctgtataggaaaaaagcattaaaaatactattataactgcttcatttgctgggaaccattaaaagtaatataaattagctttttccagaaggatccttttgtagcagtgtttatgaatgtaacccccagcaaaatatggctatatattaggggagccagtttggagcagaggcctgaaggtccctgctatgcagccgtggccacagctcgcagcccaagcactgtggagcatccacacctttgatggcaatgcagattggtagcaggttccataggcgtacaaaacagtattaaagctcagtgttttgcatattgttagcatttacaaatatttttgctttagtatgaggaaagtaaggatgggcaaagaagcgatcaaaatagctattgctacaacattttcgaaaacaaagttggggctgtatttctttaaaaagataagcctctaaaaatgcttggcaaaaaaaatatagtgttaaaataggccagtgatattaatgagaaaatgaaagtatgtatcaggaataaagtgatattgcataggagtattgtatttttatgaattttatgccagttgtttacatgtactatatatgttaaattaaaaaaaatcatgagtaatg

SEQ ID NO: 37793 - DNA, 111856 bp, Homo sapiens
caggaaaggggtccccggactctggggctctcagcacctgcggtcgcaaaccaacctcatgccctgactttaccaggcgtcgggactctgacttaaccggggaatgagggacttggtctggcggcaggtaattttgtgaagaggatgagaaggaagagggggaggtggtggtgatggccaggacgctgtggccctgtgtccagccgtagcttgggagtgggatggttggttctgccacatggccacggtgaggtacgtgccaggttctccaggagtgccgcgtgtggtgccccaaacaagatgcaagctcctaacataaagagacgtgtctgagctgtggggtggaggaaggggggcggtgggggagagggagatttttatcaaaattgaacacagattgctgagatctgggcttgatttaactcttctctctctgcctcggccacttctccacagttttggagtggatttggaacgtttctcggagggttagaggaaaatcacacctctccggaaaagagtccccataggttttcccttgatgcccacgtgggaatgaaagcagcttcccatctttaaaaagttcaaagtcttgtgttttcccccttctgagtttggtgttagtttcctgagtttctttgcaaagccagctgaagcgggggatggattttccctagggcctagggcggaaagtgtgctccacggagagtaggggaaaaaagcagcagtgaggctgtatcgatccatcatccctgagtagcacagtgccaggcactgcctgtcaatagctgggttccacaaacgagtgaccacagacagactgaattttcagctttgagctagccaggtctctggttttgtattttgcagtagagccaacctacaatgtctgggtgggaggaagattactggactctccctctgtcctagaaaaatgagaaaatgaagggacagggaggaaatctggatgtaaaaacagacccacaggaagttaagattcaggaaggattttagaaattatataaattgaaccccagggaagctccataaaagatggagcaggcagcaatgtcagaaacagactcatttaacttcaggagtacgttgtcaactgaagtgtaatgaaggaggaggaaatcatcccataggcaatgtaaacaagggtgcatgtaaacaggagtgactggtccccatgagatgcacatgcctatgtgtttttacacatacatgactgtgtggtgatggccatggccttagacatgggaggataaatggtctatttcttcatctgtgctgggaactccatctaacccccatttcttcctttatgcaaacaactgtgctattattgtcttgctccctggtagttgcaaactctggctcctaactcccagctgagttttcagagcttttcctccagcgcctcggatgctgagggaatactcgtgcccccatcaggacaaaaagaggagagaacattctcctgggcattagaacttagagagtcaggggctcaagaaggcggaggctgtgcaggcaagaccaataggaaggcctgtaaatgattttgtttttggtgagcgtggaggaagttgaaatactactgcttgctgtgagaacatgttctctccccagtcttctttcccgactgtctccaaagtttttgatgcaaaacagattaaactccccattactaaagagccttggatccaggtgtaaagaatgaagataaagggtaagtacaggcagtagagaaagcatagagataatgaaagatgaggctttcttatttgattttactagagccaatggaagtaacaagtttaaatgttctcattcatttccattatttaaacatagaagactacccagggacagaagggacccctcggaacaggattcccagaaatactcttatcccagcatacaactcctcagggacaggtgaggggcaagaactgggttttcaactctttctacatgtggggtttctgggagtgctgcatgtgggatcagtggagtcctgatgcttctgggcttgtactaggagacatttcactatggccgggatgaattcccaggccatggatgcctaggctgacattgaagccttctcatggctcattctatcagttcaatcttctggccagctctttggtcatctttgagattagattaagtagatgggatgcattccaagacatccttgaaggtccagagggcaaacacagctggcagaaagaacaagttgaaggatatccttggctttgatagcggatgaccctctagatctcaacagccagagactctgtcaaggatcctgtgtcattcagccctagacttcagaggcagcccgacaacaatggaaagagtgcagatttctgatcagctgcctggagagagagaactgtgacctaaatacgaattagtaacctgggctacatgacttattccttctgagcttcagcttcctcatctgtaaaataaggatagtatttccctccccaggtcattatgaaaacatttatgcacaagaactaagaacagagctcagaatgttataagacccttcataaagggagtgctgtatttttatttttcagtttttcagccatcacaagccagtattgcttggaaagaacctctccccaaatctagctacatattttccatgattgaaggctagtgggtggagtttctagggctctgatcatccttacttccttcctctagaaaaggtgaccaatgaagatattccatgagcatccctggtccattatcctgaagtgtgggagaagaaaccagggatcctggatgtctggcctagaaatcactcttgtgtttgtgctctttagggagggagaaggacagaagagcaggttgtataagtatggtggggaggggaaaggtagggaggtgggggtagggcaggagggtcaaggaccaattggatcttgaaggacaagcctgagtcagagagcgggtaggcagccactccttgtcaagggtgctcaggtcagagtaatgggggaatctgatgggttgtaaagaatgaaagctttagtcattgcaaacatctccagtgggtatggggtgggaggctgccccctgaaccctgattgatacattatccaagggagtgactactccaaaggaacaaaggaacatctgatgttagagagcagctgcaggtcctcttggcccatctcaaagcttgtaagttatccttcaagttgacatttaagattttgaagatcacatttgtttttgttttgttcaagctctctctttaaccatggcctgggatgacttttaagcttttaagaggctcaaccagtggtcaacttctcttgagatggcccagagcgggggtcagtgaattcctcactcttggcagcatctatttctccaactctctccacattttttggtttgttttttgtttcattatgaggttctaaaactgcacagtcaagatgctgtggggggaggaagtaagtgcctgttcttggaacctgtgcagcgttatgctagcactggccaagacttatcagactatggttattaataggtgttatgggtttctttctggggtccccctccaaaaaaaaaaaaaaaaaaaaaacctgtaaaaaaaaaatgaactttaggcagtttgatgtctctttcaatcctggccaaagaggagctgaattatttgtggtacatcctatggttccaaggaagagctttagaatcaagcagacagagatttgagttctggcaccaccaggtcacaagcttgctaacctctctgagtcttctttatctgttaaatgagaacaataactattctcattccccagggttgttctgaaaatgaaatggaatgatataagggaagaagctagcaaactgctcagtaaaatgttaatgccattcccctctccagttctaagtccgtgaaaatacatgggtttagacatttgtccacaggtcaaagtaaataagccacttattcaaggattaacaactgtgcttggaggtcagatatctcagcctggagatggagaccctttatacaaaagtggggcacagaacagtgctccccatgccaagcaaatggcagccccatgtgaccctctattggaataaaggaaaggccactagctcactcacccatgaatttgggctatttagtgagctctccatagagcttgtttaaaaagctcaaatactgtcctgagaatcaaggtcaaactgaggacagaaatcattgaggcagtacctaacattaaaatctaataatgatgtcacaatgacagcagtattttaaatttatataacattgtatcatttgaaaggtacattgtctcatttaaacatcgttgacaatcatatgagattgatattaaccacatttcacagcccaaattctgaggacttaaaaaacttaccatatttcacaccttaagtaagtggaataaacagaaaacaaactgttccccaagcagtgggtctcaaccctggctgcacattagaaccacttgggggagcttgtaaaagtatcaatgcttgggcccaccccagatcaatttaattagactccttgggaatggaacctaggcgtccacagttctgtaagcttcccaggtgatctgaagtctaagctgagaatcactggtctaagaggagtgaaaagcaccaaagttaggacccaggataccaggcatgggaaaaagaaacagccaagactttgctaggatttaagccctatgagggtgcagacttcgtatggttctccctgtatccctggagcctaggagagtgccagctacaaggtaagtgctcaataaacattgggtagatgaacaaatgaacaagataccatagattagaagttgtcaatttcaacagtgaaacccagcttgtcatcttgttttatagataaagttttattggaacacagccatctctgttcatttgtgctttgcctatggctgctttcgtgctgcaatggcagagttgagtagatgtgacagagactgcatggcctacaaagctgaaaacatttaccatctagcatttcacaggaaaggtttgctggctcctgctctggatcccagacatgaacagagcaagtatagtagcttagggaaggtcattactgcatggttgttaagaatatgggttctagaatcagataaacctatgtatgattcctggaacacttacctattaaaagagcttgcaaattatttcacctttctgattctcagttttcgcatctgaaaagtggggatgataataaaatacctccctcataggatgactgtgagggttgtcagcccctggcggagagtaacattagctatagctatggtagttgctgtagttactagcaatcagccacatagagaactaactagacaaaagtcaaaatctaaatccagtatcacaaggtagatcaagggatgaagtaggaaaaaataggcagtcagtaagcttgtgtgaagaaagactaatgtgaggtttctgagataaatggtgtccttttaagacaacacagatcaggccccaggaagtgtgagtgaggtgcttttgtatgaccaattgctgtgtcggccagcaatccccatcagtcctcaagggttaacttaagtttcattgcaccaaatctagtctcaagaacagtgcacctgtatacatagttctttctacctgaaagtccttgcctcagtcctggtcttcctgatctactcatcctccaaggcctgctcaggtgtccctttttttctcaaattccctctacaaggctcattccaacccccttttcctccttattcccttgaacctggcacacaactctgtcatcacattgaacacattgcattaccgtcgaggaaggaccaagtctccttcatgctttctacatgtttacagctcataaaagtcaaattgcattgtagaatcgacgcctggaagccaaaccatatcaactaggcccttaatccaaggcaatcatgtctgagtttgaggaatgagtaggacttgcccaggtgtgatgggcttgcaagagctagtctccataaccagaggggcaggagctacccagtttatcgactatgtggatactttgtgtcctcgtctccccactgtttggtggctcctgccctccacaacacttctagggggtagccagagacagggaaagatggaagaaacttaaaaccaactctttgatttcttgtcagcagatgtggtgaaaagtcgggttttgtcttctgtaggcttttcatggatatgtgccaagataattgggagttgatttggtatgtgccaagagaattgggatttggctctttcgttagcaccgtaatagaaatatggccacaaataatagcaaacaaataatgcacagttttgctgtttgactacagaatgtgttgcataatttttatagactttagtggcagacttattttggtggcagatatatattgtgtgtggaataatgtaaaaatgaagttctattctgatggtgaaggggagggcacagaaaactcttcaccttgagttaaatatttcttttgatcctccccaaatgaacgattgggagctgcctcctaagaggggcaggaggagaggaaatgaaatactatttatctatatgctccactatacatgacactaggcaggtcattttaaaaaatatattcttcatttgatttttccatattatgaaggtaattctttcttgcttaagcaagtgaattaatatcatgcaaagatatataaagacaagtagaaatgtattcacccccttctacaccctggtaattaatgttaatagcctagtaatatatcctgctgtaacttcatttgtccatacaaatacctactggtgtgtatacaggatggaggtattttgcctgagtatttttcactgaaagggaatcttatagtacatgttactctgtagcatacttttctttcccttgaccatatgtcaaggtcatccttacactggatgtaactcatttttattttttctgatgtctttatgcctagacttacacagctttacatatttgggatcacattgttcctggtgaggtggtcattttgtcatcagtcagctattaagtgtggtttctttctggatgatcactagattgggtctctgagctgccagatcaagcatcatccatcacccaggcaagctttgctttggctcttaggctgcgtgacggatgtacacagcctgctgaccaccctggggtgtgactacctggtgtgtgtggcctccttgtgtctcctgggcctggggtagctatcaggcatcaggcccctatgactgcccttcctgctcatcagagttaggcttacctccttggagctccttaattactgaatatgcgggaaacatagcaggatgatcaatgagattggagaacagttttgatggagcaaatcgggcagcatagtataatggccaagcatgtgggccctgcactcaacttgcctggctgggtccacatccctgtgtagtggacactgggctgtgctctctgacccctttgaggactgagtccccagctgcagggagtgctggacatggttagcctttttggagcagccccggctaaagagacttgctgtgtcaggcactcctgtccatgctcctctcctgggtcaccctgaaaccaatgatggtggggagctgtgactacctggcccctctgccgcaatgtgggacaattctaacgggcgtgccagcttcagggctccctgtgggtttggcggaggccttagctgaggctacatcagagcttcatttctccctctgcccagtgctgcctccaacctgccctcctgcctggaggacttgactcgaggaacccttcctaacaagcctgctgcccactgtactccatcccagagtctgcatcccaagaagaaaccctacctactttgccatttaataacttgcccaacaagttatgaaccttgtctgggcttcagttttcttatctgtcaaatggagataataacatttccttcctcatggggttgttgagacaattaaatgggaagatgcatgttaagtccctggcacagtacctggaaaaatgctacaagttttagcaattttatataaaatcgttttagaggagttcattattttctaggtaattgttggtagctatgtcaggatatgaaaaagtacatttttccccctgtgctttgtgtggtttttaggcaaccctcaactgatttctctacaaatagagctgtggcaaaactgggcagactgagtgaatgtcttgacttttattggcaaatttgcttttgttccccaaccccatgctaatctgaggggtgtggatgtatctgggtggaagcataatgagatggccttgttgccgacctgcctggagacaaggggctggacaagttgacttttgggaattcctctctacctcacctgtgcttctgcagtatgaagggggtggtcccaagggaccctgctggcccactgggagccgccatcctgcctgcgtgcttattcatgtcatgactgcatggctgtctgccaaatctgattcctcctgatgggtgtttgttgcttgctcctttgtcccaagcacaggcggtctttggtgctgtgctttgaacattccgcctttcaggttatgtacacccattgtccatccagaatgccaaagcaaagcttgcctgtgtgatgaatgcttgatccgccagactccgggatccagactcacagctcatgtctgaccacattcccggggggtcagtgttaacactcccttccttgtttcctcccagacaccaaagccccctgcctccaagttcccttgaccagggcagggaggggagaaagtgattccaggtcagtgggaagatacgtcaatattttcacagtgccagaggcagctctgaagttattttgaaacaaattcagagtttctgtggactttgggctgcagaaggatcaagctattataacactctatttcttttgtaatctctgtcagtgtattaatcagactgttccccaccaggaagcattgcactagcagctgcccagagatagttaggaactgctcggcccttccaagacacaaagtcaataagttaccatcctcgctgccctgaacagaggtaatgttatcgatgtctgtggctgcctaaatggaagctgaggctgacagctgataaacagaccaggtttctcaactgttagaggcagcataaagctgtttttcagagcacaggccctggattcagatggcctggattctgattctggctccacttcttgctagctgtgtgaccttgcacaagttactttatctctctgtgccttagtttcctcatctgcaaagcagattgttttggaggtaaagttaatacattacttggttaaaaaaaaagaaaaaagaaagtccttgaaatcatgtctggcacatagtaagcactaagaaatgttagtgaggatgaagatgatgatggtggtggtggtggtgaagatagtagagaacagagagtgcatctcattagctgtttccccagcatcctgcatagtgtctggcacagagttaggtctcaagaaacatttattaaataatacatcccagtgccttttgctgtctactgcctacctagtccactcaactctctaccaaagaaagaaatatactttccattaaaaatttttattttgtcttaactttttattgaagcccaacataaatgagaaaaaatacacaatttttgaggatgtagctcaatatatttccataaactgaacatccaccaccccagccctgcccaagaagccccctcgtgcccctctctggttactacccttccatgatcctgacttctagcaccatagattagttttgccttttcctgctcttcatataaatggaatcatacagtgggtgcttatttgtgtctggcttcatttgctcagcattttgttgttgtgtagatcattcattctcattgttgcgtagtagtccattatgtgaatacaacatactttactttttccatttttctgttgatgggcatttgagtggtgtcaagtctggggctgttgtgagtagccttgctgtgaacatttgtgcacttttaggtgaacacatgaatgcgtttttcttggtatattcctgggagtagaattgctagagccttcagcatgcatatgttcagctttaggaggtatggccaaagttttataaatgagttgtgccatgttttgcatattcttgacagatgaagaagctgttccaactcaatagtgcagaggcttgacagtgatatacagggattcctgagacgttcacagctcccaggctctttctagctgagagttcacatgttctagaaagtctgctggggtaggtagtcctctaagaagcaggcagtgtgccaggcattttcgcttacactgtttcaccaaatcctcacagcaatcccatgagatggggagtgggagtatcactcccttttcacagatgaggagactgaggctcagatgaggaaacttgagagacttgcctaagatgttagaagcagaaactgtcagggtcagaatataaaacagggatgcccgaatctgaagctcatgcatattggatcccatggtgactcgctttagcctcagtgctaacactggaaggaaacacagacacagacttgggtgctgtccccctagaacctgtgcaggctgtggggtgggggctgtgaggagaagtcctgtaaagaggaacagacataagcaactcagtgaccttgggaagccaaattgttttcctgcccaggggctgctggagagtcatgaatttcctggaaggcaaaggcgaccatataatttactttctaaaccaggactctcaagagtgaaaggggcattaactggatgggacactggagggaatagtcacagactgagactgtcctgggcagcctgggacaatgctcaccctctggaagtctgtgtgggcattgctgtcctggtcagtggggctgtgtgggttatttttaactctttcagagcactgtctgtctggagtttggcctgatgtggcatcctccccagcctcctctgtttatgggaagagtctggcagagcctggcttttttcttcccctttccacaccatttcctgttcaaatggcgctctgacgaggtgagcttcttttctcagattcagttgctgttgagactcttctgttaacagatttgatactcctagaaggttaggactgtgcctaagtcactgcagtgtttacagtgtctggtggcagacacagagttagcgctcaggggatacttgttgactgtatgtatcaattatccctgtgtgtattcatttactcagtcactagctcactcattcattcatagtccataaacaagaacttggtttagattctttcctttttttctgagctgacgcctattgcactggtccagaaagagagatcagttctgtgtgtgtgtgtgtgtgtgtgtgtgtgtgtatgcatgcatgcgcacatacacatacaaaggacaaagaataaaagggatcaacttaattagtaacaaaagatgtggtatcatgggacttggtgtcaggacttaggtttgaattccagccttcctctaattagctgcaccgccatagatgagcttctgagcatttctagtcatgtgtgaaatggaaatgacagtaatactggtggtaccagattgaagtgagccggaaggtgtaaagtatatgaaaagtgcttggcacactgcaaagtgctgtgtaagtcttatttgttaatgcttgtggtcactcaacaaacatctgggaagctgcctggtatgagacactgtgtgctgagtcaggtgttgtggagtgaattctggtgagcaaaattcccgcccacctccagagctccagtctgttaaagtgaggttgactgcatatgagccaaacccctgtgactgggaatttttattaataagaaaggaatcagcaaattcctccaaggccctaaggatttgatgtgggtttccaagataaggatgcaaaggataattaatttcttattaagcccacagctgcattttcaccagaacaacagcaagaagcatctaagggcttgtgtgcttccaggagaagttttggtatagcacagtgatttctagtgcagattccgggagtcaaactagtgggacctaaattcaaatttcaccacttgctaggagtgtagtcttggaaactgagcctcagtttcctcatctgtaaaatggtgatggtaatgatacctactcccaaatgaggataaaattaatatatgtaaaatacttagaacagtgcctggaacatagtatgtactccataaatatttattattatttgccacatagttttctttccattggaatgctaggtattatactacatggtgttactgcaacacatggatgaggaaatattctgagttgggggaagtcagggaaggtttcatgggaaagaagtatcctaaggttatttttttttttttttgagacagagtctcgctctgttgcccaggctggagtgcagtgacacgatctcgggtcactgcaacctctgcctcctgggttcaagtgatttccctgcctcagcctctggagtagctgggactacaggcacccaccaccacacccggctaattttttgtattttagtagagacggggtttcaccatgttggcaggatggtctccatctcctgacctcatgatccacccgccttggcctcccaaagtgctgggattataggagtgagccaccgtgcccggcccctaaggtatttttaaggtatcttttataacctgaacaagactggcttatttctaccattacgctgttcttaaagctcagagaaaattcagtgtggaagaatttccttcccttaagaaacataaatcaaatgcctcctgaaattttgaagttgaataacatgtggtccttactctcaagcatttccaaactagttgatctattttgccaccatccttgagccagagacaggggacatatagatgagtcctcaaggtactcagcaatgtcatgggggaaggatctagaagtgaagattattgctataagagggagatgctcaaagtggatggaaattaaacaagtccgtcttgctcagaatgtaaaagatatttgaaaaatatcttaggatgcctctttctcatttaagagtatttgggagtagaaggacattgtggagtctccttccaggtatgttattagaggagccatttcatctgttgatatggtcaatacgtggtgcttcttgcagtaggaagatggacaaatggttcctttgattcctccagcctatctgctatacccatatagctatgtgccttgaaggtgaagggtatgatgaaatcattcagagctgctcctagacaatgacaacaaggtctaaaaagtgcattccccacattgcccaggaatggctggaatttctgcttcatgtgatttatctctaatattatggcttatttaaaaaaaaatccctgtctcatagccaggatgcaaaagggagtcttccctctgcctccatcctcaacccttctttcctctgcaagttttccagtgaggaattaaaataaaaaatcctttagtgtcttaaagcatgtaaatgtaatgctaacattaaaatgatgccatagaatcataaacatatgaaaagatgcttaacctgacttggaatcagggaaatacataaattaaaatcacaaggagactctgttttatactcatcagattggcaaaaaaaaaaaaaaagaaaagaaaaaatcatgctcatcatactggatgtggagccaaaaataactcctcttcactaagggtggaattaaactgataggaacacttcaaagggcaatttgacactatctggtaaaactgaagatgcatttactgtaagacccagcaatttcactcctaggtaagtccagacaaagtctaatacatatggaaagaagatatgttcaggaatattcactacagcatggttttttagagctaaaaagcaacccatatatccattatcaaccagaagactggttaaataatttgatacatacatacttacggtggaatactatagaacacagcaaaaaaaaaaaaaagggtgctagacattgttaaagacagatactagtgacatataatctcagaaacgatatgaagtggaaacaatattaagcaagttgcagaaggatgccattgctagtaagttaaaatcatgtaaaacaatactctcttttatttacaaacatttatatgtataattaaagcataaaattatgtttgtgaacaaccataaaattcagagaagcggctccttctaggaaaggcagtaaggcagaccaggggagaagcacataggggcttcatttatatctgtaatattttatttcttagactgaagggtgggtatacaaatgtttattttatttttgagacagagtctcactctgtcacccagacaggagtgcaatggcgtgacctcttttcactgcaacctccgcctcctgggttcaagtgattctcccacctcagcctcctgagtagctgggattacaggcgagcacaactatgcttgggtgatttttgtatttttgctagagatggggttttgccatgttggccaggctggtctcgaacttctgacctcaagtgacccgcccacctcggcctcccaaagtgctgggattataggcttgagccactgcaccaggcctagtttattattatttatattttttagatatctaaaatattttttggtttaagcaaagctaattttaaaaactaggcacagactcctagttcatctcccttgaccattggtgagtagttatgctgaagagtgaacaggaagctgtctcctattggctgtaggtccatctggaaaatttcaggtagatgtgacatctccaaataggctcttctccaaacatctatatctcatgtgcacatggtaatcactgtttttgaccttttttttttttttttctaatttgcggatttgttgggatcatattttgatatactggtggagatgccaaatagggtcgtagtagtataggttggtccaaaaattatggcaaaaaccatgattacttttgcaccaacctaatagaaaccaaacagcaactctgtggctcattcccacacagcaaattctggagccttctttctcccatcccttccttgagagctactgggatttcttgcaagtgctagaaagtgaccacaggctgtccttttgataaggacatgggaccagataatgtcaagtgcttctcattgctacagggtgaaagaattttcctctctccaccatcactgccttgtcgccatgaagtcctccttcccttctgattttcattcatatacagccattgctctgttccttttgcgaacaccccagcctgaggtgggaaagtacccaccactgggaattgcttcactttcttttacttgacaatgaagccatgctgacttcttctctggtgtcttattgaagtgcagtcgattcagctctttcatgtcccttactttttatgatagcttccttcccttgaaatctggtctgagcccaatccaagtgacatacactgtgttggccctgagggcccttgtccttgttatatggcctttgtccttgacccagtccgtgaaccttaactctcagttcagcagcagtgaaccccttatcgggttggcgtggtgcttgcactggggactaaagttgggggtggctttcctctctgcatcctgcttatttatacatcgtgtaattcaccttaattaaaagacaaaaatcatgaaattgggacttgtttgagcaaatcatgggagcgtggtttctctaagaatgtgtattgttgtctctgtcagtcaggctccaggcaggaagcagttggcactcccaaaagggtttgatggataagagtttaatgagaaggctatttacagaggagggagtagagagatggtgacgcactcaggaaggagcagcaccaggaagccgttagtgcttctccacctgaagatgtgagagcaaggagtggtgtcgtcagagctctgcctgctggagctgtgcaggagggaccacttggcaggagctgtggatccagagggacacagcctctgccagactcatggcttagcagaaacgtaatgggggagtgggcactctgaaatttcagggacttggcacctccctgagtttcttaatttacctagttcattgctcttccgtgaccaacctcacaggcctcagttctttggctctcattcatgtctcattaaagtcacgtaccagggctgcttatagacctggctatctgctcggtttcttctagctggggaatggtgaaatgttcaggaggaaagaaatctgaagaggtcatctattgtagcatttcccaaactgcctttgatggaacactaagttctcacaatggttgtcctagggaaaaagaaagttctgtggttaaagaaatttaagtagcccttttccatctcccctacttttccccctagagagccacaatgctcagagaagcactgcagtaaaaaaacaaaaacaaaaaacaccctagttttacgatgtctaaactagcgcttctcaatttatctaaagggactttttccatggtataccccacagaacgagtgttttgaggtttgtatcagaatttatattcagctatagccacatggaacagaaacctggctagagttgttctgtcaactggggttctttatttttcttacacaaccagttcagcagacacactccagagttggtagggtggttccacagtgccatcagggacccaggctccctctctctctctcttcttcagccttctttagaatggaacctttgtctttgtgctcattgcttcatggttacaatgtggctgcatcacctccatcttcaatctgcattccaggcaggaagaaagaaaatgacaatgcataaaaagtgcatgccagctacttccagtctctttaataagcttctcggaaagtcctggccatacacatcaaaattctgttgaatagaggtcccaaactgcagtggagtccggggggaagctgaacattttttaattgggcatgttgctgctgcaaacaaaagcagggacccattcataggaagaaagaagaagagatcagacattaggtgaacaatgagcatcatgtgtcacatcgatcaaaccttgtttctctcttcagcaggctgattctaaaatcttcacaggtaaaataaaaacaaacaaaaacctatgtaatcaatagaaaaagcaaattctaagcaacaagccacttggtatggcagagtctgcagaaaatactattggtgctcttcccagacccctggttgctgtgggtgctccagctaatggttcacacctgtgtgggctgcccttgggttgtccatcccctctacccagaggtacctggaagttacacccacttgccccaccccagcccacctctcccctgcatcctgtgaccaatgactcactaggaaaggggaagagccccatttttttgccccttatggggacaaatgtgtctcggtccaagtcacccttcagagttcctcacagcatgaggctgaagttagacctcacccgaaaccacattctttcccagatccctcccctgccttttcctatttccttcattccctttctggttcttcctgagagctcagtttcaccaaatcacacatacacccatcctgtccgaggctctgcttctagcgaacccaatctaaaatgtcctgggtaaagcaggctattctttattacaccctaagggaagggatctaaaacccttcccctcagcccagtttgtggccactggtgggctttggcttggcctgggtgttgtggaggcagatcctcattccaccctgatgatggctgtgggaatgctccttgccaagtcctcagatatgtttgaggaggcctcctgacaaggcatttagcacaaggggtccagcattgtctcttctcaaggcagatattcttagaaactttgatttgcatttgtaagcctgtaaactgaagggagtgtgtgtgtgtgtgtgtgtgtgtgtgtgtgtgtgtgtgattttccatcttgtggcaatggcagctgggtatttatagctggatcttcagggccattctcacgtggctaaagaaaatgaaaacctcatgtggatgttgttttgttttctctctctgcctccgccattgcaagcactccagttgttaaacccttattgttgtaactagagccaccctgagcatccctgcgatggaggggttatgtacattgactatttcaggacaaagtgcctgttctccttcaggcaggccacagagtaaaggaggggacttttggggagagctcgtgggcaacaccaaatggcaaccccacccggcaccctcctctctggaacgtctgcctggatttaccccatggaatgtggattccttaaatcacctcatgatccctctgcatatataagctcctttgaaagaaaactgttttctttctcccttgttttgctgtattctgaagtcttttatgtctgggtttggccttctctgttaggctgagaacaccctgggggccatggtctgtttgcccaggttactagagctcttggcaggggatgttggcggggggatctgagaagggtggcaggaactcagcccctggctttctccaggatggcttgagaactcatggagctccttagacaccagggttggatggtttgcctaatgtttactgagaagccagtccccttcctgataattgagggaactgagactgaggatgcagggcccctgtagaccctctgtgatttcattctggtgacctggaacccacacatttactccttggacttaaacactgaggctacagagaatttgtatctggggcatagggcagggtgcatagcccaaacctgccagaactaacaaaggctaccaaagagcatgttaggaggggaatataagcctggttgctgcggaccccgggagctaggtcttcccactccctggccagacccacggcagtcagaccttctgcagctgttctcctatgaagggttttatacactcctactcttcaaattcaaattctctaaataatacctaccatgtatggagggctcactaggtgccagacactgggctaagcccttgcacatttcaacacatctcattctaacagctctgcaaagtgggtattatcccattttatagaagaggaaactgaggttctgagaatttagtcaactttcctgaagttgcacatctagtttgtggcacagaggggattccaagtaaggtgtgcctgaccctaagacccgtgctttctgtaccgtaccccaatcatttcacttcatgatgaacttgacaatcgactgtacctgaattctgctttgttataactctctagcctccacaaacactcagtatcccccgcctccccaccctgcccctgtcagccttctattcttagtgtggatggtgacctctgactgtggagtcagcaggtagcttttggagtgcctgtaactcaaacaatttaatctgacatctcaatcctgccaccctcccctctgttgcaaacacaccctcaactcccttttcctgcctgcctctgtcctcctccagctcctgtgagttctagagggtttccaaacctaggatagagccagcaattcattagtctttgtcctgtttccaagaatcccaaatatataagaattcctcattgaaaagccaagcattcttgggggaaagtgtgtgtcaccaagaaagcacgattcctcacattgggaaaggggatcgtagtccagtccaggaaaataagtgtagatttcagtgccagatggaagtggattggctctccctgacacctcccctccccagccacccacccctcacaaaccacaaccggggagcttgccttcccagttcatctgagggcactaaccggatgacattttcctctggagagagaaggaaagaagaggcagattgtgtgtgtgtgtgtgtgtgcgtgtgtgtgtgtatgtatgtgtacacagttctcctcacctacaggccactttctgtgcagttccttttggcatggaccacttactgtttgaagagccctctagtgagtttttggggtgggggtgaatcataggcgatgagtctggctgctcttccactaggaggaagcatctccctcctctttggggcagctcagcttaccagaagatctaaggtaaatgaataggaaatctgctcgaaagcatttagaaagcaacctcttatggctgcgttatgcaaattcataggctagaaacaggacaggcaccaagaggaagcacgtgagctgagtgagcagagtgtgtgtggagtgagttataatcaagaaaagctttaggaggatatgaagttgctttttttaaaaaaaattctctcctttattataaaagaaacatggatttattatacaaaatacatagtagcagaagacaaaaataaaattagttcatgagcccatcacggggcactgaaaagagactttgatctttctgttcctctgccccctttcccacagcttcccacctggccacaaacaacacttggagaatctgccttcccaggtcacttaacatttggcagttaatgtttccagtcttttctctccacatacattgtaaaagcatggttgaatacatattatatgtgcagatgttagacagttttgtattgtggttttatcttctggttagtattaccaactttgtaaatgaggagataagtcaagtgaggtgtggaaaagggtcatggccactgtttggtagagaggaaactgagaactgggggaaaggggccctaaaagaccagctgataccctgtgggatggaggatcttttaaatcaagcttgttcagcccgtggcccatgggctgcatgcggcccaggatggctttgaatgagggccaacacaaattcataaaatttcttaaaatgttatgagatttttgcaaggttttattttttttaagttttctttttctttctttctttttttttttttctcgctcatcagctatcgttagtgctagtgtattttatgtgtggcccaagacaattcttcttcttccagtgtggcccagggaagccaaaagattagacaccctgttttaaatgacagaagatgaagagcatctaaacctcaacctcccagctcctatgtgagttgggagcagtaacaaagccagcctcccctttgaccttggcttggtttccctggccacagatggagctctgatgcctttgttggggttggcgttggcgttgggtgagcactgtggtgagcacttcacatacaactgattttctgttttacagatttggaaactaaagtttagaacagctaaggacctggagtaagatccatgtggcacagcagcagagctgcaattcaaacgcgttcatctttctcctaaccactgtcctaggcagcttctagttccatggaagagaatgtctcctgattcctcactttctgctaagcctttctggattgactcaccaaagaacaaggggtgccctcccaccatttctgtggaactcaaatgcctgagccctgctgtatggagtgtgtatcaaggagatttgaggaaataagtaacctcagcatctgttctcaccacgtggctcttcctccaggaagttttccaggttgaattccactggatactcatccctctcctcctccattctcttcagtattagcctgattcaattcagagccactcagtcattgatattgtgaccagatgtcacccgaggagccctgtctttgagattcagaataaattagctgaatctcactgccacaaacagagggcagtggttctcaaattgtgggaccttagaccagcagtatcagaatcacctgtgaacttcttagaaatgcacatccctgggctctgcccaaggcttctggatcaagctctaggggtgcagcccagcgatttgtgtcttatcaagctcacgtggtgatcctggtgcacactgaagcctgggaactgctggtctggagattccaaaataagtggtggtggcttatatttttcacatcacctctggctctgagttcctatttccactgaattcgttaagattattaactacccctaggtgacaagcatggtggcccagaaattaacatgaactctggagccagactgctgagatttcaattctgtctctaaggctcactcattgtatgggtgtccctgagcaagtggcataaattccctctgctgcagacctcttatccctaatatgaaataaccatggtattccccatagggcagctgtgagccttcaatgaaactgtgtctgttaaacacagtttaacagtgccttacacatagtaagctcacaggaaacattaactcttattggtgtcatgcaaaccacgaactcttctgcactgtgttgacccagatgtggaattactcccatacccctggtttacacacacacacacacacacacacacacacacaccgtttacacaaggcttcatgaatgcggtgaactttatggaggtctggggagaccaagggtatttgtattacaacaattcagaattgagcactggataagcttattctaaaatagattggccaaaggttacaccatttggtcttcctcctctctcccttggtgctcacaagcaactcactcaaacaggtccccctctttattatgttgagtaattcagctgtctttactctccagccccactcctcaactttgctcctcagttcactttgcaaatccaaagacaacttctaaagaatggaccttctaccctgattctcatgctggattcctccctcatagggagaagagtagcaatgaagatttatttttcctactgacatgaactgtgctacctctcaggatgctttagtgatagttttggtttttctctataggtatatgaatcacacgttgtattttttctagtaaatacttgagaaagaatttgatccaggagtctggggcagagcccaaggctgcgcatttctaacatgttcacaggtaatgctgatactgcttatctgaggtcccacagtttgactgcaatgtatttatttttgcaatggggcatattgctctataaatgttctcctgctcttgttctaaaccttcacaccctcataactagggatttgatcacagccacaggttctcaatcttgatactaggccacataattcttggttgtgggggggctatcttttgtatataggaggcttattaacaccccgagcctctactcagtagatctcagtaacatttactagttacgagaaccacaaaacttctccagacattgccaaatgtctctgggggcagggggtgtgatgggtagccacccccagttttgagagctgctggtctcagctaaatagttcctgtaatagttcaagtccattatatcttattctaccccacactttacctctgtatttaagttcaggggcctggatttattcattgagaagaaaggtatggaggagtcccagcagcctctggatcacccttgatttccaaggagaatcatcaacactttgtgactgctttttctcaaaggctccacacttaacccatctgcagtggagccaaggacatccaggtctgtttccagtaccgtctctagtcctgttaacgctccccgtgtggcgggaaacctcacaggaactagggaatggcctttggtttttggcttataaatactcatcatcacatttcttttgctgagaagtttttcaaaatcgtgtttaacattcttgttgccgtagtggaaacttttgttctttggagggcttcccatcctaggcccaggtcagattcctcagcagagctctgaacattttctagggaagtttcagcagtgagatcgcacctttgatgcacttacacaactgtggctggattctgggttaagactcccaggatcccaacatacacaacagggaaactatgcagctggaggaagggccatgtgcctgggagtctttctgggaggccaggatcaaaatccttttatgattctattacttttctgggtttctctccttgccccctaatgtcttaaatctaagataaacaatgagcacttcagtcagtaaaagattatgcgtaataacacacaatctccaaatttcagtgactgaaaacaacaaaggtgtatttcttactcatgttatctgtcggtagtggatcaacagagggtctctgcttgttttagtccctcaggaactgaggctggcagaacaggccctgtcttcaatgttggcagttgctgttctaaaggaaaagggagtctggtcctcacaattaaaagctctagaccactaatgatgcttctgttcatcagtgttctatagtgaaacagaaccaataggatctctctctacatatatctggatttgttttaaggaatgggctcccatggttgtgggactgacaagtcaaaaatctgcagggtaggccagcaggctggagacccaggaaagagctgatgttgcagctcaagactgaaggcagtctaggggtagagttcccttcattgggggacctcggtcattttctctgaaggcctccaactgatcaaatgaggcctacccacattatggagggtaatctgctttactcagagtctactgatttaagtgttcatctcatgttaaaaaaagaaaaaattctggctgggcatggtggctcacgcctgtaatcccagcactttgggaggccgaggtgggtggatcacctgaggtcaggagtttgagacgagtctggccagcatggtgaattcccagctctactaaaaatacaaaaattagtcgggcatggtagcacacgcctgtagtcctagctatttgggaggctgaggcaggagaatcgcttgaagctgggaggtggaggctgcagcgagccgaggtggcgtcactgcactccagcctgggtgacagagtgaaactgcatctcaattaaaaaaaaaaaaaaaaaaaaaaaacttcacagtaacctttatactggtatttgaccaaatacctggtcccatggccaacttgacacataaaattaacccttcatattttcagcgaatgggccaaagttagccacatgactccacccaacacaaggacccaggaagtaccatcctctgtgtgtaatcgggggtggggaccaacaatatttgactaagcaccaacaactagaacaactataaattattttatctgaggatgaaagaaagtattaatctgtggtattttgacgttaatgcattctactaacacaatgcagaaatagtgttagacttagctctacctgctcaattcattcgtagcagaggtcatggaagaacatgggttgtagcatggcctggcctccagggtgactaaatttgaacactgttactgaacatcgtcctgttattcttctgtattgttttctttataacatgttttctgtgtgtgatgttgcatttaaagcccatttgtgtgctgtgtaattgaagtatgccttgcaattaatttggcctttgtgacctccttttagtataaattctttaggttcctttttcttgcttggatcggaatcatctgaaagggctcaggagccagctgtcgctctgtgttttttgctactgagtcactgtttctgacaagcctctcctgagtgtgggccctcatttccttgtctagagtggggttgagcaatgtgatttctaaggttccttctggctctgacattctgtgtgcctttgttccacaccctttttcagtgatgccagtgccagggggtacagcctcagggatgtataacagggttttcctccacaaaactggcagaattgttctgggttcttatttgaaaatgtggcatgtggcctctcatcagtgctttggccattttgcatgcactaactcacagagaatgcaggctacaccccagctggtgagcatcaccatcatctctatgcccactggctttctgtttggctggagggaagctgaggacaagaggatgttaggttggagcacagggaggcctgtggaaggcagggacggtgtagagtctggcccagctgaaaatgggcttggggagcctggccagtccttcaggtccatctgggcaaacctagtcttcaaagggcagagtcacaaggacctcaaatgctacttacctcctccagtactaacatttgacacatctaatgcctattcattgttgtgaagttcaaatgaggtaactcatgaggaagtgcccacaaaactaaacacttatgacacactctcaaacacactctcaaacaataagaattactatcatgagctgcctgactccacaagattttagtgctaggtgctagggacagaaaagtgaaaaaaagatgctcagttaattagcatacaatgtgatgctacctctaacaatagactttggatgatgtcttagttcaagctgctctaacaaaataccatagattgggtgacttacacagcaaacgcttatttctcacagttctggaggccggaaagtcaagatccaggcactggcagatttgacgtctggtggttcagccttctcactgtgtcctcacatggcagatgggatgagacagctctctggggtctcttttataagggcatgaatcccgttcaggggagctccaccctcatgacctaatcatatcccgaaggccccgcctacacatagcatcagatagggaattctgcctcaacctatgaattttgagaggacacacacattcagtccatagcaacgggcaaagcttgtgagagcacagaggaaggagtttttaatgttcaacactctgctcgtgggggtggaagcctccatagcagcactgacagtttaacctggtctggaaagatggcaaagactgcacaggtggagggaatgggcatcctagcctgagtgagtggcagcgtgctggagaggcttatggaaacctctggtaatctggcctggtggctgggtggggtgggtgggaccatgtgggggaagctgcggagggagctggtgatcaaattaggaaaggtcttggataatctatgaggagcctggacttcgctgaatttttcagttaccaggttttaaaaaactttttatttcagtttttggctgaaagaagaagctattattttaattttatttaaaacctgcctgtggatctataataggcaaaacttaactcaaatagatttaatcatagccttgctgcactgtcctgttaattttgctactctccttcctcttagagcttccacgtagaatacatttatcttctcgctctagtctcgtcttgattgaaatattggagtgagagatagaaggtgggatctttatttttttttctctgtatacagaataatgcctattttagaatgtggaaaatactaaaaactataaagatgaaaaaagaaatttaccctctggacaaggttggtagaagatgagtggttgagctccagtagaatcagttttgttcaaatcctaattttttcacatattacctgtaagaccttggcaatttactatctccaggcctcagtttcctcatctgtaaaatgggaataataatcacaatacctacctcctaaagttcctattgggactaaatcattttcttcatgcaaagcacttaggaaagtgctgtgtacatagcaaataattaatatttcttatgggttattgcaacaccctctgggtgagttcagccctagaggaaagtaggtgagttcccttggggaagggtctttctgcctccatgttctacatcaggaaagtggagaagcttgtcataccacaggatgaggctagtgccgagtcacagactggtgtgtgttcagagtttttccctggaggatgctagcttatcctcccttgctccttcctttctagcatttccacccacctcgggctcttggggcaggctgtccctttaagaaagagagccacacattctgctcctgacagtggccctgcctcccttgctagataccttgctgggctgtggttgggacactcctgggctggattttagtactgaagcctccagaggagggggcactgcttcaaatcaagcacaccccaccccaggaatccatgcccacagaaggactccctgtctgcagccccctgctgtggccctgggctcccagcacccagctctgggacatcagaagataattcttgaggactgagctcaggattcctaaaaagaaagttggaaaatagctggataaacttggtaagtgaaagaaagccgcgttacatcctcttccttggattgtggattgcagattttgggttgagttctggtgactcttgccagtggtatctgatgggcaaatgtgagaaggaggagacagaggtggggactgggatccccagtgggtagcgagtcttgaacttggggatagccccccaccttatcctggtggttgtcaaccttgaggcagggagctgggggttgacatctgaacatagctggagcctggcccaaggagtgaagatccgggaggggcagatgtcagatttctccctcatttgggaaaaacaaagtgtggtcagtgagtgctgtttgtgaagatgccagagaccagtgacatttgcagcctgagggtgaaatgagtgaccctgtgagtgtatctcaggaggagacttggaccaattcctcttcttcctatagggtcaggggacagaccaggcctgggccccaagaaatctgcgttgtctccttggattgaggcagctgcccatgagcagcagcggacagtgtcgtagtgggaggaggcaggtctgccaagggcagggaagaatggagggcctgttactgctgaagcctgggaacgctgcctggggggaggcccacgctccccagagctggagtgagaaggaatgggaggagaagtctatgcagcagggggatgggctcagccagcatccccaccctctgcagagcaaatgcccccgtcccatttcctgtggcatggacacaggtgagcttcctggccttgaatgctcaggtacagtttggagggctggggtctgttacaaagaggtggcctcccatggaggaagcaggaaatgctagaagcctcagcccctggcactcacccgagggtttccaaatcagagacactttctgctaaattatgcttcaacagatgttttctgtgttcctacttgtgccaggctttgtgctggggatttaccaaaatataatatggcatggtggaattgggaaggtgtgcagagctggaaagatattttggatgtgagattaaagccatttttgaaaagtaacaataatagttaccatttattctgtaccttgaatgcaccaatcactctgctaaaggctttgcatctcctttaattcttgcagtagtttattgacttgtgactaattttgtagatttcaaagattaagaaactaaggctcagagattaaggacctttccttaaagatgcagggctggtaaatggcaaagccaggatgaacctcttaagtcgtctaaccatttattcatttgtgtgttcaacaaagttgaattgctggcctactgtgtgacagccattgtagagggcactcaggacacagctgggacagggaagggtccagggcagcctaactccatagcctgggtcctcacccccagccagagcccttcacactgggccccagagacccctgggaacattgtgtgattgttttctccaaggtctgagactctgcttgagaatgtgcttttccttgagaaatgtttctttgttttcattttaataataatactgtaaaaattggaggcatttattctgaatcatctgaatgaccaccatataacctactattggcatgcgattttagtccccaggtttgtgtttctgtgcaagttggcaccgagtggtttcctaaaatgatagtttttaactttcaatgctttgtttctcaaactgggctctacactgtgtgcttcaaaggcccaaagattaagaaaggctacatcgacagattctactgcaggaagggagatgtgcagtatgggtgtcccaagaggaaatggttcaacatcctcctctcctggggggtgaagaaaactgaggagttcaggttggggcaaagcagcttgggggttctgaatcttccaacctgctggtctccaagctcaggatggacctaggccagagactcagagaggaacaggcaagtcaggaaaaacgaagactcttgagttcagattggtgtgctctgctctgacatagcatctctgacctcaagcaaacttgctcctttctgggcctttgcagatgggacgacttgtgccgggaagggggaagtgtggggcctccctggaacactgtgtgacttcctcccaaagagggatgttttgtggtcattcagaacttctgacctttcctgaggcccagctgttaggtgagaaggccatcgcatgatccctggtgtacagaactgtgcatgtgacttgtgcctcaccaccctgggggcatccagggctgtatcatgctagcctggtgctttggcccttagatggggctgggcaatcagcatcctttctggatcggatgtcctgccagtcttggaggctggaggcaggagactgaggacccctgcctctccatcctcttccacctcctttccctcctccccctgctggggttttgggtcttgctgtcatctctgcttttgaatgatgctccattgtatctccactctctggttactgtccctcagctgggccctgggtggtcattctggtcgtcttttctccagactccactctaccctcttctgtcttgtacattaggagtcagtgaacattatctgcaaaggtcttgatagtaaatatttcagctctgggggccttctgtgctacacattagtaatttgttcctaattttatctcctcaagcgcaggagtcaatagaacttggctatctctgcagcctcccccgcccccagttctgtgcctgctgggcagtaggcactcaggaagtattgctggcataaatcccaatgacctctccccatccccctagagcccgtgccccagcagggggcatcttggggtctagctgtaccattttgggaaatcaggatctggtcacctgttggttgctgtggcatcctgtagctaaatccatctctggccctgtaacctgaacctgccccaggccctgtgctccaggatcaagtgtccctgtttgttttgacatcccctgtggggcgttagagatccagatttcaaagcaagatttttttctagcagcggttgaaggccaggcccctgccagctcctgggctcccatgttagcattttcagttaattaagaaaacaaaccccacatccttgacagaggtggttctgccaattcaggacagagaactttgcatcagcatagcatgcaggagaagctggccagctcctgcaggcaggacaagctgagggaggcagatgtttgagctggagaggacccactggtgccttctcggcaagagcaggttccgcggaagtcgcatggttgggaagccagctccaggcaaggtccagagcatggaatttctgttcctctttccccatccagggtgcatttatcatgggtgagggccatggggaaaggccagctggatgagaatagcagggggagacacaaatactttcttgggacttgccagtcttcctctccagagccaggttatcccaactgtctaactcctggaggagaatgatgagaggtgacctggggtggcttcagaggggcccaggtagctgacctgccagctgccaagaaggagcctgatcagagaggctgcttagccatgcagggcctggatgtgaatttaagaagggtctttgtcaggctgggtgcggtggctcacgcctgtaatctcagcactttgggaggccaaggcaggaagatcacctgaggtcaggagtctgaaaccagcctggcggacatggggaaacgctctctctactaaaaatacaaaaattagccaggcatggtggtgtgcgcctgtagtttcagctactcaggaggctgaggcaggataatgcttgaacccgggaggtggaggttgcagcgaactgagattgcgccactgcactccagctgggtgacagagcaagactgtttaaaacaaaacaaaacaaaacaaaacaaaacaaaacaaaacaaaacacaaggtcggggggttggtggggggcctttgtttcttgaaggaaacatagttaagcatactcctgtaaagtagcccagctctgccagtgtgtgtgtgttggggggcactttcctgagcctggctgtgcattcactcacagaatcaccctgtcacctgatcacacaccctctccatcgtaccagggataagatatgtccttcccctgctcccaccgtggctgtgattgggcaggtgggaatggggggagtcaagggagcataggtgggactggctttctgcaccccgatatctgtactgagtgtactgagtgtactctttcccaggtgtacaagccctgcaggcagggtgggctcatgtatctccttggatgtgggattctcttgcagttcacagcctgcacactacatgcagtggtccttgtacctcttgggtagaatggaattggagggagacccagtcctgctctatcattgctaaatggcccagcacacattatttgggctttgtgaatctcttaatttctaatgggaaatgggaatgaggttcacattttatgtgtccccatggtgcaggtgtgttggcaaatatgagataaggcgtatttcatgcctagtgcagtgaacctggcctccttccccattggacatgtgtcttggtccagcttctgcctgctggcttgggatgtggctgccttaaaagatagtggggagaaatgataaacacacggctggcatcttctcagcttaggagaagagccctggggaagaagcgattgtgcggcctgctcctggtctctggtataactagttcaaataactgccagttagtagcagattttttttttattttactttcgagggtcttctccttacctgctggaactctctgggctccctgccatgagtactttgtcattcacagcacaatcccaaagtgaggggctggggctattctaggaaagcaagtctcttaaaaggtgagcatccctgtggtgtcctaaagctggggagaagccacttagggttttgggggactctcgactccttctctttctctctttttcatttccagtggaatcctcaggtgatcggttgtgtagctgatatgcccaatagctcccctttcctggagaacatatccaatttgcctcacgatcctcctgaaattcttgaatccctggacaccaggctagtttgtttgcttttctccttttgccagtgatttttttcacttcatattaggactgtttgcacacaaaaattaagaaaaatgtacataaaaaatcagatgtgaaatgtgaaaaagcatactaatggtaggcaaataataataattagtatgcatagtcacaggtttctgtaacttcaacttggcaaatccaaatgtcttggaatgactgtcaggagcaccttctctttttaaagagaagtttctaagtacccttcaagcttcaaagagaaaatctgaggtgaggaaatcaggagaagttgggaatcagtttcctggagtatttgagaatatttaaagagagaggcggtgtagcttggatcctagcagggctcacaatatttaggggaaatattcatgaatgaatcttggctaagatttttggaatttttaatttttgtttttatattgcatttttgtagttgttgtttccacttaagtagaaactcaggagaaaccaggaagcaaagcagaatttgtctgcgactgttctgtagtgggagagaagagttctgtgctgtgaattcgaaaattgggttctagacatggctgtggcatgagtttgctgtgggtcctgaggcaagtagcctgcttcttgggcctcagtttctcgcctgtaaagcggtctttaaatggtagtaccttcattctcaacgtcttgtgcatgccagcagctgtatgaggggcgtcctgcagatcatgtcggagaaaggaggagttgagtccatttgcacacaggtggggagtgtgacatctcaagaggggaaggcacagctatccaggagctgaagtggggcgggggtagtctttttcagagtctgattattgggtctgggtttgtggaatggtgcttcaccaccccagggaatggtggccctcactcacgccttggctctgtgtgtgtgggctcatggaggtgcccccgggcctggtaggatgcaggggcctgggcttcagaaacagtggctggaggattctccctgactcttttccttggggtcctcatgcctggattactcttcagggtctctgtctttgtgtgaagtgtgataccccttgacccccttggtctgagaatgaactctcttaatggaccaaaggggaatctggaaaatcacaaacccagtttcagaattcaaggggtatagtcccttcatgtctgagccctggagtacttcttgggtcatcttgccagctgcccaagctctgcctgccctgccgctcacacttctaactcctgccctccctgctacctgaaggctcatacctggggaacgcctcgctgtccttggagactcagcccaaaaatcaccacacctacaaagtctctctaacgcctcctcctccccaccaatttcaggtagtagggttccctctcacctgtgctcccacaggcctgtccctgatgaagcactgagcacaatgtttgaaaaccactgttctgtctgactctcgctagactattagcttccagaatgcaaagccctgactggttcagttttgcatttctagtatgtcttagtccatttgtgccaatattccacacactgggtaatttataaaccaaaacaacatttctcatggttctggactttgggaagtgcaagatcaaggtgccagcagagttgttgtctggtgagggctgccctctgctcctaaggtggtgttttgttgcttcttaatgaaaaactgtaaagagcataggtactccttgcatttttgctattcattcatgcagccaatatttaataaggacctactatgcattagcccttgccagtggaactatgctatagtttgcatgtctgtgttcctttccttcctctggaggggaagaacactgtgtccttacatgacagaaggaatggaagggctaaaagggcctaagctaattccctccacccccctccgtctttttttttttgagacggattcttgctctgtcgccaggctggagtgcaatggtgcgatctcagctcactgcagcctctgcctcccgggttcaagtgattctccttcctcagcctcccgggtagctgggactacaggtgcgtgccaccatgcccggctaatttttgtatttttggtagagacggggtttcaccatgttggcctggatggtgttgatctcctgaccttgtgatctgcccgcctctgcctcccgcctttttataatgcactaatccattcatgaaggtagagccatcatgacttaatcacttcccaaaaggccccacccttagtattattgcaacaaagattaagtttcaacatatgcattttggagggaacacagacatgcaaaccatagcacagttccactagcaggggctaacgcatagtaggtccttattaaatattggctgcatgaatgaatagcagagatgcaaggagaatttatgctctctacagtttttctttaagaaagaagcaagaatggttactgtttggataattcacccagggaccagcttcacgggatgctgtttaaacagataaatccaattggcatctcttctttgtatacttttgttgatggcaggggcctggggagcgggctgtgtgttccacacagggtgtgtggatgggcctgcacatgcgcctatgactggttgtgggtagcaagcacagaatgatcctgtttttctgtaaatactgagccacaaacattggcagtgactttctggccattatcctcagtggtgtgtgattcttgcggcttttcccagggtgtaccaaaggagtgtgactgtggtgaccatcgatggggaggctggcagcactcagggtgatggacagaaccccatggttggttccctcttaagaggcttgtgttggaggctgagtgatacctcatttggcaccagttggagagtttatagcctgtgagggttcttacacttaccaagaggaaattgggcaatagaaatttatgttaatgtctgtgggataacaaaaaagcaacatgtccctgggtcagtagtgatcttaccttcaggggtttgtttattcattggcacactcagacatttctactcagtgcctgccatatatgcctgtcctcattctagggatgcagactgaacctggtccctgccctcagagggcttagtttctggtaaaagtgcttgaagattgggaggatgggagttgaagctggcaccctccccagagccgttctgagccggccccttggtgggaaatatcatttctccatttattagctcctctgttctcccccaagttgttgctggccagaagcaccttggtaccacccttctagatttctcatgctccctccttccccacgctgagttagagacccttcatccatactctcatcattccctgtacagctccaccaagatacttctgcccactaccccggcctgctcacatttgtaccccctttccgactgggagatttttacaatcaggtctgtgttttattcactgccgcatcctacagtgcacagtgtctggcccagagtgggggttcatagatggttgtggagtggatgcccatggggcaatgctggactgcatttatttcatcttcagcattcacactgaagcctgtgtctatctattttcatctttttctgggtccgtcatggagaggcatgactctcagagaagttgctgaaaagctggggcattgcgagaaattggagaaatctgggaagccacaggctggagtcgctggggtccggtgagtcctctgtgactgtcattccacgcactccctcccagggagggaggcaggtgggcttcagggctgacagagtggggctctgagtccagactgtgcttgtgctgaggcctgcgtcttcttcatcgtgagtggggacaagtgatgctgacagacagacctacccctgtggccctccggctcaggcagtgcagctgggccagcaggagagagggccgcctgggaatagctgggaagcaagtccaggccttgggcccacctcccccaaggccaggatgtggcgtgggacccaggcctgcggaggttcccaccactctgctcctgcactcccaaatgctccaggcccaggcagcaggagggggtggcgaggggctccagctgcctgggtcaagactgcatcaggaccagggcagctctgcaggcacacacctctgacatttagcctccacctggatagctgccagtggccctgcagtccggaccagctttgcatgggggaggagagtcagggattaaccatttcaggcccttcctccatcaggcagaaactggtcctctcaggtcgaccatgtaccaaggaccggagtgggcatatttacaaatgttgcctcatttaatcttcacatcaacgtgagggtgtgggcatcatctccatttctcagatgagtaaactaaggcatgtggggagttatgtaacttgcctaagtctacacagttagtaagtttcatatattccttctttattacaagggcctattatgtaccaggtagtaattctagtcactgcggatacagcaatgaatgatagacaaaaatgccccatggaatatacattcttgtgggagggataatgaatacatgggatgtatagtctgtcaggtggtggtaagtctacgtggaaaatgaagggaagggagatgggaggtgctgggagcggggctgctatttcagatgcccttgaaagacctcactgagagggtgtgagttattcacacttagtgctgaataggtgcctggtgctaccctaatcactgtacctgactcactaaattaatccccacaattaatccccacaatctttgaggcagattactattattattctcattttcacatggggaaactgaggcacagggaggttaagtaacttgccaaagatgacacagcagataagaagcagctctaggatttgcacccaggaagtctaactcctgagttctggctcttaacctctgtgtggcctctgccagggccacaaagacagtaaatgggtgggaaggtcaagaggcttgtaagaccccacctgaacagtccaggtctgtggcctggggggtaggcacgctgagggacaggtgcactagggggcaggtgcactgtggggacaggagcactggggaggcaggtgtactgagggggcaggtgcactgggggggggcaggtgcagtgcagggaccagagcactggggggtaggtgcactggggaggcaggtgtaccgagggggcagttgtactgagggggcaggtgcactggggggcaggtgcactgaaggggcagatgcagtgcgagggccggggcactggagggtaggtgcactgggggggtaggtgcactggggggtaggtgcactggggaggcaggtatactggagggacaggtgcactgggggcgcaggtacactgcggggacaggtgtactgagggagtaggtgcactgggggaacaggtgtactggggggacaggtacgctagggaggcaggtgcactggtgctcactcctctgcagctcccttggtgaggaaagggtagaggggccgacaggtcagttgcagttaaacctgggtgaaagtggggcttgactagtttgtgtcaaataaggagaggatgagctccccagtgagggggtcccagaggctccccttctcccctctcctcctatgccagccagcctccctgagccctccgaggactcagatctgaaacaaaagtgggactgttttttgctcttgtcctcttcttcccttccttttgtctatctgggaataacccacttagtggtggtgatgatgattgatgacataatagcagctcatatttattgaagacttactaaactgggcagcgaacatgaataacgacactcagctgtgcaggaaaaagtaattgattcttataatggataattttcaatgaaaaacttagtgtgaaaaataaaggtactttagtctctgatttaaatgagttgctttggagcgaggtcccatcaagtcaaaattcaaacttcctgtgagggcagctcccagtgcccctcccctgaatggtctggcttcctggggaagctccagtattttcctggtgaccagggaagggcctgggggctgcagggtttctgcagttctccacggagctgtaccttgctctctctgctgcttgggcctctgtgctgaactccattgaaggggccaggtctggtccggtccccagggcttctgagggtagacttggcacccactgctgaagcttaggtcttcctcaggctcctggctctgccaggacgtccacccactcctggagggcccaggtgtccagtggctggtctgggatgtgagggttctaaatgggtgggcccgagggcagcccccaggtaacttcctcagctgttgccagccatgtttgctcagagctgggtttaggcagggtttatccacgtgacctttccccaaccctgcaccctattctgaaattctccaagtcattgagttatttctaatgacactgcaaaccaccccctcctctcttctctggaggtggggaaggaagtggaatccagggcatttactttcttttcctcctagtactagaaagattttctttttcttttcttttctcttttcctttcttttcttttccttttcttctgctttgctttgctccctcccttccttcccttccttcctgatgggagtctcgctctgtcgcccaggctggaatgcagtggtgtgatctcagctcactgcaacctctgcctcccaggttcaagtgattcttctgcctcagcctcccaagtggctgagattatgagtgtgcaccaccacacctggctaagttttttcatatttttattagagacagagtttcaccatgttggccaggctggtctcgaactcatgacctcaagtgatccacctgcttcagcctcccaaagtgctgagattacaggcttgagctaccacgcacagcctataaaggttttctattgccctgtcctgtctagaggagacatcattaccttgtatcaactgttcctccctctatgcaccattttgttctggaagctatcagtcttcttttcccagggaaaacaaggtcctggcttagctctgatattagaagtgtacaagaaaagaaagaaaaggaaaaaaaaggaaacactggcattttccagaggtaaatatgttgggaaatattttaaatattttccttgtgaaatcctctgtatctggcaagcagggctatgcctgaattctcactcagtcctcaccactaccttggggttaggtcctgtcatagtctctacagatgaaggaggtaaggcttagagaagtcaagcaactttcccaaagtcttgcagcttgttagtggcagagccaagtttagaatctaaaaattctggattcttgaccccgtcgtatgcctgaggcttttgctgcttctcagaaatgagtcttggggtaatggctctttagcactcagtgacgtgtgatgtagcgccttgaataacgtacaatatcccccagagaaatggggatgggtttcagttggctccaccaggggtaaatataagagcatacctcttatattgtcataggatatctcatttcagatttagagaggggcttgttggttttcaaattcccccatttgtatgcatgtgactacctacatccttcttttttcactcattttaactatgacttttcactaactgtttgggtgactgcactggagaaaaagtgtgatgtggacatccttcaactccactctgcttccctagtgaaagaggcctttgatttgcagcagtagctcctgttcgccgagcctggtacagccctgactctcagtgctcaagttggctaaagccctgcccttttctgtctgctagtagctgttgaggatcatgtgcgacatttgaaaactcagctctggcttcacttgcactggagttgaaaggcgaagggggtatctgggcaccacctaaaaatagggggagattaactctcactttatgttttaagcttttattacataatcagcatcatgctattggtgttatattaactctatataagaggaaggagaaaatccagccataatcacaccacatgcatttggattcacatttccaaaagctccaatgccccgggaattctgagatggagggcagggcagggaagggagcaaaatcaatgagaggtgattaaggtgacctgaggtggcaggagtcaagccaacgcacgggctcagtttcagactcattttcccttaagactgagctctggcattgccttctccagaaagccttccctggtgtcctccttgtcaatagccagcggtattaggtgcctctctccacccacaccacaatgccttacttgggtcactgtgcgcttcccgcattatgtcatgactgtctatttatgtgcatgactctcccactggactgtgagctccaggtgctcaggaatgtattttgttcatctctttatctctggtgcctggcacatctgaacaggccaagaaatgctggttgacatagtcattaagctaagatgctggacataggggtccaggtagtgactgaagatggcatgcattgagactcagacaaatttctaaagtctgcagggtggagaacagcacggagtcatgaagtgtgttttccatgtctgatacaatatgttttattttatgtattttctgtgtgcaagagagagagcaggaagatttgactgtgtcttaccagtggctgggagatctcttctcacgttagaagagacttgaggaacatgagctggggctctattttttccttatgacaatgtgagctcccaactctggactccaaatctagtgctctcttctttagcctgcaggagggcagggactgtgtcttttttcgtattggtgccaggtcacagagttggtgctcagagaacatttgtggaatgagtggctgaatgaatgaacaaacatatggaggaaggaactcttgccatccagtgagattcatcagggaaggcttgaggggatgcgcattgagcgtagctatgaaagagacaggggcatgggttggcgaagatgccgagaggactctgtggttgagtggttggaagaaggctgttggtgcccctcttggtgcctaccctaatgagatggccaggctgatgctgacttggaagggccctgtcttgggagaagggagggtggggaactgagggaagtcatacaaagacacaggcccagagagggcttcccccttatattctgcttcctttcctccagaacttggagacattactaagattccttgaatccctagggcagggttgggggtggggtggtagtgggggcagttctaacaaatgagtctggacagaggcatgtggagtgtggcccagagaaaaggggaggaggggaaacatatattgcaagcttggagagaaggaagttctattttgggtgactttaaatcccagcccctctgccggccagattcacagcagacctcccccctgtgcagaagattccctcattctcagttctgtgcactggctttggctccattttggctcacatcgctgcatcctttaagacttagttcattcatactttggtgttctatctcttggtatgcttgcctgcatctaaaacctccccccagccttccagccttcttaaagaaggcatccctaaataacagcagcaaaaatgacatctacagtttatccacatttctgctatggccctgcaccaccctgggtgccttatgtgtccttcaactcacaagaaaaacgcgaggtcattattactgtgatctctagttgacaaatgaagacactgagcccatgacaggtcaagtaaaccaggcaaggtcatattgttagttggtggcaaagctgtacctagaacccaggtatgcctaactccaaagctccattgtcatctcttctcacagctacagagccttctctctaaatcagaaactctggggtggggcccagcaatctgcattttaacaagccctccaggaaattctgatgcaggataaagcttgagaacggctggtttggctgatctggctccgacctggctgcaaatctccacgtccaccctagatttgggggaaagcccatttgttaactgccattactcatccttactattctatttactagctccggatagagggcaagatactcaagtttcctgagcacttgtttccctagctgtaaaataggaacaattccagctcttctagaggcactgccctggtttctggtttccaagagaagatcttctgtgagtggctgtcaatactcagcaccttagcatcacctgggggaacttttacaaaatattaatgcccactccctcccttcccagactaagtcaacatctctgggagtgggcctggggcatgagtagctctgatgtgcatgtaggtagagaaacctgctgcccactctcaggcttctcccttcctatcacttcctcaaaggaagagccaaggcatctccaactggtgactctcgaagaagtatgagctgggcctgtcaactgcctcccccgtctctcttggatctgccacctgcagggtgggtgcatcttggcagtggggtcaggagcttgctcctatggggaggtccatagtccccatcctatgccagtgattggatgtgtgaattggcgtcattcatgggtggaatattaggagtgcatttggccagtaaacccacatccttccaacagctctatcataaacatagctgctattctcgaactcctgacctcaggtgatctgcccacctcagcctcccaaagtgctgaccaatatgatgaaaccccgtctctactaaaaatacaaaaattagccaggcatggtggcatgcgcctgtaatcccagctacttgggaggctgagacaggagaatggcttgaacccgggaggcagaggttgtggtgagccgagatcgcaccattgcactccagcctgggcaacaagagcgaaactccatctcaaaaaaaaaaaaaaaaaaaaaaagaaaagaaaaaaagaaatggctgctattttgacctttatcaggggcttcatgtgtctgtttctcaactggtcctgaacttgagcatgaaggggaaatttttatgtatggcccctacaaaaccccaatgccatatattttacagagttattgctgaatttaatgagatggcatattcaagccagctagttagttggtggtcagtaaatgtttgctgcaccagaatcaaaacaggccccctctgatatcagccttacactctccctgtgggatggacctcccagcctcaaaccacctgtaccaccagcccatggctgacagataattccctaatcaccacttcactcaagtcagtccacacggatgcttctggtagggatttgcagaagatctgcaggtgagagagtagaatggggctgtttggttaagcatgtctgggctctaggcacagtgttgccagcaactagcaatctgacctcacctggttgcctcagcctctctggggcccaatgtcttcatttgtcaactagagatcacagtaataatgacctcacatttttcttgtgagttgaaggaggacacataaggcacccaaggaggtgcatggcccatagaagaaacgtggataaattgtagatgtggattattattgctattattattgaagatggcaccaccttttcaaacaaattcccgggtgatgctgatgctgctggcccagtgacaaattttaagataaccagcgctcaatgaaaacaaaacgcaggtgagctctgacttttgggaattgtagggagagtgggctggttggtcgaggccttgcctgacctggatgcagtccagtgtttggtaaacttgcctacaaattagtgtcacctggagagattttacaactgtcagagcccagaagagtgaccaaccatcccagtttgcctgagactgagaaggttcctgtgatttgggactttcttttttctttttcttttttgagatggagtcttgctctgtcacccaggctggatggagtgcagtggtgtaatctcggctcactacaacctccacctcctgtgttcaagtgattctcctgtctctgcctcctgagtagctgagattacaggcacacactaccacacctagctaatttttgtatttttagtagagacagggtttcaccatgttggccaggctggtctcaaactcctgaccgcaagtgacccacccacctcggcctcccaaagtgctgggattacaggcgtgagccaccgtgcctggccaggactttcagttttaaaactagggtgatcttggacaaaccacgatgaactgctcaccctagtggtcccccctctctctcctcccacagagattgttttaattggttcaggttgggtctaggctaggcattgttttttttttgtttttttgtttttattttttttaaatgccccgtgattctactttgcagccaggcaggaaaacctgagggatccgctcataactttggatagaaagtgtgaattgttaaaaggtttgtaaaaattctggcgaaaaaagaggaaagagaaacggcagtaaattaaactgcctgcatccaaatctcctggggaacttgttaaaatgcagattcgtaggtcttccccccagatctgtttacttagaaactctgagggcagggccctggaatcttcatctttcgtaaatgcactaggtagactcaaaatgtgcacttagtttgagatgttctgttgaaagtggaaaaaacaggaattaaattgagagaagagagctgggaaactcaggatattgtttaagcaggtagtctgttcagtggttctgacctgagaaccaggcttaggacctgaagccaaaaggaagaatgagaagggtgcagatggagtccagaagaaaggggtcagcctcagcctgggctggaggtcagccaagctggcaagaaaggacaatgcctgagagaaatgattccaagcttagagcatgtgcaggctcacagagcaagtgtgaggtgagtccacactgccagcaaatcgcaggaggctctgcacagccagcctcccagaggccagtgaggggagcccagtgttcacacaggtgagcacagacttgatgcaggaagcatttctaagtagaacccagtagactggatatgaagactggataatctataaaatagagaactgtgtgtgggtgcgggagtacctgtgtgttgggggagaagaatgggagtttaagacagctgggtcatggccaggcgcagtagctcacactcataatcccagcactttgggaggctgaggcaggcagatcactggaggccaggagtttgataccagcctgggcaacatggtgaaaccctgtctctacacaaaatccaaacattagccaggtgtgatggtgcatggctatagtcccagctactcgggaggctgaggcaggaggatcgcttgagtctgggaggtggaggttgcagtgagcgaagatcgcaccacagcactccagcctgggcaatagagtgagacaatgtctcaaaaaacaaacaaacaaacaaacaaacaggcagctaggtcagaacctgcctctaatcctggctcagtcagttttgtgcttgtgaccttgggaaggttgcttcacttcactgaacattggtttccttaaaattgggatgctaatacccacatttcggagtttcttgtgagaattaagtgagatagtacatataaaatacctggcatatagcagtatttaagacaaaggaagagttaaagatgcttctctgtctttgaagttcggggtggtccgaagggggaaggaaaggagaggttagttgtaggggaagttggtggcaccagcattggcacatctgaatagaaatgtagatcgttggaaatatggagctggagatgagggaaaggagaattttggagtgaccattgctgaattagtctgaaggaaggagatggaggggagttttggaggggagaggatacaggagaaggccagacatccagggtctgcaccttggcaaagccctggtctatctactatgtgccaggctctgtgctgagcaccagggttcccattacactgtgcgacactgtccctgacctaagaagatcacaacccagggagagtggctgtaattcaggaaacaatagatctgcctgatgtttgattatgggagaaacacaggatgctaaggaggaggaagggtggccgggatggcttccaacaggaagtgaggcttgctaggtgttccggctgaggttccaggggaggggctccaggaggaggggatctggggggtaggggtcccacggggagggttccatggggggaagctccaggggcagggttccagggggaggggcgctgggaagaggggctccagggggaggggttccagggtagagggaactccttggggaagggttggggaggggcttctagggcgagggttccagggggagaggctccagggggagggagtcccagggggagggttccatggggaggagctccaggggcagcagggttccagggggaggggcgctgggaagaggggctccggggggaggggttccagggtagagggaactccttggggaagggttggggaggggcttctagggcgagggttccagggggagaggctccagggggagggagtcccagggggagggttccaggggggagggaactccttggggaaaggtgggggagggcctccagagggagggcctctacatggagggattcctgggaggagctctgacctgagtggcttcggctgaatcagagaggctagagagagcttggagttctcagggcaggtggatcagatttcacatcgttcacaacttgaggagggagaactgagaaaaggcttctgaaggggtgacaggatggaaaaaggtgacacacagcaggcactttccaggatgaggtgggtaagtggcttcaacactgggcactgaggagggagatcccttcagtggcaataatcggggtagagcttgcaaggatgtctgggttgaaaaaaggcaatttagaaatggggagtccattcaaggactgttctcagggcttgaggattggcctgtgttctcagaggaaatctcagcttctgtagcctgaagtcctggagccagagtctcgtttccgtcagagaaagcatccctcaaagcacagagacgaaaaatatctcataccttttacatgcaagatgccttttgttgacagagaggagggggaaattaaaaacagaaatgaaacaaacaaatgaaaacatcctgcatttatctgagaattccaagacctgatttaaccatgcaggtttataaagaagcattcctttgccacttgctgagggtcacttgagaaacctattgagggtgcctggccaaggcctggatgccttcatggattgaaggacctgagtcattggctgggccatgaaggttcattcctggggtgttaaccactttctccactctgcctctccccacacgctgctgttagatgtcgttcctttaggaagagctcacggaggactgaggacctgctgcacacattccactgcgccaggagctattctcatggactcagagtctagatgggggagaagttaattggtataaaaaacatacacgtggccaggtgagatggctcatgcgtgtaatcccagcactttgggaggccaaggcaggaagatctcttgaggtcaggagttggagaccagcctggccaacatggtgaaatcccgtctctactaaaaatataaaaaatttgccgggcgtggtggtgcatgcctgtaaacccagctacttgggaggctgaggcaggagaatcgcttgaacccgggaggcggaggttgcagtgagccgagactgtgccactgtactccagccggggcaacagacagagactccgtctcaaaataaataaataaataaaaataaaatcaatgaatacaagatattaaataacgtatgtaatgaagtatataatgaagtgtcctataaacagcagacaaaaagtgctttgagtttatttaggagaatgcaggtaggttggagtggttagggaggctgcttggggaaggtggcatctgcagtggggatggatgagagaagagggggaggaagcaggggaggtgggcatgagattggggtgaggggtaatgttgagaatccgcatgtggaacgagcaagtctattctttactatgtttcaaagctaaaatagtctcctgcttttattatttaatttcagaaggatgtagaagcttcgtgtatgcttaatgtcatgtcatcacattgatgatatgtcttataattgatagggtcaagaattcaggaaatatagcaatttattttttatcataccaatttttaaaaactttattttttaaattgacagataacagtgtagcaattcatttaatcctttagctcttatcaagttcctgctgtgtgtatggaaagagcactgcggggggagttggagataaaaatgtccctgccctctaggaatttcagtcccttgagcaatggtgcatttaaggaggaatgagtgggacaacatggtcggaaagcagggagtgtggagtggaggagtggggtgcgatggggaagaaagatcagggtggggagtagtccagcagttactgagatgtagatcaacgccgcttgaacaggaagccaccccagattaaagtaacttgtctctgttcagtcttgaccattcagggactgtgggtgacatttttggaaacacacaaggagtggccagccaggccgctcttcctgggaaaggctgcctgcgctggctgctggagaagatgggcagggccagctgcatgatttgcgggcccagcacaaaatgaaaatgcaggactccttgttcaaaaattattaaaagtttcaagatggcaatagcagagctttaaaccaagcgcagggcccttctgagtgtgcccagctcgcatgcccaagaggccgatcctgaaggtgggacagcctggacctttctgtgactaagtgtgtggtgagacgatggggcccaattgctgcctgtgagtaggtacagggtttggtcatgcaagcactgagttctttcctgtgagctgggatggggagatggggaagagatgggaagtgcaccataggaggtgctgtggctgtggggatgcgtgtggtgtacagtgatgctgccatttacgagctgtgttctgcttgcagtgggaaggctgtatctgaatgttggaatcagtcagactgaggtcacatgttttatcaactttactaacttgggcaagttactgattttctctgagccttaatttccttatatgtaaaaatggagatcatattactgcttttgcaggatgctagcatacttaaataatagttgtaaaattttgagcctagcctagcttttaataaatactagtattctcttttctagaaatgtgtgaaatatttatgttttaaagcatggagcatggaatagtttggaatatattattgtcagcaactttctttttctatttcaagctcaatggggatgcagctaaaacctaccaccctgatttcaaatagcagaggtggggggttgaggggaggtatgccccattgtaatatacacccaagggaaacccagttacatctgctggacacacacacacacacacacaccccacccagagctaaatcgaagctgggttggaatgtgatactgtgttacaggaagagccctagtttgggcatcgtctcctggttttgaacctcagggtcctcatcggtcaaaaattctgacctctctgggttgttgtaagattaaatgagatgcatgtgtggatactcagtctccggtctatggcggatgtaagcgtcctttgaatgagtctgtgctcccaggccatagtgtggttcatgggaaaaagaagaaaagacattgccttctcaacagtaacatttcctaaatattatgcttgggcaactcctttataaacgaagagcgggctgatcagaaattggcacgggggctgatttccagcgatcttactgtttcctctgctcatatactttggggagttgcctgggagttctttctacttagatttggaagtcggtacaagcatgtgtgtttgctttttggagatggacacatatatgcataccatacatgcacacatacatcacctacacccctccaccacacatacatacaccacacacaccacacatatacaccatacacataccacatgtacacaaaccccatcacacacactacacacaccacacatacacacccccccacacatatacatacaccacacatgcacatatacatcaactacacccttaccacacatacatatacaacacatatataccatacacacataccacatgtacccaaaccccatctacacacacattacacacatatacaccacacatacacacaccacacacatacacatacaccagacatgcacataaaccatctacacacacatccacacatgctcatacattacacacatatcgcacatacacaccacacatacacaaaccccatctatacacacatcacacagataccacgtgtatacaccacacatacacatcccatacacatcccatacacatcacacatgcacaaacatacacatatacacacaccacacatacacattccctacctacacacaccacacactcaccacacacaccgcacacataccacaaatatatgtaccacaccacatacacatataccacacatgcgcatacaccaagtacacataccacacatatgctacctacacatacataaacatacaccataccacatacacacataaatacataccacacacacataccactccccaccgcttcacccagagagtcaaagatatgcattcatgtcttctctctcctcctccctctctcttcctgtctttagtgagcatctcctatacttgcttgtccagtgcacaaggactcagggtcctcctggaccccactcaatccacatccctcccgatgctttgtcctgaaaactccgtttcacagctcccattcctagtcctctttgccatctcgtctgcctctaataaatttctggagtgtgacctaggctgtgagtgccctgttcttatccacccagggccctaggctgctgtcaattcagctgaactcaggaatgcagaataactcgagaagcacatcattcagagagctgtttgcagggtggctaggaaagggggaaatgagagaggttggccctggtctcagcacgggatcacgtggggctggtttggagcctggtatttgggaataaaacaaatgcatccaaggcgttttagaaaaaggtgctgagaatcattcacaggatggggcattagggattgaagacaaaggacaaaagggactctgagcttgggagactatagctctgtaagggcaggagctgtgtctgatgagtttacctgcacgtacccagccccaagagcagtgccgggcatacagtaggtgctaaaaatcaatggtggttggatgaataaatgagcaaatgagtgaatgatgaactaaagggagttcatgggataggattcaattcaaacagcatcatttaacgcctcatatactgtctgacacagattctagtgatggggtagaagaaactactagacaatatgtagtttgactggctcatttacagacagggcccaaagtacttatgttctcttgcccaaggtgttttcaatctcctatggcatcaataaccctatgttggacttctgttcttgatctttggtagcatctctgagtattcccagctctcattctactctacgacgcctcctctaaaccatgtttatgagcagaaggtttagggtggactagaacccccgctgggctacagttctgcagacattccgcagattcaaacctttgtacttcccttatcataaccacatccacgctttttttttttttttgagacggggtctcgctctgttgccccacatccacactttattatatttatttgtctctcttcccaaccaaactgaactcatgcttattttacatttttacagctcttagcatggtacttaggggcccaacaaatatttgtttgaaagaacgaatgaagtggtgaaattgtacacacaacatttaggaggaggaaaggagtcaccctggatctacattttcaaccacatttgcctttcaggggccagctcagctcccatcctaccccctagttactgccccatcccagtctgccctccctgaggagatggactgtgcctgtgggtcctgaggcaggagcaggggcctttctggtagaaaggcaggaaggtcaccttgtactgcagaaggcacagccccgggggccaggtggggccatgtgcacaggccctgctgtgtttctagggcagagttggcctgacagaacctcaaggtccttccctcaagagtgacagaatgctttttgtgctgggaccctgggagagaggatcaggaatagtagccagtgggggcttctcccagtcctgggctgtggaacggtgctgaggcctcagcgatgggttgctctggtgggagagctgggagtggagcacagaagaaagctggaggctcctttccctgcgcctttcagtaacagcaaccccgtctgtgtgagccggaggaggggcttggcttctggaagcagagggggcgaggcctcgggttctcctgtgtagggtgatttccctttggccaggagccccagacttacggcgctaatgggtagcagagacatgggcgctaaaattccttctctttcacttcatagctgttgcccagagagctctccatgctccccaggttcatagtcagcccaggtccttgctctgtgtgtccagcccctcatcctctcactcacgtgccggcacccctccgtggcaccaccagcatccaccccttcctctctattcttggcggttcagggtctcattcccttctacccagacacacagacttgcctcccaactcttccactcttccacttctccctcttgtcttcccaccccatacagtgccaccagaaatgtctcttctaatctcagacctcacaaactctctcctctaccataagtcaaggaactaatcaacagcaagccacacactctccaatggcttcttccttcttcccctggcactcaaggccctcctttttctggctgtagttttggttcccactgcacctttttgagccctgagaggtgcagtggaaccaccctagtagagcttctcattcatctgggctgtcgttgtgccaggttctcactctggcatgccacttgttgagaatgctttcctggacacccctgagcccctggcatgtgctgacgccctctcttcttctgaggcccagcttcattgacacttcttctggtgaatgttccagatccttccagccagaagtcactcttccccacctacagtcccagggcctggagccgcacctccttgcctcccttacatcctaggatctgatgtcaggctcatctaagatacccagaacattgctttatacatggcatttactcggtgggtgggtggatgaatggataaatgaatgaatgaatatttgaccatgaccttggagaactatcatctgcttgtttagtgccctagtgagtcaaagaaacctttattctctttatcatttctcaaaatgagaaaaacagttggaaaatcctcaactcccaccctcacccccaagtttgagaaatgccactctgagggattttcagtttcacttttctggaaagacgttcctttctctccttcctcttctcgggtctcagcgatgccccctgtgtctcccacccctaggcctgcacagaggggactcagaggccgagataatttacttttgctttctttgccttttccagagcatagggggaaaccgtaatttaggcggctgctaagaatagctcccccaatcctggaaagagcgtgtgcttatttttgaaagtgctccttgtctctcccccagccctgcctgaggctcacagtacaagtcagtcaaattgttcagggcagcagtggtgtctggagacctggtttgagttcctaggttcatacctagcgtccttctgagcctcaagtttcttcgtctgtaaaaagagaagatgaaagtttgagataaacctcgaacatggtaggtgctcaataaataattacatctttattatggttggaatcactagatttagagggcaacgctctcaatgggtcagatagtacaagtgaggagccagtacgatatattaagtggaatcatatgaaatcggtgtttctgtggactaaaaataattggatattgtcagttgcgtaggaatcaatccagtaatccaggagttggcagtctttctataatgggccagatagtaagtgtttttggctttgtgggccatacggtctctgttgcatggtagtagccgtagacaatacttaaatgaatgtgcatgactgttccagtaaaactgtatttgggaaaacagtccgtgggctgaacatggcccctgtaatatctgccaagccctatagtaatatgtaaaactaatgaaattacagaaagaaaactctctgtaataccgtcaacattcaggtatcttcgcaagtagaacagcagcttatctgtgtagctattaatagtctttacttttactaggctctattccaaatgctttacaaatattaactactttaatcctcctgacaaccctatgaattatgtactattatatttcccctgttttatggctgaagaaactgaggctcagagaggccaagtaacttgtttgaagtcacctggttagagttgatggcaactgaacagaattcaactgagtgtgtagggtagagttgggtgatggtaattcaacagcttcagggaggaagtggatggattagagctaagaggaatccccaggtctgcttgctgtccaccagcttgaggagatggtctgcagaggcttggggtggaagcaggtgtggtgtaggtgggcagtggggagatgtgtgggcagagagtctggtagtgtctcttgggacacgagatggaaaagcatagattcttcctttgggagccaggccccaagctgagcctggggccatttcctgggtgactcccagcagcacgtggcacgtggagggtcagcatatagggagcaatgtccgcctgtggagcaggaaattgtttacattccttatgttccatgcagcagctctgggaagctctgagccccattcccagccccagccccaggggacctggtggggagaggagggcaaaggaataggctccccaggatgcccgcagctctgccatcaaaccagggtactcgcataccctttccatttgctttgcctgttgatttagccaccaaaggatgaagccactggtcaggactctgggctcacacatgctgtgctcttccttctgtgcctctgcttatgccgttttccttgcctggattgccttttccctccccttgcacccttccttgattttctcctctctttcaaggctggctcaatgtctgctcctcctggaagcctgccctgacttcccctttaccccccacctcccaggctggacccggtcctccttctcagggctgcccaaacacctcgttctctaactctccttgttgtcactgcctggactctccttgctttcccactagaaggagacttttaggaaagggatcacaccttgtttactcctgggtcctcatcacaggtcagtgttcaacacatggctagaagctggtcaaaagcacatttgtttgaatgagacactactgtcctcaaacgtagccctttcacttctaaaacttggtctttgggcaacttgcctgacctctgagactcttaatgtcatcatcagtaagaagggatcgtggtatcattgtagggttgggggaataaatgagataatgcagaaaattatcagtataatacctggttctcagtaggtaccttggaagtgaccagggacagatagtcaataccatgtccttgtcctgttacccctgtgtctgaaggtaggaaaggaggcagtttgataggaggcaatttgaatgtcccaaagcaatagcattttccgcaagagctagaggaggggctcatgagtcagctttggttctgtgacaagaccactaggcttagagtaagaatacttacttgtgagtcctagctctatctcttagcagctgggtgtcatagagcaagccatgtaacagctcctgaagcctcaatatttttatctgtaagagggtataataataaccaccttataaggtcattgtgaagctgaaatgagattgcccagctgtgagaacacctggcccagctcacaggaaatgcagaatcatgaattattaatatgaatctgtgtaacacttgagaaaactctgagcagatctcagcttaggatactttctggacgtgtgccttatggcttagtggcttactgctttagagtcagacagtcctgggtttgaatcctagctatgtccctaactagctatgtgaccttaggcaagctacttaaccactctgaaccacagtttttgtggcttttgtttttgttgttgcatttttggttttttctccataagttctataaaatgaagccagttatctcagagagttgtcgagggaataaaatgtcgacatagccagtgtctggcatgtaggaaagtctcaagtgttagtattattctgcttctatgtaagactgagggataaacactgatgatatggggcttttgaagtcctgaaatgtaaaagctggtgtgtgcagtggctaggggttagggtttgagggtaagggctaggattgcatctttaccaaccaaatggaaggaatcagctcaagtggtaggaagtccttcctggctcggagagcaatgtgggggaagcgctcagtacaggcagaggacagccccttgggaagcctttgggaataggatcgcgcaggcagtatgaaaggtcagagctgggaaagtccttggaggtctttagtcaaaccctgccattgcacagaaaggaaactgaggcccagagagactaacaccatggcctgctgaactcccgctggtgagtgacagaactgggacaggcaatgtgctttcactacaatgtagagggactgtgatggtgatgggtgcagtcaggctggagccacgagaagcgttgcttaactggctgtgacctatggtttggtgtcttaggccagttggtctgtgcttggggactaacagtcttgaggagaccttgtccccacaggaagaggggagggagcaaggagacaggatgtggagggcagggagctgctggcgctggggaagttttcatggagagaaaagtgggtggaggtgggggcagttgaaatctctctggcctgagttcaagtccacttggtttccttgtgtctttgcatccccttttctccaaattgcttctcaattctcctccgaggtggaaaactcattgttcctcttctaaagaggttttgcagaaatgaattcctgtggccacttcaccttctcctctccctgtccagggccagtgatgaagatttgcttatctttctacccagagatagctcagagcccagggaaaagcacagctcccctggcctagaggaaggcagagctgggtgacttcataaatctggccaggcacattcccagaatgccaggcctcggtcaccccatcattgcctggagaagcgctgaggcttgcaggctctgggcagggcgagtcttaccttgctggcgatgatgggaatggaggcccgctgcagggtggcgcttcctctagtgtcgcccagtgtgctccaagcatttcacttctattacttcctgtactcctcactgaaacccagcgaggaagaccctgtgatcagggtgtcacggatgaggaagctggggcttcagaggtgaagagtactcatgggcactagctgagaacacaaaggtgggggaatcccagtctcctgacttcaaagcctctgctccctaccccaccctgctactaggaagctggagtgaaagaggtgtcagagcaggagcgggtgaggaattagggttcagatgatggaagcagctcctactgatgaggagaaggaggcagcatttggagcctctataaacctctcctgctctctagagggatttctaaactaagctatagagattgatctgctctagcggagggaggctatggctatgggggagctgaaggcaaggtaagaaaagcccattgacagggaagacaaggtctgctggggcagtgaccggaccacagcctggctgctggaatcctgggttttaatctcagctctgttcctaggcctgtgacctcagataagacagttcctctttggacctccattttcggatctctaccatgaagtgacctgatttctaaggcatcttttggcagagaacctgtgattttagtcttggatgttcagatggggccttaagaaagggaggcaaggaaagacttagggtttggttgggagggcattgtcctcaggagcataaacatacttgggagctgtcatacatgcagcccctcaaaaagacacatatgcagcagccccctgtatgcacgaggtccttctcttgggggatggtacttcctgttcgcagggtctgtgtctacttctcctctcctgagggccactgtgcctcactccccgtactcaggggagatgctctaatatttaacaacaggtatggcacaggccctggccagtcagagcaatcatggctgtaaacagccggtgtaagactgtgccaaggtgcaccagctatatgccacccctgctgccatgtctgattcctctagtagagccaagaaaggtaagagggagactagggaacaagaggctggggaagtaaaggcagaaagaggggtcacaggttctccttgtccctccctcatggtgctgtcatcccagcctccccgctgcctctcggagctcccttcccatgccttgtgccctgaacaaagcagtcttgcttgccagctgcagctgcgttctggaggctgatggaaccaaggggatctggtctgtattccatgtgatcatcccacacttgacaatgggcaggggaccccagggattccacccctacctgcctgaagagttggtgctttactaaccctaatggtcagaaaccagggctttgtcttactcactctctgccattggctatcaagtcccaggggaaccccaaagtcccccttccactctgttttactctaatgctaacctactccaggtctttgctgccatgtccctggattgctgtgctagcctgctggctgcttctcctaccctcagcctctaggatggttctctttttccttacaaaggttcttgattgcttattaattgctagtagtcaagatttccatcagtattttttgactgattaataaggacccctctttcctccttttccatgagaataggtcatttcccaaatggtcaagaaatatttattgaacccccatgaagcacaaggcttttattggctatagaaatggggatggctgtcaaagaagcaggagacacagctcctgccctccaggagccctcacgatatttatgagagccagcagcaaaaagataaccagtagtacaacggcaatcttccataatgtgttatttgaggcttttctgggcctattaaaaattctgtcacaaagtttataaagaaagagaaaatggagctggtaaaaaattctagaatgacagttaaaatagagcatgatgtatgagaggccagatgagattatactaaattattagctaggacttaggaaataaagcagtgttctctagaagttaccctgagttcactaggaacaaattatgccacatttatattgttctctcttttgataagattctagagcttggttcaaaggagtgtcatagatttagcatatcttgagttctacagggctttaggggaaatctctcatgttgactttatagaaaagagggctagatgagagcatagttacatagatttagagctggttgaaggactgtcccctgagagtattgatgaaacttccctggcattcctagatcagatttttgtgtcattagggtctgtgtccttgatgtggtcaacatttttagcaaagatgtgcgtgatgaccacagaggcattctaatctgttaataatctgagtccaggagaaatagctaagaatcagaattctaaaatatcttgactgcaaaccgatgatactcaacagggataaaaacagaattccatatttatggccaaaaaattaagatctataagtatgggatggggagaatcttggctgggtagcagtttggtgcataagctatggtctctctactgaacccccctaggttgtcaggaacgagtggttgaggatgattctgcctctcaggaggcatgtgtactggttgttggattgaattgatctagaggccatgtggcaccaatgacaggggtagcgttctttctcaagctggtcatcattgacctaggctttcctagtggcgagccaaagccttgaccctttctgtccaatgactactcagctgttaaacgtccatcagttctggtctctagacagaacagtgttctctgtagttgcctggtatgaaaagaaaatctgagcagatttcttctgaaaatctgagcaaatgtcaaataccattccaatgatcagtcctatttctgtacccaggcttcgctctgactcccctgggtaactctctgaggacaactggccgcctccttctagaaggatcagtgaaccactgcctgttgctatttcacattcatccaaacatgcctgtacagaaaactgagcacaaaactgtacaagcctctgtagtcttccgtcttcctcctgctctggagacccaggctgcaggagctatgccacatcattagctcagtgtttcctctgccagccttcttcaactctttcctccccattggtccatgcctttaaatcagttatccccagacccggaaatgaatcaagtgagtaagtgagccttgctggaagctgatcttacggaagacagggaataggagcccgtccacacatttatggaaagtcagctctggtcacatggaagtcacattcagtgaccccagcctttgtccttctctgagggcaaggaaggggaatatgaaagtgtcttggcagataacactcagaggacatggtggggaggatatgtaaatgcctccaggtgggaagagctggagggaacagagggatgctgtgggaggaggggcgacagcggggtgggtggggctttgctattgggttgagggctcccagcaacctgtgggacagaggttatgaaggcagagtgacctctgccctggcctatctgactgtatgcctgaccaccctgtgttctctcctcttgtccagatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggtcagtgagagggtggggagagacagtgacaatggggaggagggtggatggagaggcagagctggacagagggcagggcccctgtgctggggtctccatctctcaaaactcctcttgggaggagataggcccccaggacacctcagctatgttggggaaccagagtctctcactgggatggacagcataaagtgtgtccccagaagaatggtcctacctcctctctgcattggattgtagaccacatggtgcagtaattaggttatcataggaaggggcagctctgggttttgcaaaataagatggtgagacatctcaaagaacatcagaacatttgacgcctttctctcttctgctccttggagtttccctgggatcttttaatgtccgaggcacaaagaagggacagagtgggattctgtgggcagacactgggcacctcggaacaggggatgattggctaggaacctggaggtggaaatgcctatgtcatgcctggggtcccagttcaggcctgggatgattatgtgctgtgcttagcaaggggcaggcggaagctctgccattcacacccggaccagcctgtgctgattccgcaatgcccgcccagaccagctttcagactgcccttgtgagaagcccgtgtgtgtgcagctttataccctggccacaaatagacaggctaggaaagaagcatgattccttctctctttggaggtctggtggtgagacaaagtctgcacaccaagggaggtcccaggcctggtaaagagccataagtacatgttcatctaccattagctcttggtcactcattctgtggtgggccattagtaagccagtaaagaaacaaggccatgtggttggaatgtggttttatacttgtatttgctaatagatatacctggttaagccaatccagctctttaaataacagggtccctgaaagatgagattatgcaggttatatgagaaaggtgtccagcttccttgtcacatcaggtttaggaaaactcactgtttcctgattttttagctttcctctggatggggcaagtggtgggggcaaagcgtttgctagtgtagaataatatctggagcctgattagtgttagggatattttcttgagtagagtgagttttgaaagaaggacatgataggcagtgttcctttctttggctcttttattcaacagatatttactgagcatcttcaggacagggacccttgcatggcactttagcaaaaacaagggtgagtcagacaagtcttgcctgcaagaagaatagcatcaggtatctctcaaacaagtgaacaatatttcttggagagactgctgggtgctgggctgtatgagggtcctagggatgtagagatgagccaccagagacctcccctgcctccaagaatgtgaaagcctagtagggaagactgattttgaggagcagtgacaagtgtgatgagtgctaggacagggagcattctgggggtgggggcatgggagtgtctagcagggagctgtattctagactgggagaagtcacagtggcctctgtgagcagtgacatttccaccgagatgattagatcagtgaatgaggttcaggacaatgacagagggtctcctgcagaagaaacggcatatgtgagtctcaagtcagaaaggagctgggtccttttggggtacacaatgaagaccagaagaactaaagtttttggattaaaccctaagggcagtggaaagccatggaagattttaagtagggatttgaggtgatctgatctgcttttctaaaagaccacgcaaggtgctctgctaaagaagggttctgggttgaccatttggaggcttttgcctcctaatcctacaggttagagagaagggtgccttagactaaagtattagcagtgaggatggagagaagtggacagattcaagagctgtttaggaggaaagataataggacttggtaggatcaaagagtgagtaggaatcaaagaataccctggtttctgacatgaagtgttggatggatattggggccctgggcaggataggatatactggaggagattcaagttgagggggctgggatgatgaactcaatccacacattctttctgtacatcagtttccttatctgtaaaatgagttgttataagttgttatttatttatgaataaacattacatacttagaacagtgcctggtacatagtaactctacataagtacatcatagtagagacgtactggagacagtggggccctagggtctggagctcaggaaactgttggcctaggggtacaagtttgagagagtttgagataataactgagtcctggggaacaggtgagggaggatggtgccctgagggacttctacatttaaaggtaggatagaagaggagaagtcatcaaggaagcccacgcaggaacatagggtgaagcaggagagactgctcaggagggtagttgctaaagaaaccagggaagtgaggtttaataaggaccgagcagtcagcagtcagtcatgtgctgcctaggctgagcaaaaccaccattgatttaggggtatagagaccactggctggaaaagacaagtgcatcaataatctgaatacaagctcacatggaactgctctgtagttcaggaagggagagattcttcttacctgggaaggtctactgaagacttgcgggaggaggctgacactgtgccctaggaattagaccaggtccttagtgtgagtgggtgcagatgcctgtccaggtaggactcactgtgtaaacaaaggcacagaagttgaagaggtgcagagtttgtattgggaaatgtaaggtgcatataactctccttttccttttatttctgattttgatcgtgggaaagaaacctcaaacagggttctgggaattttgagaaagaacttcctgggatatatagagagcagttctagggaagaaattttgtttgggattaaatctgcaagagtctttagttccagaggcaggtgaactgatgggtattatttcaaataatccttgtctgtgctgtctgaatggcagtccctggccacgtgggactactggctcatctgaattgagatgaactgtaactgtaaaatgcacaccagattttgaagacttagtgtgaaaaaaggaatgtaaaatatctcattattaattttctacatgattttatgtttaaatgattatattttagatttactggtttaaaatatactatgaaaattgacttcacctatttcttttaaattttttaatgtgactagaaaaaattgaaaatatatgtcgcccatgttatctttctattaggcagttctgatctaggtgagagaataaagtcttaatattctcccttgaataaaagtatagggaaaagattacagatatcaaaatttaagactattatacttccttagatattgttttcactgtttattgtatttgaaaatataaagagtcataatattatgctttgttatgcttaatttatgcttaatgcaagttttgcttttgattttaaaaaaagcacactatggtctccatggcccattaactagtcctttgattagccctggcattgctcatgaatgacaggagaggcagcttcaaaaatagagcttttcaggggccgtctagcacagcaaaaccttcaaattcaccctaaaatacctatggagttaccccaaatatgacctcataaagttccagttagctccttggaaagtttggactagcctgatggagccccgtgccttctcttgctggtcctgcagtgggaggggctgcctccagcaggcactacctccctcggaagcagatcaatgcctcccggggcatggctcgcccatcctactctgagcagccccttgtcctcaccagctctctccagcctgtgctagggcctatgctgagtgtgggggagccagagaatgtctagggcagagattcgaagggcaggtagatgtgaaggatggggcaagaatctgagagaggcagaacgagatctgcagacaattcccttctttgttaggctttgtattatggtgtccacaagcttaagaatgacaagggatggaagacaagagaccccagggcgagaggatcaggagctagcaaagcaatgcaggcgatgggcagggaacagggtgacctgaagcaggagggtggatttgcagagacaaggctgggggtggacaggaagtaaagggagtgcaatagaagtcacatagggttggttgaggcaaggggatggggctgtatctctgatagaaaaagaaatgccctatcatatctttgatgctcttcgggaggaagatagtagtagcctgaggaactgatttgggggaattgtaatttcctgcagggctgactattctaatctcaaccatccctagtgtcagacgtattttttcttattgtctttgcaggatgaattggatctcactgacaaaaaccgagaggctatgtttgcactgccccctgagaagaaatggcagatctactgcagcaagaagaaggtgccctctctgacccctctggccacatctcagggttcatggcatggggtggctcttgctgccttggcatgctcatgcattcacctgatgtttattacatgccagccctgttctaggtgttggaggaacaacagtgaataaaatagaaaaaggaaattctgctgtcctggagcttacactcaaagaaataggattctctttttcaaaaacgcttaaagcaggacctgctgcatcccaggactggggcttgctgggagacagacaaagaagcagagtctggactctctcgtgcctgctcccaggcatggagggtgggcatcatggaccatacctggagcagctttgctataagaaatcagtttggggggcagggatgtcctcttttggatctttagtctccactctgtcccaggctagggctcacacatctgtccatgttctcctcagcatatcctccctctcttcttgctcattaaaagatgctgttagcctcctgctatggccctccctagaaaggggtatgctgagctccagtggggcttaattggacttgatctcctcccttctgctttcccagcggctgtgcattcttctctctgctgtctccatctccgtgtttcttcagcttgcctctgtctctacgtctctctcttgccccctttctattttagtctgtttcttttgctcctgaattttcttttcatggcctactttcctcctctcccctccaccctcccagttttcagacttgagtcccaagtctaaaacttgttattctgccctcctacattgctttggtgtttggggaccagagcctggctattcccacgcctgaggcttaggctccctccctcctgggaggagacaggaaggtctgggcggagtctgagccatgtatcctttgtgctcctgtgccccctcatagctcttctcttactcttcctgctgaagactttatcccattccgaggtctccacactgagccagactgaccttgtaacattggaggattcaaatatacaccatttcagagttgcaggaacctggaaaaccacacagtgtcgatgcagtctcattctttattctacaaatgaggccaagaaggcctagagaggcaaaactcacccacagcccacccagtccgttatggcaactggctgcccattgctagaacctgagactgctggggaaaatagtgctagaggctgaggacctgtgacaagaggcatgggctgcacacgctatgagccattgtctagtatactcaatgcatgcttattaagcacctgcagaatataacactctgtgtttatgcatctcattgtgagaaaagcaggtctttaaaaagctcaaatcatggaaagaaggaaggaaggaaagaaatttcaggcgtaattaatcatatctcatgattctccattttccaaattgatttactatggagttcccttaagttggtctcttctacagctgctaaaacaaacaaacaaacaaacaaaaaaatggccaggcatggtggctcatgcctgtaatcccagcactttgggaggccgaggtgggcagatcatctgaggttgggagttcgagaccagcctgaccaacatggagaaaccccatctctactaaaaaaatacaaaactagccaggtgtggtggcacatgcctgtaatcccagctactcgggaggctgaggcaggaaaatcacttgaacctgggaggtggagattgtggttagccgagatcatgccattgcactccagcctgggcaacaagagcgaaactccatctcaaaaaaaaaaaaaaaaaaaaaaaaaaaaaaagatttattaaaatagaaggcatctctcactgccttccaaaccaaattgtaatttccccacacactttcacaaccttccaccttcccacatggcacttcctctgtctataacaccctccccacctgtcttagctgtaatgctctttaatagcccagtgttcttagaccactcacgccaaccccctacaagccttctgtgttggatggatcaccccccaaggtctgctatgggtggctctaccatagaacatttaccaccctttctctggcactggactgttacatggaaggcagagaccatgactctttactccgtactttcagagctcagcacagtgattggcatctagtaggtccccattcagtgcatatggcatgggtaaatgacgagccagcaagtttaggaaaggatgtgtttgccgacacaattgtttttggtgctgattcccctccccaaggcagaaggcagaatgtttggccttcagtcatggagaatttaacatgtataaccatgattaaatttaacatttaaccatgtgaagtcataaagacccaaacaaagcagcttttctactggtctaagatttgtattttgtgaaacaaaatagaaaacattgagtggatggagctgagagctgcagggcccgctggcagctggcagagaggtgttttgtcagggagggtctggaggaagttaagttttcatgccgatttggaagcaggagagtggagaaagcagatggggaggagcctccaaagtgacctggggcacaggaacaggaatgagcaggatgggtgtgaggcccagaagcagatccatttggctggagaaggctggattttcagtcaacattaatatttctttaactcccatcattcttgcccatacttggggaagagtcgagcctgtctcttgagggctgagcactgggccagaggtcctcggatctgggctctgcctccccgctgcacatccccctcattcaggagtttgccaggaattaaatcacaggcctaagggggtctcctgagtcttttcaaagcccaaagccttggaaatttctctatttttctaaagttactatttagtgagtgcctactatgtgccaagtgttttctattagtgttctagaaatacctgaaagacttaagtttttaaatttccaaactgtcacagaccaatacttttgtaaaatatgagaatgagattatcagaaaaagtaaaaagatgtataaaaataaacaggaatctgaattagattcaacagccaggaaattatatttcattaaatacaagctgagcaaacagaacaagagaaaagaatttttaaaaaatggtgcacgttgctcactgaaagtacacacacctgcatagtttctgcccgcgtcgttgtctggccatgagagtcaatgttcatcatctgtatttcaccaagggagaaatggaagcctgggggagagtgtaatttcctccaacccacccgacatgggcagagctgagaaatgaatccctctgctgacacggaatgaagctcaggatctcaggccacgggcctgtcttgcctgttggtccatgctgtcctttttcttgtttcaggagcaggaggaccccaacaagctggcaaccagctggcctgactattacatcgaccgcatcaattccatggctgcggtgagtggctgcccctctcctgccctgcccccacctggaaaggctacggcagggagtgattcccccagcccccaccccccacacaccaaactgccttttactgctcctcagcgccccactgcccactcactggagttcagcagctttccagttattcatgaaattttaaggtaatccacccctcctctgggcaatctcagagtcccccaaccatttaaacattttaaaatccatttgggcatcacacaaacttgggaaataaaccgggccagtacttctctccatttcacagatgaggaaagtgaagtcccagcccagaacctaggtcttcccaggggccgacactcggtctcagtaaaccattccctgaggcctcaccctttctgaggcaagcatggcccctgggtcacacctgagctgtagtgcagagggttgggagacaggcagcccctttctacctgctggccctcagatgcagagtctgtacgcgtttgatgaggaggagacggagatgaggaaccaagtcgtggaagacctgaagacagccctccggacacagcctatgaggtaattcagtttccccctcttgcttcctgctgagtcccttcacagttggtctccttgccttcccgaagccctgtgcagtgctctgctcccatgccggtcctcctggccaactctgcctcacctgacttcacttcccagcccctactcctctcctgggaggctgccagggcttgggaggaggggagagaaacctgggaaagtgggataaacctcaggtcctgaggagctctctaaagaggaatcgagggcaagtgctttttaaaaatttattgatttatttttggtaaggggatagaataggagcgtgaccaaatggacaaggtacaaaagaaagagccttgtgaggatgagggggcagggtgagtgccccatccaggaaaagagggacgcacgggtagagaagtactccaaccactagggggcggtgtggtgtctctggatgggatttgccatctagaatgggagcaacgcaggcatggaaaatggggtagaagtcctggagccataggaggacacctttcccttcccaggccacaacgtgtggggcccaaagtggggctccttgtgtctgggtctgccccgtggtgtgctggaactggctagtaacagctggcgaatgctgagtgtcaaattttcagcaattttgtaagctggttgttaaacgtagctatgattaaaatttcaattgtataaatttaagattcagtaagttatatcaaaacaaaggtaataaatacttgaaactcttcattcccaaattacctaattatttttctacattttactataaggtatacttttgagtttacatgcattgtatgtgcatggaaacactatgaaatatgcatctcttcccaactctgcattcaatgacatcatatctgtagcttgaaattggctatgctgggagcatttacaccatggaaatgagcaaacaatcaggagccacccttcacccttcccctggcgaaaagctagccatccattgcatggggatgtgtatgttgtctgagctgagctctctccccaggagactagaaacagcctcaagaagaatgggagcatcccaattgtctcttgtcattctggtagtggtggggctctggaatgggaaggggatagaggaaaggatgaggtagtcaggaaataaaggggttgagaggaagttgccaggtttgtctcctaccccaatttattgtaatttcccttaataatattctgctaacaaaagttacatattgtcattgtggaaattttatggaatgcagacaagcataaaatagaaaaaagtaaaaaaatagctattgttaacaacttagtttgagagcacattcttttattttctaggcgtatttgtacaataacataaacacaaatacgcttgggataagtaatgttatttataataattttcttagatcattaattattttactaaatcaagggtacctgtgtgtgtgggcatgccatggacatccggcgcctaggtgaaacttatggactgcttcgcagaaatgatgttttaaataatagataaaaagataggcataacaaatcaatgaaaatacagctacaaataataaaaatgagatagcaatgaattctgcttctttacaccttaaatagcaagagctagctgcgagtcttgataaccatcataattttgaagtactgaggagtgtaaatggtattttgagatacctggtacaactgtaatttggtatgaaaatagctgtgatttcttggggtgacaaagtcacagattatgctaatactactgtcatttattgctgacattcatcattgaggaaaatactaaattttaattagaagttaccaaaaataaaaatgtaattttcttttcccacccaagtccttggatctgtgaatgctatccatagattcttcagcagaacacagactccaaattaagaacccctgaactaaatgggttttaatgtttttttgctaacattcaagatagataactctgctattttctttaggatcccttgaaatgtagcttccctaggcttaacgccatgacttgatgattctgatggctttcctatctggaagccctctttgttatccgactgtaattctcttaatctccatcctcactggagaggagtgttcaggtttaacagctctgataattatcatgatcatgtgaagaggacttcacattcataccattttagctatgcaactgacaatgatatgcaaatacagagtatttaaaatgcaaataagacacaagtcttttgtgaagatgataggatttcactgctttagataaactacgaataaaccaagtggctactgtaggtgggacaaggtgcatggtggtacacaggtaagggggtaactatttgcaaagtgtacacagaatcatatgcaaatatatgtttgttaatggctctgatttgtaggtttgtgacccgcttcattgagctggagggcttgacctgtctgctaaatttcctccggagcatggaccacgccacctgtgagagccgcatccacacctcactcattggctgcatcaaagcattgatgaacaactcccaggggcgggcacatgtgctggcacagcctgaggccattagtaccatagcccagagcctacgcacagagaacagcaagaccaaggtggctgtgctggagatcctgggtgctgtgtgcctcgtgcctggtggccacaagaaggtgctgcaggccatgctgcactaccaggtgtatgcagcagagcgaacccgcttccaggtgaggggccaggctggaggtgggatgccagctgggtggggcagaggatgtcacatgtgagtgagagcctgaagattctttgcagcagaaactgggggaaaaggaaagtaatgtggtctgcatgcctgctcctggaaggtaacaggtgaagagtactgggacctggaaggcttgcataaaaacacatgcagggccttaagagttatgagtttggctgggaaatggacttgtcttccttattagtcagtgggttcctggaagccggaatattggcctgcattatttttgtggctctgcatctccaacctcaacacctggctcatgataggggctcagtcaagaattactgaattgagtgcaattgctgagattgagattttaggtgctatacttgggccagtacctaatgtgggacactgggaccatccctgggagcttcagccatgctattctcttttctttccctgacctgcccagagaagtatcagtgagatgaacagtaaatatgaagtgtcttagcacagtgcctggcacagagtaagtccatagagacatgaactgatgttacaaaccccatggtttattgccaaaaactgggtcctgactctgcagaagacggaaaagggataaaagcagtgtccataccataaatgagctaggcagggaatacatatgagctgtaaacagctggagcacgatgataaagcagcactgaagcactgctcaaccatgtagaccaagccccaaaggctgagtggagaggaagtgaggcagcactgccactgaggtgagaggcaagggaattttccaggcagaggtgaggtttggggcagcccagagtaaattggacagacctgattgggtggagagagcagatggggcattctaggtagtggaggcgacaggagtaaagatgcaaaggccacacctgttgggaactcagccctctcctcctgctctgtcctgcatttccacctagaccctgctgaacgagctagaccgaagtctgggccggtaccgggatgaagtgaatctgaaaacagccatcatgtccttcatcaatgctgtcctcaatgctggagctggagaggtggggtgccttctccttgcccttgctgttccctgactttctggacctggggtagagtgtgtgagtgtgttgcttccccaataattgtttttgctattaaacctgggagggctcctggggagttgcctacataggtagcatcatgcacggtggacagacccagagctgagctggctgatgatggctcagggtggcagagaatcattggtgggaggagggcgagtttgggcccttgtttatggagagctgtttctggactgttttctcgttggctggtcatgttcttctagtgccttctgttaggtgtgccttctggtttcccttcctttggggtcagaatgggattcttgaagtataaaaatagcaacaggctgggcgtggtggctcatgcctgtaatcccagcactttgagaggcctaggtgggtggattacctgaggtcaggagtttgagaccagtctggtcaacagggtgaagccccgtctccactaaaaaaatataaaaattagccaagtgtggtggtgggcacctgtaatcccagctacttgggaggctgaggcaggagaatcacttgaacctgggaggcggaggttgcagtgagccaagattgcaccatcattgcactctagcctaggggacaagagcaaaactccatctcaaagaaacaacaaaaaaagcaacaatagaagaacttgaagagcaggtgaacgttccaaattctaaggcaatcagatgccctggtcaaggttaacttgaaggacagagggggcaaagggagcaatttaatgatctttactttcccctcttttccgccagcatactttttttttttttttttttttttttttaaaaacaatttatctttatgccctgggttagggaaggccggttgggggaataatctgcccctaagatgctaacatcacctttgttggtaccaccttttcatggctggcatgtgctctgattagctggtaaccacacctcatcaggtaattataacaagtgtcatccctgtagattagttatgctatgatcatttcacaaatggggaaactaaaagttttcccaaggtcacaaaaccagatccaagatctgtctgattccaaagcttgtgctccatgtcactctacaacactgctctttggtgctgaaggctagaactggcaaggggcttgaaggaagtggggcaggagacctaaaagaagctgggcagtgggtttgctttaaactaagaaataaggtctccattctttcttggaactctgggattggaagcagctccaggtgagttagctgtgggagatgtgttgggtctgtggctagggtggtgatgagggctccactggggatgttgtggaaactgagatctgccaatgagtctggccctcccttggtgacccccaggataatctggagttccgcctacatctacggtatgaattcctgatgctgggtatacagcctgtgattgacaagctccggcaacatgaaaatgccatcctggacaagtaagttccaagcacccgtctccattgcaaacctgtggggacagtgcctcagatggggatagttgggacctttgtgaaggctgcccttccctctggagaccagctgccattcccagcgcagattcagaatcagctctgtggggggaaggggtgcccttgcctgtcctctttgctgacctgcttgtctcatctctgatgttatagacaggtgaacccagtagccctcaaccattgcagtacttccccctggggggcatgtggaaatatatgagggtactctttggttttcaaactggttgatggtgggcaatactggtattggttgttgggggccaggaatgctaaatgtcccgcagtaccttcctgctcaacaaagaaatgtcccacccaaaatgcttgctataacgcccttgttgatccaagggcacaattatgttcccatgtgataccagtgaggcccctctggttctgtcccattagtttaggctattttattacactaggttttaagggacagaggatggatccttttgaggtggaacaagtggatgtgtgcatgaggatagaaaatgagggagagattagttttgagggttgacttggagaccctatgaaagtactggggaaaatagaccagggctgatgtcctcaactgagagacattgggcgatgcctgcagacattacattcttggttgtcacactagggggtgctgctggcatctagtgggtggaggctggggatgctgctaaacatcctcacagatcagcctcccacaaccaaagataagcgagcccaaaatgtcagtagtgccgaagtatagaagcccattctaaggtgaagggaccctggattggcctccctgaaggaaggtcatgggatcttataaagggcagacaatgggtgtcctacaaacagcggcttctttcccattttgccttcattttgcttgaatgaagctttcagatttagccagtggggggctcgaaggggctgtaaccctcaaccaagggtgtgtcctggctgtaatgtctactctctctgtctccccattctgtctagacatttagacttcttcgagatggtgcggaatgaggatgacctggagctagccaggaggtttgacatggtgaggagccagcagggtggagcgattgcaatggggtagtagggttcttggtggccccacagccacttttctagaccccgtgttgtggcagggctggtgtgggctggttccctggtgggcacccccatggccaggtcctgtgatcagtcatagttcttcatagaaacacaaccaataggatacatatatagagatagacagatgagagggcatttattaggcgaattggctcacgcaactatggagactgagaagtcccatgacaggtcggagttattgcatggagaaacagggaagccagtagcatggctcagtccaaggccaagggcctgagaacataaggggccactggagcaagttctggaatccaaaagctggagagcctgctgttctgatgtccaagggcaggaaaagaaggatgtcctggctccaaaagaggtagacagaaaattcacctttccttggcctttttgttctctccagaccctaagctgattggatggtgaggagcccacagggtggagtgatcgtagtatggtagtagggttctaggtggccccacagccatttctccaggccctgtgctgtggtggagctggtgtgggatcttccttacccagtcctctgattcaaatgccagtctctttgggaaacaccctcacagacatacccagaaagaattctttaccagctatctgagtatcccttgatccagtcaagttgacacctaaaacgaaccatcacatctcacttccagagccttggtagtatgcaggctgtggaagcctcccccgggaaggcatcggcctaggaggagactgaaacccccaaaggaaagggagcaagttattgcatgtgattagtctcaaatacctttcctgggctgactttcccctgccttccagcaacttcctgagtcccctctccccatccctaaccagatcatgcttagcaaactaaattgtattttcattttaacctcggcaaccctgaaagcacacaactctgctttattgtgttataaaatccccatccaaatagaaagctacttttgggtggtgctttacagtcactgagtgcatccattatattttcacaaaagccctggatttatagatacagaaacagaggttagaggggataagcagcttgcctgtcatcacacaactaaagcgtagatctggggtttgaacccaggtggtggacctgcgccacattccacctgctactttgaatcctctatgcccctgctcccttccctagtttggatcagtagctctcaagcagggatgattttgctctcctctccccctggggacatttgcaatgtctggggacattttgacttgtgtgagggggtgccactggcatctgctaaggagaggctggggtgctgatacacaacctacaaagcacagggcagcccccacaatgagtaattatctgacccaagatgccaatagtgctgagactgagaaactctagtttataaaattgactatctccctgttccttttgtctttctctttttaagcctgggccagaggcaggggaagaaaacctttcctatgagacagggcatagtggatggaagcagggtcttctctctcctgctgacttcctctgctgcctacccactgatcactgtgccctcttctctcccaggtccacatcgacaccaagagtgcttcccagatgtttgagttgatccacaagaagctgaagtacacggaggcctacccctgcctgctctctgtgctgcaccactgcctgcagatgccctgtaagtaccctgcacttgctgcttccctcgactggcctgaaccttgacttggggcaggtttagacaagactttgggacctccctggtttggggagtctgaccatgtctccctgtgcacttgcttttgggagggcaggccccatgacggaggcccctgcttttccttccctccttggggtcaggtcttcactgtcatctggggaaggagctggggacttggccctgagcaactccaacatcctagtccaaaaacggtagcttgatcattgcaaaattaaatagctcagctttcagctcatgacgggggagagatcagtcatgctggggagttccaaaaagttttgtgcttgggggagtagcacagatgtggaatgaacatggttgtttttttccttaaggttttatcaactccttcatctagtccttgttggcttccactcttgcactcttgcccctgcttctgcctacaaataccaaatgtcagcatctatgggagcagatggctaagttcttaagatccaggtgtgcacagtgattgaataaattgtacataattgctaatagccactccagaatgcaatttgaaatgagctttaactgtaccccttggtacttaagctcttcacaaaagagaatattttgaaaaccagtgtggcccaccataatggttgatgttggcggtgtcagcaatcatagtgacagtgatgacaactgtgacttattgtgtgccaactctgggccaggcgtgatgtgaggtcctttagcacatcatctctgaaccttagaatgacctaaggaatacacattattatgtccatttgaatagtgagtgaacctgaggctcagcgagatatttacatatagaaagaattttggtttctgcggggtcaagggttgagataaaacatgttctgcctctttgagctagtgacctggctttacacgattttgctgggtgaaaagtagatggtaaatgatacaactttgcaatgcatgtgtcagtagacttgtggacaggatagatgcagtgacctgaattaagaagctatcagttctccaaagctcattgcagcaggtcttcatgaagggcatagaaatctctgggaaacctgacttcttgtgctcccagggattcctgtgtttcctgttccatgggcaatgtgaatgggttcttctactctgccccaaaatggggctttgcagactcgatattctaccttgtaggcattgtggtttgctttgatgtcaggattgaacttgttggctttttatgatggtcaataaagtgctagggatcaaggaccaaggaaagagagtttgtggttattacataaaaaggaagtccatgtccagccagatgactatcattagaggggatgagagtgagactctatgagatcacacacaacacactatgcctttaccttcatagttcaaggtcacttccacaagaaattttctcgagttccattaagcacttctctaacccattttgactctcagtgcacacctgcaatcagtttcccttcatctttctctgtagagtaataatgtggataatcctaaaatcttttttaaaaaaaacttccctggagacttcattattcagcatgtaatattttggagcaggtggtttttatagataatgtaaaaagcaatctgcacttcctgggcatagtatgcccagggtccaaacaaggaagaaaggcagccagaaagtatttcagggagtagagaaatatgttggggaggtggttgacacatccgtagaagtctagttgccgataatcaagagatgactgaatcagtgagttgccattatcagcaatggcattgcctcttcttctagactgggagcttaccataggtggagaagggcatgcctcaccagccagaccccaggcagcaactctagggtggggcccaagggggacttcaggactcaggaaagatatgatacctgtcatccctcagacaaacggaacggtggctacttccagcagtggcagctcctggaccgcatcctccagcagattgtcctccaggatgagcggggtgtggaccctgacctggctcccttggagaacttcaatgtcaagaacatcgtcaacatgtgagcagtggccagcctttgccctgtcttcctccaccttcctcatcactctcccactctggtctcaccagcgaaacctcagctccctttcgcaacccagtcatcccgaaatgagtcttgggcagcatggtccaacagaactctctaagctaatgaaaaaagtgcatttctctactgttcaacatggcagccaaatgtggctatggagtacttgacacacggctagtatgaccaaggaactgaatcttaaaggttgtttcatttaaatttcaatagccacatgacacgtggctagtgattactctcttggacagccaacacaggtgtattgggcatgttctcaactctccacgatccactgcatggcttggatagatggggaatttaaacacattaacgtagaacaagggtcagcaaactatgggtgcatgggctgactccagtcctccagcttattgtgtatggcccatgaactaataatttttacatttcaaacaacacacacacacaagtataagtgacagagactatgcatggtatgtaaaacctaaaatatttactctggccctttatagaaagtttgctgaccactgacatagagcctgaccatttgatcatgaggttgctggataaggttatcagagcctaaggccttctggtttaccatattttattgatcttggatagagaaacacagagaaacatttaaatctacatcaattaataataaggccttacattaacatactaatttttaattttaagcttttacttaactttcagtatgagtttgagccacttgcccttaaggagataaattggctgtcaatgattcattatgttgcattccaaagccaagtacacaattattttccagctattcttgctactgttttcatttgcatagtcagatattgatgtagttaaaatcctaattggtatgttggacaagtgcaactgggaaagtgatcaaaaggtgactttagttttatttcctaccaattcattacactatttagtaggcaatcttttccactgccagaggataaaaactcctgaggtccaatgaagtttttaacccttcttgggtaacaggagtcctaagatcactttcaagtgcaacatagtctgaaatctacaactaggaggactaaaatcatgacatgacattctagacatgatttagccttaaatctttctcctccaccagctggggccaggaaactggaatgggaagggtgtgtgtgtgtgtgtgtgtgtgcgtgtgtgtatgtgcatatgtgtgcacatatgtctgtgtgtgatatttgccttcttttctctgttctatttaccctgtaaccccttctatctcccacccctcctttctacaaaccagtccgaccctctgaagaggcagcctggggacaggaaggaaagagggaaaaggtcttacttgataagataatttagtaaacaggctccctgctctcttgcctttttggcatatgggtaaagacgtcagtgtgttcctggaatcttcagaagttccttgctgggtgcctctcactacaaaacccagctcactggccatgcaagatttttgttccagctggctggctgcttccagctcttccatctgtccctggttccctggcagtccactgcctgtagacttatggtgtggatgttcccacttttcgctcaggtggaaacagctccccttgcacaggactgtgaaaactgcaccccagttcctccatgaggcttatatctgacccatgggcaaccctcatgccatctcttgtgccaacgaactctaggagtgctggcagggccccacacagcagtgttcttcttttgctcccagggctttgcttggttccaagtagggccccagtctaccctacctccctcccaacttcagggaacatgagtcaaaactcttggggaaggcccaaagaaaccccttccttggatggtggtgaaggaggtagcatcttggggataacagcagtggccctcttcaaagaaatgtcttcatgaaatactctccctctccatactctgttctctatgtccttgatgtggctgaagaggccaaaagtcatgggtctaactcttccacattctcagatttataaaggaaaggattcttgggatctcgctttgggatttcacctctgttaggccttggtgtcaaggtaaaagctaaatttgaacacagtttcaagagcttggcatgaacaaggctgtcctctgtgtcactctgaacacattcagtctgtattgctggtgtgggtgatgtctcttgctcttacgcattggtctttggaaacctggaccatggtagggccaatattttgatctcttttaaaggtaaaacctattttacaaggaggtgcaagtcatgatataattcttgggagcctgaggttcagtcctagttctaccattaattagctcttgccctatccccattctctgagcctcagtggctccggctgtatcacaaaggggccgggttatagggtatctaaaggtcttttctctcacggtctccacagacacataatgtgaacggggcaggggacctggagagacacctgggaagtctaaatcctagcccccttgatgtggctggacagattggagaccagggtccccacctggagggtagaaagatgatgtctcctgggaagctgtgaatcaatggtcaacaatcacattgccccttccctctatgccctgccaggctcatcaacgagaatgaagtgaaacagtggcgagaccaggcagagaagttccggaaaggtgaggggctctgcttaagcctgctgtccactccacatgcccttcccctgcccagcccataactccatgcccttccaggcagggagtcacattactcacattctctccttctgtttcctctcccgtcccacccccattccagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcagtatgcaagcatctccccctttacatagttgagccaagaccctgggcttcaggactgggtgggcagagcaggtgtcggagaggccaaggaccccagcatgagggagaagggagatggagaccttgggccaggatagaagagacccttgaggctgtacaggtggcatctttgtgttagaaaaataatgtcccttcctctgggtgacactgtgccaggaagcacaccttggacagcagagtgcagctggaattggatccacttccctctctcagctggagatcttgtgcagtcagtaacctacacaactgcatagatcagtcctgctgttgcattgtgatggctatgactctgattgtccagtgtccgtgtgcgtgacgtgtgtgtgtctgtggtggtggtgtgtgtgtgtttgcgtgtgttagatgtttggatgcagagagagaaaatggggccaaatgtgtgtagaagataagggtaggatttggggcctagtatagaaagaaactagaaggagaggaatcatggtgggagacctgaatggcaacggtgctgatggctttgtccttgcaatttttctgtttcctcacagacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggtgagcatctgggaaggggctggagggcccattcttctacagcagggcagtcagcctcagggaccacccgccccttgtttacagatctccactctgggtcctttctttggtggggggtaagggcagtcatgtggatgtacaaagtgggtttgctgtgccaggcagctcacggtcagaacacctaccctgggagagatgcttgacattgggcaatgctgacgttgacaaagtcatctacaaatggaatttgtgtttgcccagggttaatggagtcacagccaagacaaacactgagtagaattcaaggacagggtccagttgaaggaaaggatggaaaaataagcaaagagcttgggccagcatctaggttttggtaaagatcaggacaatgtatacaaaggactaaagagtttgatggcaagacatagctattttggcatcttcctgggggaagctgcacacactggcctcatgtctggaccagcagtgagagatcctcatgagtattatccactaataatcaccaatcccagaaccacaggtagggcttgattcctctatgggactcccatgagcatagagtagagacgcccttggttgcattagacctctagcaatcgaaggccagttccagcctggaccaaggcctgcctctggttctgcacaatggcaagtcctattaggaggactaggagctttgtccttgaagtaaagacctgcatggtaactggtttcagttaggttggctcactgggatttgaagctgggatgaatggattccacactgacctttatcccatgggcctgttggactggctcttggggaactcataactgtaccatgtgtttgagcttcagtgagctcaaatgcagagtcaagtgggaagagatgcaagattgctaagtaggtggtcagctatctgccaggggtcttctcctaatggtagaccagctagcctgtcaatctgaagtctgcttttgtaaagctttgtgctgggggctatgatggatagtaataaaatgacattgtcctctcagagcttaggatctgccaaattaggaagcatgttcaaagaaacccctagagagcctgagatgagttaagggtgaggttctaaccaaaccaggtgtagctttagcggtacaacctctgtaaatcactcaacttgtctgtaagtcagtttgctcatgtgtgaaatgatctcaaaaattccctctgcctctggctttataatctaggtggaaagatgaagcataaacacagtccatttgtagtttcccgggcctctgataacatctccaatctgagttacttaagctttagagccacctgttagcagcattcaaagcaagattgttgaggttggtgacaggtgcactgcacagttgtgccctgtgggtgctctgtggccatgaggtgagccagaaagacaaactgcacatgagtaggccaaccgctctgcagaacgtgcagaaaggttcattgttcatggtcagaaaataacattttgtattgtggtaaaaagagaaataacattctgtctcctattgtcacaatttataatgtaagattttaaagatgtaataaaaagttatgcacatcaataatgaaggaagacagctaaagcaagcaatatttgtgcaacattttcatcatatgaagctgtgtgctcaggagtttctctgggtccagtaatagtaaggtctatacagattgcccaggggcccagagcaggccagagtttcatttctagactggagagtgtgggtttgttggaatagacagtgggggatatttggagaagtagagcaaggtgaacggtctttgaataacatttgagaacttatcaccccaatgccaagcttttaattgtgtgacgggcaggttatggaatcatttggacttcaggttccttatctgtaagtggggcaataataatgtccatctcaagagattgtagccgggtgcggtggctcacgcctgtaatcccagcacttggggaggccaaggcgggcagatcacaaggtcaggagtttgagaccagcctggccaacatggtgaaaccccatctttactaaaaatacaaaaattagcagggtgtggtggcgcacgcctgtaatcccagctactctggaggctgaggcaggagaattaaacctggggggcggaggttgtaatgaaccaagattgcaccgctacatgctgcactccaacctgggcaacagagcaagactccgtctcgaaaaaaaaagagattgctgtgaggattagttgatttcctacatacaaagtacttggaacagtgactgacacatagaaagtcttcatataataaatagattattattagtggccctaccatgtatgtttgaagtatgttatctcacttctcacgtcatctcggtgaggtaaaaaaaatcatggagactcagtttccttttatgtgacatgggagaaaaatctcatccctccatcttcccacagtcccacaggatggcagggctgggagcgtcagccagctaggcccgcctgaccccaaaggcagtgcaccacgggggaaacataatgaaacatgcttttgagaaagctttccctggcatgtgaaggatatctccagcgggcagaagtcccaggagtctagactagagatgatgggctcttggccagagtggtgggaaaattaaatttgaaaattatgcaaggtgggcacatcagggcgacgcggtgagtgtcaacatgtagggaatattaggaacagacttaccgctctctggctccagacctcagttatacctcctcgaagagcctcaagtccttctggcagatgctggaagctgggggtgggctgggcaatgtttgggaagaagtgagagagagagaaagagcccgagcttagtcagctgtctcatgggaaattcttcccgtgtgaagcagccagctctctcgctgcagcccgtttcttctcaccccagcctcaccaagaatagagaaggatgggaagctttacctctgcaggcttctctcttccctacctccacgttggtcctagctgcagagggaggcctccctgcagatcagactgtggctgcacactgcttcagccagcgccgtccctgccttccctgattccattcccttctcatctctctgcctcccacacccctttccagaagcccgacgcctctcctagtcccttcccctatcccacgtgtgcttctgtgagcgcacacacacacacacgcacacacacacacatacacacactcatacacagtggttgtttctgccatgaaaagaatgcatctgtgttggggttggccagctgcctgtatcccttgctgctccaagcttcccagccggcattccacaagagggtccctggccttcagaaggccacaggaatgtccccaccccctgactctggcctagcctcccctttccagagtttaagaaaataacagtgagtgaaaggtatgtttctctctccaagtctttctgaggggggttgtagggaggaagaggaggcattaaacaaggttccccagctgcgctctaggtagaggaaggcagagagattctatgctgaaggacagcaaagctctagatgaggtggggattcctgagaggggagggttggaacaccctgtcaggagcttggctggctgtgctctggaccatcagcagggtgctacgagactgccagggcttttttttttttttttggcttgactaacagccaggatccagaccctagtgcaagggtcctacacagagatggggcaaggcctaaatggagagaccttggaatgtaaaaccctggacatatcccagttgtaaaggatggtaacaccttccctggctctgaccaaagggaaattgtggcagagtcttgctggtctcagcagtgtcactacaggtgccaggtcccaaactttggtatttgtccactttctgagaatctgggaaagtgggaggaagacccttgggaaagaaaacaaccatctgagatacataaatacagtccgtgctgcagctttgaggatccaaaatatgtatggctttaatcttccaatgatggctgccaaggacaggggtgactccaggcaacctgccctttagggggagtgggcctgtgtgaagtaccctgagtgcagcttctgactttgcttttggaaaaagtgaagtggaccccctttcctactgcctacccatccccccagcaccccccatgatttctagaacatgtttacatgtggctccatgcacaagggaggaaaagggggttgtctctggcctctaccctggagcagagtattcaagagagttggaggttgaggggagcaaccgactaccttctgaaggtctgaaatcctggtcatcttagtatgtgcagttgggagataagtggggttagggaggcatggagcatcttcatgatggagttgggccaaccatgggatcttctccctaccctgaattttaggagcgtgtccctggcaccgtatggaatgagattgatgacatgcaggtatttcggatcctggacctagaggattttgaaaagatgttttcagcctaccagaggcaccaggtaagaccctataccctctggcctcttggaccatacccttgaatccaaacctcagcttctccttttctttctgcctgcctgccttcctttcctttcctttccttccttcccttcctccatcttccccttcccttccttctttccttccttcctcacatgtatactgaatgattttattctttatgaggtgatgattttattcttgctgaggatgtaggtatgaagtagaggtgcacagaccatagggggaaatatgcttgtattatggttcatatttatacaccaagtattgaaatggtgttttgtccatttctctcttccatcctggagcatcggaggtagagtcgcaaggcctgaccactgtggacccttgctgtctttggcccaggatttagggactaggcttagaaggcataataacttctcaaaccacttttccaccacattttgtctgtcaacacctctatgagaccgagcaggggatgttgccttgcaaggaaggcagaaggtgctgctccatgtcactcagggggctgaggctgaggctgaggctggggctgggcctgggcctgggcctgggaaggcccggggaagccttggatattgctctcaaggctctatgtgcaggtggctgccagcagtctggtcttccagtcacagagaaagtagggggtgagttggtggcagagcgcagggtgttcctgaggtgggaatctgaaactgtgccgagtatctgtggggactgccaaaagggttgcttctcagacctcatcctggaatgtgattcgggagatgagttggggcccaggaatccgcctggtaactagcagctaggggccttccctctaagtccatttggggaatgaccagcttagaagcctcagggaattgctttatctctggcccgccccagagggacttctccctcttggggctgggctaccatcttccttgttttctttacttagcctgggatctcagtcttgagggtttccctgggtgccaatgagtgggtcctggcaatggctggctgttgtggcctggctccccactgagctggagaggttgccctagctcactttctgcccagccctgatctgtggatgactgaggacacatgcagccgctcctagggctctggccagatgattgcttatttaatttaaatgtgggtgcccacagcatcggattctctactcctaattccaggaggcatttttaaccccatgcccatgtcaggctggcagctaaggctgctggagctgaaaggaactctttgagcactggctcctgggagccaattctccacgagtggggttgaggacagaggagtgtgtggcaagcataccaggcttggtgatcgcaggccacctcctcatttgagagtctttctgcaggacaggactctggcccagcctactcaggctccagggccctgaggtgaggctgggatggggccagtcaggaaagaaggttatggattttgtacaaactgggtctggggcctcccagcttggtgagttgagaagagttaagactgaaagaccccctgtcctgtccccctcacctctctgagcccacacagtccaatcacctgcctcccctcactcagtgggccgtctagtctctgggactgaaatcccagcagcaggactggagagatcccggaggccgtattaaccttgttgcctcttctctcagttggttgtggggcaggggaggtcctgggagtcatggtcttctctgtgccccatgcgagttttgagtcagtagcttccactccatcggcgtcagggagaacagaggtgcgtgctgtgcctcttcagttccccttgcacatcaaaggacagatgaggggcagtgagcaaattcaagggcacttgcttttctctgcctcagtaaacacaactttctggagcttccagatcgagttcatttgtgactcctcctctatttagaaaggtgaactcatcccaggatggaggaatgtcctccaccctctctgcaggttttcagcagaggaaaaggaagaacaggcagcaaagcctggggtgggagaactcaggggtttggtctgccctaactggggagtggtggtcgcactaggcagatgggaggagctgcctgatctccgcttcgtttggcttctccgtgagtgcatgtctgctagaagcagctcctgtctagtgccacttatgggtgcctgtctacaaccatgggtctcactgggatgaagtggacagtgtagatgctgagggatccctgtgtctgtcatgctatttctgggtccccaaatgtcttggctaatgttgtgcatgtttaattctctgttggctgtggctgctgcctaggagctgataactaatccttctcagcaggtgagttactctcggggctctgaccactccaacttttaactgctgtcccgggctgctgctctgtactgggcctgacagagaggacttgtccattccactttctaccttattccccattcatacagggtggtatgggagagggcccccaaagagaaagaagaaatgtagcagagggaggtaatcaaatagacccctggcagcagtggaggtcaatgtctcctggaatgaggagaaggcttctaggtctactgtcttacccaccaggccaaaggagagcctttcctgtaaggacacacagggtaggcacgacacaattcacaaagataaccatgcaaggcggcccctgaagttgtgcaagagggacctcccagaggaagaacagcacactagacagcctcctgtctacctcgccaggggcccaagagaaggagtggggcgggatcaatgatttctccagaatctgcctgctgggactcagaggagagagttctgcttcagtttccatacctctgaacttgtggatgctctctaccctgggcatcttgggctgtgcctgaagtccctaggagtcagcaactgttccctaggggggtttgcaaccaggttctcagcataagcctgaggagggcctctgggttgggcagtgggaatgggagttgattctgttggagtcatgggaggttatgtcacattgcccaaagccacagagatcagtcataccctgacccactggcacagccccttccctcattgcccagagtggataatttctaaaaaaaatctctaaaaaaataaaaaaaataggaaggggggcttctcggtgtccttccccaacccattggagcctatggaaaagtcccagataccgtctcttaaagttagctattatccaccctcctctctctcctgtctttttcttcccccttcccctcacaccaggagcattcctggattggtaggaggtggctcttgcggggcgggtaagaggaggattagggaacccacacctcaactgtccacttgacttgttggttgcagaaagagctgggctccactgaagacatctacctggcttcccgcaaggtcaaagagctgtcggtcattgatggccggagggcccaaaactgcatcatccttctttccaagtatgtgcaaaagaaggtggttgagttggatgcctgggggacaaagggggtggaggaacggagtggtggcagtctcgggcctctccctctctgctgtcccctgggaggggcaggcattgatctggaactgtctctcgggaacctgccttgagcagcagtttggggctctgcaggcaggaaactgcccagtcacgaggcccttgcccagcctggtcagcgtctggcagctgagttgctctaagcccacggagggcctcgcttggctcaggccatggagcagcatgatctcagcccctaagcatttcccgcggctgcagaacaaacagggcagtatctgcgctaacagcacagcttctgtacgggggggcctcctgcctgagcagggtcagagggcaccacctcccatactattcttagtgctgccccagccgcctctgagacatcctcctccctttcttctcacaagcccccaggcctcagtttcccccacttgatggtggaaagagttctgaatccccagggttcctaatgggggtgcatgtggaggggatagggaagggctatgggggtgtgtggcttctccctctcccagacagcaagactgattgggacagctgtgtgggagctgaggcgctgtcagaagactgagagcgattctgtgttctgagaatgaaggcagcaggaaattgccctcttagtggcttgccgataatcctgtcctcccgtggagatgctgtgcattttttaagcatgaggaggaggagaaggatcaggaaccctttgccctgtccctttggtctacattgaagacatctcttttactcccaaatgcccctatcagctctgatggattatcaagagaacagagaccctcacgtctctattttgacactaaaatgctcattatcaagtttgtggactgaatcatactagtctaatctaagaaggctttgtagaggaggtgaggggggaatactattaaatatattcccaagtcctgttagggaatgagggaaggcggaggtggtaccttttggagaagaaggtttgagggctgtcctggattgaggtggggttttgccttaggttgaagctttctaacgaggagatccggcaggccatcttgaagatggatgagcaggaggaccttgctaaggacatgctggagcaggtgaggaccctcgtgggaaggaaggggaactgaacccagcgggcagccacgccccttcccaacagcccccaggaggctgcgattcttgggtcaaggagaaatcaggctggaagagttagggagaaggtttatagaagcctccctgggccagcctttcttggggaaagctggaaaaggctaagtgttctccaggagtcattctcccatctgactccaaggcaaagtcagatgaggaaaagtgacatcttccccaaatctcttccctctcagttttttggatcctttgggaaacctagaaaacacacaaagaaacatcatcaattggacttcattacagttaagaacttctgttcatcaagggcatggttactgagtgaaaagaagacaaaccttagaagaagatatttgctatacatacatataacaaagatcatattcagaacaaagaactctacaaatcaatgagaaaatgatgaaatcaacttaaaaatgagcagaagacttgaaggggtgcttcatgaaagaggatttccaaatagacaataagaatatgaaaaggtgttcaatatgattagttatcagagaaatacagtcaaccacaataagggggcaccacacacccactagagtagctaaaattaaaaagactgacaatgccatgtgctgacgaggatgtgaagcaattggaattctcatttggcacaattattttggaaaactacttggaagtacactctacagctaaacatatacccgccctattgcctagtaatcccactcttaggtataactccagggaaatgagtacaaatactgactaaaataaatacacaagaataaagttgacccttaataatgtgggggctggaggcattgaccctccatgcagtcaaaaatccacatataacttttgacttcccaacaacttagccgctaattgcctactgttgaccagaagccttactgataagataaacaaccaattaacacatatttttatgttacatgtattatatgctgtatttttataacacagtaagctaaagaaaagaaaacgttattaagaaaattattagaaggaagtccgggcacagtggctcatgcctgtaatcccagcactttgggaggctgaggtggacaaattacttgaggtcaggagttcaagcccagcctggccagtatggtgagaccccatctttactaaaaatacaaaaattagccaggtgtgatggtgcatgcctgtagtcccagctacttgggaggctgaggcaggagaatcacttgaacccaggaggcggaggttgcagtgaggtgagatggtgccattgcactccagcctgggcaacagagtgagactccatcaaaaaaaaagaaaaaaaatcattaaaagacactgttcattgagtggaggtggatcatcataaaggtcttcatcctcattgtcttcacgctgaggaggaggaagaggaatggttggtcttgctgtctcagggatggcagaggcagaagaaaatccacatacaagtggtcctgcacagttcaaccctgtgttactcaggggccaactctatttatagcaactttatttataaattccccgaactgtgaacaacccaactgtccatcaataggaaagtgaataagtagactgtggtatattcatacagtagaatcctactcagcaataaataaactaccatgacatggatgaaccttagacattatgctggggagaagtcagacataaaagagagcatacagcatgagttcaaggacaggcaaatctggctaaggtcctagaattcagttgagagcctatattcacttgaatggcttactgaagtgatgaaaaataactttcctgggggatggaaatgttctctatcttaatctgaatgatgattcaatggatggagatttgacaaaaatcactgaactgcacatttaaaatgggtgcattttattttatgtagactatacctcaagtttgtttaaaagaaaagaaaaatcactgagctgtacattgaagaatagtgtactttaggctagacgtggtggctcccacctataatctcagcacttttggaggctgaagtgagaggactgcttgagctcgggaggtaaagaccagccagggctacgtagtgaggtccagtcttacaaaataaaaaaataaaaaaaattaacccagtatgtgctacatgcctatattcccagctactcaggacctgaggtgggagtattgcttcagcccaggaggtcacggctgcagtgagctatgatcataccactgcattctagcctgattgacagagtgagaccctattaaaaaaaaaaaaaaagaaagaaatactgtatatcagttacatctcaattttaaaaaagaaaaaagaatttcagagctgtgtgccctgtcatccccttcaggcagatgaaagaaatctgtccacatgagggtgcctccctctttcaaggcaccctccccatcttgacccaagtcagtacagcttctcacaccctgtaccccatgtctgctgctcaccagttgcttgtgtgacttgcgcctgctctttgcagctcctcaagttcatcccagagaagagtgacattgacctcctggaggagcacaagcatgaaattgagcggatggcccgtgctgaccgcttcctctatgaaatgagcaggttgggccatgggcatggtggggattcaagcaggtggggttctggcaggtggggcaggtggggctctgccaagaggaaggggatggaggtgggcaggcttgagaggagactggagctggctccgggagctggggctggccaggataggggtgggatacctcaagatatggttcaccttgtctacaggattgaccactaccagcagcgactgcaagccctcttcttcaagaagaaattccaggagcggctggctgaggcaaagcccaaagtggaaggtagggctgagggttgcaggaggcttagagtggagagttatctgagaaaggcagggtgggtgggagccagtgaataggggcagagggaaacccctttcttattctcaacccaaaaacaaaaacaaaaagtcaaagacaaaatctaaaatgatgattattataaaaatatgcacttgcttatattagcacatgcgccaaccttgtgacatgttccttatgcctcagcatgcaagctctccaaggtggggcgtctgttgacatctgccccagcatgggatggaaaggtagaaaagataataatagccacacctacaacagtgcctggctgggactgagctcatcagtctttactctacttaagaggtactaggctcatagaagacttctgggcacgttagtttaagtgtgagccattcagaaagtaggaaattgcacaagctgatttctaaaggcatctgattttctgagtcaggaacacttccaatacaggccatttccagatgagaaatttgtagttcaatgagaaccatgcgccaagcactgtgtgaagcactctgcttggttggtcctcatttggtcatcacagcaatcgcacgggtgggtgctattattaatttccatgtggctccattctctcctttctaaagtagggctgtgttaatgtcccgaggctgtgacactggtgagtggtggaaccagggtaggaatgcagatgctgatcttcaaaatcagtcccttccctcttgtcccctagtactccccaggggctgcctgtgctgatggcacagcagggaggggcgtggagttgttgggagaggcaggaggtcaggacggtgggcagagacatgtggacccaggaggcaataagcaggagaggctgggaggctcatttgtggggaggacagggtcagcagagtggagcaagaaagcctgtttccaggatgttgaggttaccaggctgggggcagaacagagcatgggcaccccctgctggacaccagggccagtcagtactccctgagatgcccagtccagagagcaacccttcctgaaatccattgagatgcttcagggatagtctatggatagggtggagcatgcagagctaaggcagacattttctgtaatcagatcttgttccccctcacactacacacacacacagcaagggacctgcaggtggtaagcatagataatcaatcaagagggaaagagagcagcagtgactctctatttctaaggtctggccatatctcctgccctggtgatgggtgaatccttatcttcttcacaactttctttcatcctgctgcagactgcctttggagcatgcagcacaagtaaggggttcagcccaagacatgtgtgcacaactatttgtatgtcttgggtcagtggaacaaatgtgagcaattgccatttggagatttggaaccagagtagcttagccatcagaaaggtttaatctcagacagtttcctgctcccaggagcctaagaattagtcagtggaggctgggtgcggtggctgatgcctataatcccagcactttgggaggccaaggcgggcggatcacaaggtcaggagattgagaccactctggctaacacggtgaaacctcgtgtctactaaaaaatacaaaaaaattagccgggcatggaggtgggcacctgtagtcccagctattcaggaggctgaggcaggagaatggcatgaacccaggaggcggagctggcagtgagccgacatggaaccactgcactccagcctgggcaacagagcatgactccatctcaaaaaagaaaaaaaaaaagaattagtcagtggatattcaggaaagagtctccatttgatatcaagctaagccgagtaagatgtgtttgggatagcaagatctgctggggaaagctactcttctatagctctgctctataataattgctctgtatagcaatggctgctgtccttgtatagaccagacataagtctctttcctctaagagctagataggaaagatatgcctaaagttgtgtattatagaatcagatcagtgtgtgtgactataagtggagaaaagaggattgtgcaaagatgggattcttattcttccttccagttctcccaggaagtattcctggaagagctaagatttagcctatcccagctaggtgtgatgagctgttgacacctgccctcctatccccagcaggggctctgagtccatttgccaaaagctagttcaccaaatttgacaaatttaccagttcttctatgaatatattcatgaacttacaattcttgaatatattcttcttatgaatatattgctgaatataccacatttaccgattcttattataaatacattcaccgaatatagtcaagatgaatatggttgcaaatgtaatattcttatgaatatattcatgaatatattattcttgtgaatatatctaaaatgtcagaactgcatctgggcgttttcccatttacactgatttcctttgaactcttgtcattttctgttttgccaacattttagcatttttaggaggattcctttgcagattttccaaatagcatataaaccttagaaaaaacatcccaaccaatataaattgccagaaactttcccaagtattctttttaaataaactatttttgaaacataacatgcatatagaaaagtacacaaatcataagagtcctacttgaagaattaaaaaagggaaccacatgtgtaatcaacacccaggtcaagaaatacagcttccaaccccccagagccttcttcatgtccccctcccaaactttacccccctccctcctctctaaaggtcaaacccatcttgactgctagtttagttttatcggttttgaactttattttttaaatttttacctattttctttttgagacagggtcctgccctgtcacccaggctggagtgcagtggtgtgatcttggctcactgcaacctctgcctcctgggctcaaggtatcctcccatctcagcctcccaagtagctggcactacaggcacatgccaccagcctggctaatttttgtatttttgtagagacagggtttcaccatgttgcctaggctggtctcaaactcctgggcccaagtgatctgcccaccttggcctcccaaagtgctgggattgtaggcatgagctaccatgcctggcctgttttgaactttatatgaaaggaatgatagagtatgaataattttaggctggtgacttttgctcaacattatggttgtgggttgtccctgctgttacatgtagcagtggggtattcattttcagttctgcattttattccattatatgaatacaccataatttacccattctatttggaatttaaaaaacctagaaacaacccaaatacccaccaagaataatgtggcttttaggttatagagtatgtacatgttcaacttaaaagctactgacaaaccttactattcatttttacaactttatttacttatttatttatttatttatttatttgagacggagcctcactctgtcgcccaggctggagtgcagtggtgtgatctcggctcactgcaacctctgtctcctgggttcaagcaattctcctgtctcagcttcccaagtaactgggattacaggtgtgcaccaccacgcctggctaatttttgtatttttagtagagatggggtttcaccgtgtcacccaggttgttctcgaatgcctgacctcaggtgatctgcctgcctcagcctcccaaagtgctggtatagcttctttttaacagttacttatttctaactgtgttcgaagctttctacaaacttttagcaaagtcgttttcattttatcttcctagcagcatcttaaagaatgttcagtttggcataagccacagatcacaggataatctggtctttttgttgccacactgaatattcaaaaatcatattccgtaactagtagacaaaatctcagtttaggatttgtgtcccccttctgcacacccaccataaagacatcatagctgaggaagggccagagcatacacagcagaatgaattattgaagttttggttactgttagcttagtttgtatttctggcaaagataacatttagagcattgggggaaaatggttaagatgcccaaaggttggaaaaatcttaaaaatgacattcaacaggatgtcaagtagcttatttcatcaaatcttagacactatcaactgaaaagcatgccattattttatagaacaaaaataatagaatattataatttagaatatgttatttaattgattttttttctttccaaaaaaccaatagaatatagcatttcaagacaggcagaagcaatcccataataggtaaaatgctgaagttaagtgctaggtttagaaaagtaaaagtgtcatattcatgagtatattcatggaaagaatatctgaataatctttttttcttttttcttttttctttttgatacagagtctcatgctcttgcccaggctggagtgcagtgaggcaatcttggctcactgcagcctcagcctcctgggttcaagggactcttttgctttggcttcccaagcatctgggattataggcatgcaccaccacacctgactaattttttgtatttttagtagagacagggtttcaccacgttggccaggctggtctcgaactcctgactcaagtgatctccctgcctcggcctcccaaagtgctgggattacaggtgtgagccaccgcaaccggccttcttaataatctttaaatacatgtaagaaaagatcttctgaaattgtcttcttgggaagagctggcacgtcctacaaatggggtatctggtgaattggccttggtgaatgtgtctgcttcccctggaggtgggtgaatgtgaaatcgatgggtctgctgaggagtaggtataatctctgcctcactgagagttgaaggcatttgacagccccttttctgaactttgcggtggcatcttcctggggtgcaatgagaactgctgccctgcctagcccatgcaggcctctgacctgtgcctcctctcccagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacaggtgaggacctcccttcccggccacttccttggcctctatctcaccctaccctggcctctcacatcctccctctattaggacgggaacatcctaagactcatcacccctttctcttaacactccatcctctgaccctctgaccctcgtgcccagtttcctctgtcacttaccactgacctgactttcatccacagaaacatctctctgctccattacctgatcatgatcctggagaagcattttcctgatattctaaacatgccttcagagctgcaacatcttccagaagctgccaaagtcaagtgagggttctctccaagacttccttctccccatgatgaccctcattcttgtcttactttcctcttttggggtctactctgggcttgatgatggctggtgtgagacctcggttcttgtcttctgagttcaaaagaatttaaacagacacacagcaaagggggtttagcatagaacaatgtattgcaaaagaagatatcttgtgagttaggtgcagaatagacagtacaccctgagagagagaggattcagggtgggctgcttgtaaggatgagacagccaagactggcaccaggaagactcccagtatgggagacttacacgattattcataaagaggtgggaagaggtattgggaagcaggctctgagtggtcctctgggtgcacatgtgtagtagctgtgtgtgctttttcatacatcgcatgtctcattagcaccttaaatctccacctaggggtgtgtttttttactattatatgagcaaagggccagtctgaggataggtaaaatcaaaatgcgcatgctttccagaggggaaagtccctactgcagatagctttgcttgaatgagctcaattacaatgcgaatgctgaggtttattgtgttgactgtatgggcaccaccacagctgctgtgttctgagaagtgctcacttccttgactacctatcctgcctcaggctgagtaggaatgggccatgtctcagggtctgcttctgggaaaaaccaaacaaagacaatttgctcttaaatccttatttcagagatgcttccagaaaataccagtagaagaatggggaagtgagccagagatagaaagaatgccagtaacaaacattattaagccagttaccaatcacaggcaattggtgcttaaccccatgaggaattctgggaaacagtgtggaatagttacttcagttttcccacccaaagggcaaggttgctggggcaatcagagagcatctcctctcagtaattggctgaggggctctgcaggggcagggaataactctctggccacaggtacaggtggaaagagcttggcctcaaaaagagtgtgcgtacagttggaagagttggggccatgccctacaatggatggtccaaggaaatgtgggtggggcaccaacagcatctgctaggcaagatatcagacacgaacatctaggctgatagatgtcatctccaggaaaactagaaacatagtggtaaatggctcactggtatcgaatgctattgcttgcaggatcacataaagagcttataagcattacctggtagtaataaaaataaataggtctaagccagaggccacaggttggaaatcttctgatattgcagcatgacatttctgacctggaaagatctatagaatgcaggcttcaccttgttaatttattgatgcacagacagaggcatgaaggggaggtgctttgtcagggccaacatcaatggccacaccagggctggaacccaggctcaccgactcccaggccactgtgcttggctctgccctctccctgaaccagccttagcacctcaaggcgggagttgatggtcctcattcccttccctctgtgtctccttacagcctagcagaactggagaaggaggtgggcaacctcaggaggggcctgagagcggtggaggtggtgagtaccttgtcagtgcctacctgggtgagggctgctgtcagcaaacactgttcgtcactgcaccctaagctcctacacaggggcaaaaaacaatgggtacagcctctagcacagggtcagccctcccaaaggataactggattactggggcttaagtttgagccttttaaaaggggttacctaagactatacccatgttactgtccaacttggtatctatttggcagtggagtggaatgaaccatacatctgacccatgcctacattggattcaagtgcatgggaaaaagaatcctcatcccttgactgccagctaggggcaggaagcacgcaatgtggcagtgggaccgatgtacccagaaggttcttccttatgtctctctgcctgtttcctgggccagtggaggacccaggtcttttgttcccaccattcccgttctgatggcttctcggctgatactatctctggccctagccttccagaaaacaccagtagaggagtggggaagtgagccagactggcccagtatggggatgtctctaagtcttgtcccccacacctaggaagaagggacccgttccgtcttcactgaggagagaggcagtgggtaagggaagaatggactttagagacagattaaggatgacaaagaacgttttgttgccactacggtgggggaagatgatttccaaatttacaattttatagtcctgttaagtgctactcaaagtgcggtacatggaccagcagcttctgaatcagctgggagctttagaaaaatgtctctttaatttgtgcatgagtcacctggagtcttgtaaagatgagtcttgttaaaatgcagcttctgatcctgtgggtctgagagtctgtatttctcataatttcctaggtgatgctgctggccccaggtcacatgttgggtctcagtgctctagagaaagaaagatggcagggtgggctggctgctaatgttagctcatagtctttgccatccttagaactttgagatgcagggtgttccctcttccaaagggctcaatgtcctgtgagtgacgaggggagatgtggtgacccctgcacccgactctcatcttggcaccagtctaagcagcacttcaccctccctcctcaggagctggagtatcagaggcgccaggtacgggagcccagtgacaagtttgtccctgtcatgagcgacttcatcacggtgtccagcttcagcttctccgagctggaggaccagctaaatgaggccagggacaaggtaagggtgccccaacccccactgcttgccaacccagccttatctaaacaagctccttcacccattcctaccacagacagcccaggagggacaaacccagagttacagagctttgagagaaaaccgtttcttcgctcttaacaagacaagcaatgataaccacataccgcaaagatcatggtccatttatcagatatcaggcaccatgttaagtgttttaatgatttgtcaccacctaccttatgggtttgttgaaaggttatttcccacttgacagatatgaacgctaaaatcagagatgctaagtaacttgcccaagattgcccagctgtaagttatagaactgggttagaatctgacaccacagctcagcagtggacatgattaccatgcctctatctgcttctcacactaacgtgtccatagacctcatgtatgggggtcttattaaaacatggattctcatttaggaggcctggggtctgagattctgcatttctaacaggaggtgaatctgctgctagtccatgaagcacacttttgagtagtgagatctttcttagaggatactgagtgagttgaattaacaatggtagctctcagtaactcagaacagtgcctggcctatataaatatagccactgttttatagccaccaactcatctaaccccccaacaccactatgatgtagattctattattcccatttgacagtggaggaagctgaggcacagaggggttattaacataactagaggatctttgaagttctgagttctgccagcctcttcctgacctcaggaagggcttcccaaggtctatacccctgacctcatgcctaccccttacaggcccaggggtggctctaaggtggactgagtgagcccaactctttacctgcctctccttagccttgtctctgatcctgatgatgatgggggtgtcttctcacctcttccagccctgccccctgtgccaacagtccccagccttgcgctgggctctgctctggctagaacccagctaacctcaggggctgagcccagcatgctccagggcactctccaccaatcctgttctgtcccttgacagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatggtgaggggcagtgccaggcctgggactgaggggagacgggtgctacttggggagaacacccccaaactggggtgtgtgggaggagggcagagactgaggaactgaggaacaccataggggttggatgtcagccccaggagagagaaacttcttcccagcctgagggaagagagtggtgtgaagctgggggcctgtatgtcctaggcaggaagaaagtggggccaacagatacaggcaggcagcatgaccatggcctaggagttagcccagggttggggggctgccctggcctcagcgcctctccctgagagggttcctatctttggccccccgcccgcagctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctacttcatataaattgctcaggccctcccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccccgacttctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctacccagtc

SEQ ID NO: 37794 - DNA, 46006 bp, Homo sapiens
agggcctgcggagaccgtccgcctggctcgcccgagctcgcccgctgtccgccagcccgcgggagggaggagagaagcgaagcgtttccgcggttggctactcagtgtcttggtctcaagttgcctcattgcggctggcgttcccaatacagacgcatcgtttcttttttaatactccctaagaaagggaataaccttcaagctggcgggagcaatggttcacataaagaaaggcgagctgacccaggaggagaaggagctactggaagtcatcgggaaaggtacgggtgctgggctgcgacgcggccgcggccagcctggccggggggcgtggcggagcccggggggcgctcctggcctgggtgacctttggctgcggttctgcaaggtttgcagcctggaaccgggaaagagcgtttctccctttggtctgggaaaggttgcaggggcggagaggtggggaggcagaagcagtgctgggacaagaggggtagttacagaggctcggcctctaaatccgcttttggaaacgtacggatttccacgccccgccttaggttaatgcgagcttcccggggtgtggaccccagtgtgtgaattcttcactgctcccgagggattttgaccgcggtcagtcctggtagtttcaggttcttaggcgggtgtctaaatgaccctttagacttccgcaggccgaatgatctggatcctttgccgatccccgcccccgcttgggagtggagggcgcccttagggagaggggttcttcataagggtacagaactaggtctgtaatttgctgcattgagacttccgtatccagggcctccctggcttccagaagccccgacagcctcaggaaccctagagagacaaggaaattggcgaggcctccacacccacccctcggcccacgttgcacagatgagaccttctaatcgcgctccttcgcgctttcttgtccactcccccaaggcgtgccccacttccgcagtgctgagtcccagcggggagccccgaggacgagccagaagccatatttccccggagtccccgagtggacgtcccagaggagttccctgccgagtcccgttacctggcaggtgacatcagcgtgactgcatgcttcttctgcaccctcacggtgcagggatggtgatgcgtgcgactccgggcaattaatgtggtgattttaaactcaataataatatagccatgtttgtcctcgaatggcagagatgccagtcattgcagcataaggcttcccagtttccagttttatttacttagtagccaggctgaaatgtggaatcctagagaataaggcagatttattcttcatagcgacaaggaaactccacatgcgaaggagaaaaaattccggtttgaactcaacaggtgctgatgagctgagcccacccgatctgatctcaactattctaagtcagtcacagctatatctatcaatgatgtgttctttgcctggaatttggggatttgggttagagtttagattgttgtactgcatggttcttgctgacctatttggcatttcagtctttcagttcttcctgtctctaggtaatttctccctgcctttgatggctctgggattcaattaagcaaacatgcaagttctagctgtgtgccaggtactgtgctgggcaaaaaggagacaaaggatcaattcacaatccaccagggacaaaaattcttttaggcaggacagagctagtacatgtcctctctctctctcgctctcgctgtctctttctctctctctctcgtttgtttgagacaggatctcactcttcacccaggctggagttgcagctctctgcagcctccacctccctagtggctgggactacaggtgcgagccaccatgcccggctactttagaaagattttttttttttttttgtagagatggggtggtgggggtctccctatgttgcccaggctgctctcgaactcctgggctcaagtgatcctcctgcctcggcctccctaagtgctgggattacaggcatgagccactgggcctggcccatcatgtgatctcttaaaagtgaaaaatagtgagcagttttataaattgagtctttgagaggggagaagggattccttggatacattctcaggtgtccatcagtatttattttgaagattatataaacctgaattaatgtgcatttattctggttagtgctgtgatatttctgggctcacacggtgcatcaagttgcatgagtgcactgatgctttcatcgctttcattggaccatgccaatgagaaaagaactgatgtggacctagtatgtgatgcattcttgtcaaatgaaggtctgtgggacatcacttgcactcataaagaaaagtaatgggagatatgagaaaaacaaccatagccaacgtttattgactgttattgcaagccacacataattttaagtactttacatatattaatgcatttaatttggatgagctaggaattaattttaagctatgacagtatgagagacagcatgggatagtggttaaccatgcaggtctggtttgaaattctaactcatttactggtgatgtggcctttgggcaagtgacttttcctgagcctcaagtcctctgtgtgaaaaataggaataataataatacccacctcacaacgttgttatggggatgaaagtagttagtatagttaaagcattcgaaatactgcttgtgtttgtgataaatatagtaatcttcactttataggcaaggcaactgaggaactgggaagttaggaaacttagtgtcaaacaggtaagtggcagaaagtggcagagcagaggtatcacagggcccataggtaataaacaggctgtacctaaaaacaaactaaacaaaacatgaaacagtaccatagcagtccatacaatattcactttgagaggtcatttagttctagcaaaacaacatctgtcaagttaactcagttttaaatgttactgattttgtagttctgtgtgcattaaatttaaagtaaatttttattttatagttgaagaaaggccataagcaaagtttatatttgtgccaaaaagaggcattttttttaaagtgggtgaagtgagtttttttttttttctttcatacgtttttcaactttgaaaaactctagatgagacaataagttctagtactttgaactaacaacttttcagcaaagtctagcctggcatcttggtcaatctgaaataaactcggcaaatatttaagtgattcccatctgccagccactgctctccagaaagacagactctaagtggggctttttatttattagaatgccaagaagttccagatgaaaatgaaaatctgtttccaacatacccatttaaatcatagttaatgacagcattcatttaacagtatgtaagaggaaattgaaatcactgaactgtgtttaactggcttatatgacttgtagagttacccattcttctaagctttgatacctttttcattaatctcagagcaagcactattatgaaataaattaaaccttttttaaggctatgagctagataattttcacattacttctcttatttagtacctgaaattcctgggcttactgttgctaacaagaaagtattatacttcctttttttttttcatatctgtgtaaaggagctatgaaacaagtttggataataaggctttttcttaccaactattgagatacaataaattgcacatattacaggtagtacacactttttaatcagttttgatttaaacatacatctgtgaaaccatcagtaagatcaacataatgaacatcttcatcaccccctaaaaagtccttatgcctctttgtgatctgtcactaacttcacccccatctgcaggcaaccactaacagatctctgcctctgttgattagatttctctattctagaattttatattagtagaatcatacaataagtatcctttttttgagggggggctggcttctttcattcaacattatgattttggggttcatatttattatgtgtaccaatagtatgtagcttattttcttcttttatttccagtggaaggatatactactatttgtgcatccattcccattgatgcccaattgttgtttccaatttgggactattgaaataagatcctgttctaaggtcctgtgtcgttaataatacttctggtgtctttatggttgagaaacattcaagtctgcttataaccaattatagtacagagttcaaagaaaaaattaaaatatatggttaccattagttggatggctggacaggttatgcaacctatatgggcttcattgtcttcattttcacagcaacagctcttttagatactcccaattttatacagtgctctgtaatactaatttaagatcatttttttacaaagtctaaaaatagatatgagtaggagaccttttagaaacatcgcacaaattcacgatttcaaaatgcatgttataattagaagtctccactatgtgtgtgtgtgtgtgtgtctgtgtgtgagacagggtctcaccctgtcacccaggctggaatgcaatggtgcgctctcggctcactgcaacctctgcctcccaagttcaagcaattctcctgcctcagcctactgagtagctgggattacaggcgtgcaccaccgcgcccggctaatttttgtctttttagtagagatggggtttcacttttaaaatatatttatagctttatatctatgattatatcaaaatctatatccatatgttcttgttttaaaattaaggcactttaaacatttttacatgattttacttatacgtaaacactataacaactaacaaagccaaatagatttctaaatccttaacttgattatatattccttaaaatatccgttttcgtggcttccaataaataatgattgcaatccagctggacatagtggctcatgcctgtagagtgacccctctgcactttgggaggatccaagaggatcacttggacccaggagtttgccaccagcctgggtctcaatatagtgagaccccgttgttacaaaaaatgtaaaaattagctgggtgcggtggcgtgcacctgtagtcctagcacctcaagagtctgaggcaggaggattgcttgaacccaggaattcaaggctgcagtgagccatgatcatgccactgcactccagcttgggcgatggaggaaggccctgtatctataaaaaattaaaacaataataatgaataacgattgaaatctatacgtgtttgaatctcatggttgtgtgatgaattgctgaaaacagaatgtttgtttctcctgttctgtttgttttggctgcatcttcttgtctttggtagagacccgtgttcccgatctagatattagaaatgttacaatgaattatattgtgctgctctgaatacaaaataaaaagaagatctaataaaggcttatatgtgctccacattaggacactcctcagataactgtgggatggatattgttatccttatttcatagataaggaaactgagagttttacaggtctttttatttacttttatttatttatttacttatttttttgagacagagtctcgctcttgtcgcccaagctggagtgcagtggcgcgatcttgactcactgcaacctcctcctcctgggttcaagcaattctcctgtctcaacctcctgagtagctaggactacgagcacgcaccactacacctggctaatttttgtatttttttttttagtagagatggggtttcaccatgttggccaggctggtctcaaactcctgacctcaggtgatccatccgccttggcctcccaaagtgctgtgattacaggtgtgagccaccatgcctggccaagttttgcaggtcttgttccactttatagtattcctgaaaaagctataatgtagtagaagagagagcagtaacactaagaatatcattctcttttgagacagggtctcactttattgcctaggctggattacagtggcatgatcatagctcactgcagcctcaacttcctgggctcaagcaatcctcccacctcagcctcctgagtagctgggactacaggtccatgccaccacaccttgctaattttttagaaaattttttgtagagatggggtctcactatgttgtccatgctgggaaaatattatgtacataatcttttctctcctaaaatgcttgttcatccagataaagtgatcaattccaccctaatgaggcaggttatgctgtattttcttctttggtttgagcagttggaggaattctctaaagggaaataaatcactaattattactttaattagtttaggtctgttgtttcttatctccaatgaaggtaaatgttggctccttgcacatcccttcttatagtactctatcttccacccccagcagtttgttaaatcagatttaacatatttatttcccagaataaagcaattaatcttttacacttacttgtaaaatattatttaagtctactatggacagtaggaatgacataaagtaaaaatccttctgtgtgagccatgtgtttcacatttccatgctattctggaccttctataatttccgactaatgtcattacattgtgaacaccgaattggaaatcatcacagtttttcctcttggagtgttttgctcatccatgttccaaatctatttttaccctctagaagcccaatctgtttcagattatttttctcattccagcccctgcatttcaaaaggctaaccttagtgtgattgtgggtacgtgtacatgtaggatataataagaaatatctatttggtctctgccactggctcctaacacagagctcctaaaacccttataatctcctgaacaatggggtgctaggtgcatctattgttctaatatttggtctttgaccctggtacctgacacagagtttctaatcccttggaatttcctgggcgttagaaatgtcttttgttctaatgaggcgactgttggatagcttcaggatgggggctggtcatgagaaagtccaagccatgattagaaggttgaatttttcaactccacccctccccgcatcttcaggaaagggagaggagctgaagactgacttaataataggtcacacctatgtaatcaagcttgcataaatattactgaactacaggttgcagagagcttccagattgctgaactcgtggaagttcttggaagaatgagtgcctggaaagagcatggaatctctgtgccaagtgccacataccttgctctttgcccctcttccatctggctgttcatctttgtcctttgtaatattatttgtaattgatgggtaaatgtaagtagtgtttccctgagttctgtgagctgtcctagcaaattatggaacctgaggaggggatcatgggaaccctgatttatagccagtcagaagtacaggggcttatgattggcatctgaagtggggacggtcttgtggactgagcccttgacctgtaagatctgactaactttagataaacaatgttagaaatgagttaaattataggataccccattggtgtccaatggagaattgcttggtgtttatgggggaaaccccatatatctggtgtcagaagtgaaggattgagactattgagtgagagttaagcaggagagaacagtttgttttccattatacatgcatcatctttaaaatatattgttcccttacagaatatgttaacttagattgttggctatttggcaaacaccttagagaattatcagcctgttctctaatgagagccaaatgtttatgatcttaatccccattctactcttcccatgtagcaggttttgacatgcttacaatcactatagtattctccctttcttgcaaaaacatctcttgggcagatagaaaaagaaaataactttggttctcagtagagaatgggatttggatgaagcatcttcctcaagagaaactggggtgcggggtttttgttctggttttattcttctataaagatttttgagaaagtctctgatgagaagacacagatacgaataaggtttcatgtagaactggctcgcatgctcacacacacaagagctttgcccttgcatagcgattcagccagtgatactaactgctttcagatggaatacagggtcagaaaaatgcattatttataaaaaaaatagctgctatcatactccagggacgtgtagatcattcacttgacattttcccaacagagctacttctctatctaggagatgtttctgttttttctctgttggtgaggggaactcaggtgacttgcttaagaagtgggtcagagagaaaaaagcatgctaatctttattttgcatttcacctttaactctagaaggctagcagagtttagcacagtcttgcactacaagtctaaatttaaagagaggaaataacctgattgggagacttacctattcttttatgttcttttataggagaggcttatcttagcctttctccctcagcacattcaatttcattcttctcttcccagtaaaaccagaaatttcttggcaaaatgtgtggctggcttgtactaatgataatagcaacattctctcctgcaagtatgcttctgtcattatgccttatagaagactggaaaaacctgacaactttggcccaattatagcttctttccaaatttacagaggagtgaccttaaggtttacattagttgactttcagggtggtgagtactgatcatagagcactgtaatgtagtactaggcattgaagatgtgtttcacctaagtatttccaaaccaagcactctattataaatatgtcatcaattcacaagatgtggtgctgacaaattatataaatactgactgcattttgaattccaagtattacattgactggaatttaagcttcagatggtgatttggattagataccctttaagattttttttcagtattaagtcttatgctttgtggttattgtattaccgccaaaaggaaaatgtggccaatgtaatatactttaaggtcagtgaaaataaaaacaagatggagctatttttagtttctgtaaatctattctactggacaattactttgtaaaataaatagtatgtgattggatgtttcatttcttagcaacctacactgactagatgtactcttacagataactccttaaggtttatttccttgatgttagatttttctcttattctagtgacgaataaccttacttttcatcttttttttttttttaggtactgtccaagaagctggaacattattatccagcaagaatgttcgtgtcaactgtttggacgaggtaagattttagaagtttaataaaggattttacttcctataagaagagataatatatcctttttttttttttttttttttttttttttgagatggagtgttgctctttcgcccaggctggaatgcagtggcacaattttggctcactgcaacctccgccttcttgtttcaagtgattctcctgcctcagccgcccaagtagctgggattacagtcacccaccaccactcctgagtaatttttctatttttagtagagacagggtttcactatattcacctggctgagctcgaaccctgacctcatgatcctcctgccttggcctcccaaagtgctgggattataggcatgagccaccacgctcagccttcaaatctcttaatacaagttttttttctagcatttttgctcatattacactaataattcctaaactaaatgtaagcaaataggtcataaaagaaaaataagcatgtaaaaatagtttagtcttattagtaatcaaataagtgcaaataaagtcaaaatcatattatttcttgtcaagcatggggaaaaatggacttttaaatgctaatggttaagtgtaaattgatgtactattctgtagaaaattttggaatatgtatcaattttaactgagtatattatttgatccagcaacttcagttctagggaaagttaagtgaacctaaactcaatttcctagaatagttgcttctaaaataagttttggaaatggtggtaacatctgagcattacagtagccattggccatgtgtgaccattaaacacttcaaataagggaagtttgactgaggaaatggatatttagattccttcatttctttcggttattagcagctttattgaggtataattaatatataataagctatacatatttaaggtgtaaaatttgttaagcttgacatatgtatatacctgtaaaaccatcactataatcaagataacgtagatatccattacctcaaagatttcctcatacccctttgtaatctctccttcctgcccttccccacccactcctgcaaaaagcattaatttgcttttagtcacaatatattagtttgcatttccaagaatttcatataaatgagatcacacaataagtactctttttttaatctagcatcttttatttagcatagagattcacccatgctgtagcatatattattcctttttcttgctgagtagttttttttgttgtatgtgtataccataatctttttatccattcatcagctgttagagttttgggttgtttccagtttggggatgattaccataaagcttctatgaacatttatgtacaaatgttggtatggacatctgtttttatttcttttgaatgatttatcttctctttatgggttgtatgtttttattctttccatgtttgattgttttttattgggtgctagacattgtcaattttaccttactgggtgctgtatgattctgtattttgataaatactcctgagctttttttcatgaacacagttaagttacttggaagcagtttgattatttcagttctagtttttaatgtttgttaggtggaactagcaaaatgctcagtaaaggatttttttcctggtgttgaactaaggcacttccttgtcctctatgcaatgttctcagatgcttgaggttttcaagcctggctggtgggaacaggcactcttcctggccctgtgtgagcactggatgctattccttgtaatgctgtcagctagttatttgcccaggcttgggtagtttccacatacgcgtgtgttgatcagtactccagccaaacactctgaagaaaccctctgcagatctttagaattccctttctgtgcagctctcttctctcttttactcttcctgggaacttaagccaacttggtgaccctggatgctcaactccatcgcctcaatgcagtctgccaggctcagtctggctgacctctccatatactgtaacctataaaccctcttaaggttataagctaggcaattgcaggagccaattcagttgctttccctttctcagggatcatgtgttttattgcctaaccgacagtgtcttgcaaattgttattttgtctgtttttctgttactctaggaagaagataactctggtttctgttactatatcttggctagaagtaccggtttctaattttgtttaattttaattaattagaagttaaatttaaatagccatatgtggctagtggctactatattatatagcacagtctagtgctaaaaagttcattgaacttcaatttctcatgcagaagggaaaggggttctgttaactctttacccacacatgggtagcaaaattaatatcagacaaaataaagtttaaagcaaaaaataattatatggatattctgtcttatatattaaattaataatacaccaagaacataatagccttaagccttttcttataaacttatcagctataggcattgaggttcataaagaaaaaaatgatggtgctcaaaggagaaatctgtaagatcgcaatagcaccttttagaaactaacagattaaatagaaaaaaagtaacataggatgtagaaaatttggacaacccaattaacagtacatggactgtatattagcagaaaaaaatagtatatcttctttacatgtaacattgataaaaattaatccatgtattatactattttataacggaaattgtagcttatttcagacagctttgctaaatgtagtataatacattcgaaaagaaacaaaaatataatccaaataatgaagcacatatcttggaatttgtttttttgtctctaaataattctcaggttaatgaagatataggaataaaaattgctgactgtttacaactgaaaatacaacatttatcaaaagctttgtttgctggccaaagtgatactcaaaagaaattttgtagtgtttatcattgcacttttaatctttatggtgttctgagctttcagttcatgaaattattaaaagagtaagtatactaaaaaaagaaatgatttagaaaaaacagaaataaaaaattttaaaagcagataaacataagcaacaatataaaaatagataagctggaaataatcaaaattaaaaacttttgtgtttcaaagcgtaccaccgagaaagtgaaaagacagtctacaaaatgggagaaaaattttataaattatatctgataaggaacttgtaactagaaaataataagaacttctacaactcaataataaaacaatatataactcaattaaaaaatgagccaaggatctggatagatattgctccaaagaagatatacaagtgatcaatacataatgaaaaaaggctcaacatcattaaccatcagggaaatgcaaataaaaagcacaatgaaataccacttcatatccaccaggatagctataatcagaaaggtggtatagcaggtattagcaaggatgtaaagaaattggagccctcatacattgctggtgggaatgttaaatcgtgtagccactttggaaaatagtctcgcagttcctcacatgattaaacatggagttaccatatgacccagaaatcctatatatatacttaagagaaatgaaaacatatatccacacaaaattttgcatatgcaaatgcatgtttataacagcattattcataatagtcaaaggtagatacaacccaaatgttcaactgatgaatacatcaacaaaatatagtataatcctatgatgggtattattcagttacaaagatgaaagaaatgctgatacttgctacaacatgcatcaaccttgaaaacattaatgctaagtgaaagaagtcagtcacaaaatattgcatattttaggattccatttatacaaaataccaaaaataggcaaattcataggaacagaaagtaaattagtggatgactggggctgagtaagggagtgggggtgaagtgggaaatgactgctaatgggtatggagtttctttcagggattatgaaaatattcaaaaattgattgtggtgatggctgcacaactctgtgagtataataaaccgatttatttgtacaaattaattgagtaaattgtatgctatatgaattgtatctcaataaaacaggaaagaaaaaacagtaaaaattatcaacttaaaaccaaaatatagatacagcttgggaagtacaagcaagaaaacaacatgtataaacagtaaggaggaaggaaggaaaggagaaagggagggagagaggaaggaaggaaagacggggggaaagaaaggagaaagagaaggagggagggagggagaaagaaaaacataactgcaattataaagaagattgtcataacttttttattaagataacacatttggaaacccatatgatctttgtagaaaattaaaatgaatatattcatctcatatagaagtagaaaaactgggccgggcacagtgcctcacgcctgtaatctcagtactttgggaggccgaggcggttggatcacctgaggtcaggagttcgagaccagcctggccaacatggtgaaaccccttctctactaaaaatacaaaaattagccaggcgtggtggcgggcgcctgtagttctagctacttgggaggctgaggcaggagaatcgcttgaaccctggaggcggaagttgcagtgagctgagattgcaccattgcactctagcctgagtgacagagtgagactctgtctcaaaaaaaaaaaaaagtagaaaaactggaataatcaataattggaataatcaataattaaggaaaatttgtataaatatttttaaatctcctaccaccttcaaaagctgcaaaccagagtaagctttatcaaactttaaggaccagttaattctcattttacactaattataccattagtttagaaaaagatgggaagatactcaactcatttatttgataaggctagcataatgctgatgccaaatagtaagaagtttcacaaaactatggacccaattcactttataaatacagaggcaaaaattctaaaaatgttagcaggttgatgcagccatctgttaaaaggattataagatatcatagccaagtaaggtttttccaagaatgttaggatagttcagttttagaaaacctttcagtgtaattcactatattacagaataaaagagaaacaaataggatcaccacaacagatgctaaaatgtatattataaaatgtaataacctttgatggtataaactaacaaattaggatagaatgactcttctgtaacctgataggtttgcagaaaccttccacaaactttagcatcatatttaatgttcaaatagaagtaccagaatcaagacaagaagcttcctatgtgttcctgaagattgagtgggctgcagacagacttggcctctgtgatgatccttgaacacagcacaaagttttttgcactttcattccctttccctggagcatccttcctgtagttatctgcattccttgcctccctaactcctttcagggctttgttcaagtgccaccttttcagcgggacattccttgaatgtcctctttaaaataatagtcttctctttccctctggcactactctcctttgcttaatgttattttcttccagcacttgtatcaccatccatctagtcacctgtactgtaagtcccagggacttagactatgggaggcatgaagtttgcttattgctacctccaatgtatagatcagtgtctgacatgtattaagcactcattaaatatttgctgaatgaatggatgctgcatttaatgacatagaattccaatgtaataacctaatgttgattgattctttgacttaagaattatgggagaggaactttatttttaaggggattgtatctaaagaattgtagaagcttgtttctcatgctattcagttaagcagactacctacaaggttatctttgggaaatgacaaggacgtgaggatttttactcttgcatatcattgagtctaagatgtcataaatttaaaaattcatctagatattttttaaatgaggggagtgtaaactgatggtaatttgtgagactttagtaaagtgaaaattctggagattttaaatataaaagtgagatgcatcttagaattgatgaattacaatatgataacattttatgaaatttatcactacctttctagtttgagtagagatggacatttagtattctgtctgatactaagttatttcatctttacaactgtaatataatattttaaattaacttgcatcatgtattttgaacatgggaatattctcttctacttctagtagattagcagtattgtttcaaattatttccttttctggatatttacactgaaatactataaaaacactagaataaatagaaaatttatagcatggtgggtttatatctctatggagcatcaaaatttattaatattacttctttttactttgcccatgggaaagtttttataaatcacatggtactagaaccaagataatgcatagtaatcattgcagtcaaaatttataatttccttcatactgttctaaattcttataacacaaaattgtactaagataggaaagtacatgtgatatccacttctttgaaaaataagtgtaaatttgttacttatcactagttttttttctaatacccaggaccatctaccacagcacttaaatttggtatctgaaaatcatatactgtattatacacatgacaaaaagagcagtttcagagattgcacagcagatgacatgattgggatagacatttacctttttttttttgagacagagtctcactctgtcgcccaggctggagtgcagtggcgccatctcggctcactgcaacctccacctcccaggttcaagtgcttctcctgcttcagcttcccgagtagctgggactgtaggcacccaccaccaagcccagctaatttttgtatttttagtggagacagggttttgccatgttggccaggctggtcttgaactcctgacctcaagtgatctgcccacctcagcctcccaaagtgttgggattacaggcgtgagccactgtgcctggccgatacttacctttctggaaagaaactctctcattggtttgctctaaaaaccaatttctgctaaggtgacagctggtaaacagaaaagaacaagtgagaaagagaaaagagccaggaaaattttttttaaatgagacgaaagggagtaataggagacacgtaaatgggcagaagtgattaacacagatgacagtgaaaacacaaacacaggaaaataaggacagttggagatgtgagattcaaaagttttgcatatctcttttgctcttaagcagattattacattctgttgaaagctttgtgttttgttttgttttgttttgttttgttttgttttgttttgtttaaactagaggccagttctgtagtctggggattattcattctcagagctagataacctcttgttgtaggttggattgctgggcaattgactgcccacctgttctggataaacagaaaaaaacaaactccatgatgaagtcggggtcctaaaatctgcaaaagaaacagctgtttgcttctttgtggtggcctttctgatgggcctgtgtccttcccctaccacccctcaggctacacactagcttcttatggacagattctatcatcctttaggagatatcaccttagtcatgctcgcgatatggtattgccttatttaaaagctaaaggccatgcagtccattcctactcccttgaagcacggcaatgagatttacccacacccacccacccactcccagcatactaatattccatctctgtagagactcccagctaagggagtcttcaaagttatcatctgcttatcatttttccattcttactctcaagaaatgtccgttgcttccacggagttgcctcttgtgcaactgaaaggtcccagcctctctatcattctcgtctccacaaccctctgaacatagtgtgtactgcattaacaagatgatggcttacgttcataataataatctggaagcatcaagaataatttacattatgttagcattctaagcttcactaaggtaacggattatatgttttacagagcgtttcatccaaaacaactttgatgttttggtacttacagcgtttcgcctacactactgagaaaattcactcacactaacagctcatccatttacctaccaaataatagtagtgcctagtacataaaaggctggatgttttgttgaatatgcacaaagcatatggagaccaaacagtgtagcctagcgtaaatactaccaaccatttttccatatatatacaatcacatataatcaaatcatatgtatgatcaaaatatatgtgtgatttgaccaaacaatatagcctaaatactaccaaccatttctctatatttatacaatcacatataatcaaatcatatgtatgatcaaaatatatgtgtgatttgaccaaacaatatagcctaaatactaccaaccatttctctatatttatacaatcacatataatcaaatcatatgtatgatcaaaatatatgtgtgatttggggaatcatggttttaaaaaatgataccactgtaatatgcatttccttcaccttttctcattgacaataatttgtgaaaaatgttccagttcagtagatacagatgaatcattcatttaatagcttcataatatcccatgttatgcatataccatactttattcaactttccccttgagaggcattatttgagatttttcttcttttaaaaaaatatgtttgtatctgtttgttcatttgctttctgagaaagtaagtatgtttggaaaatgtgggtttcaatccctgcccccaccatttattagtcatgtgaggttgagcaagtcctctctgaatctgtttgctaatccgtaaaaaaatctccagtaataaaaccatctcttcctcagaagtttatggaagatcaaagtgtggaagcaaatataaaaatacatattataatgaccattttaattagttcatattcgttttatgtttctaattgcagaaattgttcataggtacagaaaagataaaacagtaaaattaatacttttttcctctttctattaaagaatggaatgactcctctaatgcatgcagcatataaaggaaaactcgatatgtgcaaattactactgcgacatggagccgatgtaaattgtcatcagcatgaacatggatacacagccctcatgtttgctgcactttctggtgaagttttagtatttataaatataagttacctatacaaacttgttataagtacatatatactaaaagattaaattcattttgattttagtaattttatggtcaagttttatggaaaggaatgatggcaattggtttttgaaaagctataatgcaggaaataaattatatagtgaatttggtgatttgtttcttttgttatttagatcaattgattctttatgtggacaacattttgatggaattgaggaactggatctgtttttctttcaagttacctcctttgatgttctatatctttatattttcaagtgacatgaaaacttctttcttctcttgatcaaacagttgccatgacagagccgtctgtttgcctcactggcacttatgtactaaatatgatgatccctttagaaacttactcggatttgtattgtttattatttgctgaataaggacaatttagaaatactgtctacaattaagtgggattatctgtaattggtgcagctctttgaaaaatacagaagtaatatccttgtactttgaagataataatctatattttcataatcctggaacccagaagcacttctaagcattatataaaccacagaatccaaaaaggacaatattgataaaaatttaacattttcatttgtaggatataccataaatagagttaaaatacaaatgaaaaactaaaaatctgtattatatgtcttaaaagattatattgtgaaatattaaaagttcttttagctgggcacagtggctcacacctgtaatcccagcactttgggaggccaaggcgggctgattgcttgagcccaggagttcggaccatcctaggcaacaccatgagaccccgtctctaccaaaataacaaatattagccagggacagtggcgcacgtctgtggtgccagctactcaggaggctgtggcaggaggatttttgagcctgggaggcagaggttgcagtgagctgagatcgtgcccctgaacttgagcctgggtgacacagtgagactctgtctcaaaaaaaaaaaaaaaaaaaagacttcttataaatcaagtataaaaagaaaaatactacagtagaaaattggatggaaaacaaaagaaataccactggctgatcaaaatataaaacattttgcgcagtaatcaaaaaaatgcaaattagaacaataaattttattttttagcttattatactggcaaatgttaagaaagagctataatgctcaggaacttctttacactatttgggggagtgcatgtcagtccaaccttgctggatggcagcctggcaaaatgcatttaaaatatgcataatctttgatctggcaatatttcccaggaactgttcctaaggaaatcataattcaaacttgcgaaaatgaatggaaaatacttttcactgagtatagttcataatagcaaaatacccataatgactactttagtagaagaatgtgaatagaataatgtgtatgtttagatagaaaaaaggtgtagaaagatagatgcccagtggttaatagttcttccagagcctgtaagtgtgaggaatgggatggattagtcgatattaaaggggaatcctattcattttatctctttttaaaaaattgttttgtatgcgtattttgattttatagtaagtgttacctctaggaaaatatatttcattttgtttaaaaaggcagtattcaattccatactgcctttgcattgcttgatttgttttccagaaaataaggttaatttctaaggttctatagcattttattctttactgtagttaggattcatgttttaaaagaatgaaaatatccacatgacagaaacctaaaactaactgggggaataaagggtatagagagtttagaaagggatgtttaaattgtgtcctccttaacattaacaaatgtgttccctttaaaactctaggtaataaagacatcacatgggtaatgttagaagctggtgctgagacagatgttgtcaactctgtgggaagaacagcagctcagatggcagcctttgtgggtgagattttgctgcagttttgcattagattatacccaaaatttcccttgtggaaaaaaaacccactttgcttctcatggtgaaaatattatcatgttgctttaaaaaaacttaagtatttacagtccactgtaacttaatgaaacacctagtgactctggagaaaacaaatggctatttcgaatttccactttttcaaatacaaagagtagtggggccattgtaattgctcacaaatgcttataacatgtatattttatgtctctgatggaagtagctaaccctaatgtttaagaatgctaaccgagaagtcagtaatcccaagttaaattttggctgtgccacgtgatagcaaagtacttaataattctgaccttcagtttcctcatggtaaaatgttacagggttattgtgaggattaaaagaggtgatagacttgaactttccatgtaacactaaataaatggtattagttactgttgttaataattattacaacaatgacataactcttaggaaagagtacttgataataatatacaactacttcgttatcattctcatcaaccacagacgtttattttgtgtgcccaataattcttggcatgttaatcctattgcttgacataatgtaaggaaagagtgggagtgaattcttgttctttggtattttgacaccattgaattggtggtgaagagagtccactgagagaaaagcaaagagcaacgtctgatttattgggagtgcagtaagtggccgtatagggactaataattcattaaacaaataatgttcacaacctataaagcaagcatcactgtaggtgtcttggttatagtgacaagacaggctgttcatactttcttggcacttaaagggtaatagcaatgacaaatggtgcgaaaacacatactccaaggtagaacttcagagctccataaaaatacatagaagaggaggatctgtccaattcaagggggttttgagagaagtcaggttcagatacagtgtaaattaggtgtggaggatagtaactgaatattatgttaaattttattagaacattttcttgaaactactaatagaagctgccattgattaagccagacactcagttgctttatgacagctttttctgttagaagaagtatccttattttcatttcaaaaggacttgagaaaggtatggccttgtgtaagcttcggagaaatattttaactcccgtgtgtacaggccccaagttgccccatctcagttctgagctaattttgagggtgtcactgcagggggaaagaacactaaagtaggaatctggagacttgaactttagttcatgtgtgctgataattagttataggatcacgggcaaattcctttacctccataggcctcagttttctgatctgtatgcaaagaagcaggggaattaggtgatctctgaacttctatttaactgtacaagttttcattatatccacaatgtaacaaaatattgctcagatacaggtaaaaaaatttcccaagatcacaggtctggaaatggaggagtctcttctttcaggcattaacacaatgctcctttctttttcttaacactacaatactaacaaaatttttactacagtaaaaattgtttgcaatcctatcctaaaataagagtaatgttttcattccattttaatatatttaactgatttcacagacagaaaattacattgcacccttccagttgttactgtattttccaaataattagcctttaaaaaagctcattctcccctttttgtttccttcaagtggatcagtatgtatacatgcgtacatacatacataagatttttgtcattttttaaaaatgccacccatcacacagcagatattccttgtagcttgttttcttcacttactaatacatcatggaagttcctcccatctcagtaggtgtaattcatttccttcaacagctatatgatactccatgatatagatgttccacagttcagttagctctcccttattgacagattttacagttttttaaccacttttctacaaataatgtaataatcatccttgattttctatgttttacaagttagtacttgaatattttttacatgttagaactttaatatctctaaagtatttcttagaagtaaaattgctgagacaaaggatatagagtttttatttttatttatttatttatttatttatttatttatttattcatttatttttgagatggagtctcgccctgtcgcccaggctggagtgcagtggcccaacctcagctcattgcaacctccgcctcccgggttcaagtgattctcctgcctcagcctcccaactagctgggattataggtgtgcgccaccacgcctagctaattttttttgtatttttagtagagatggggtttcaccatgttggtcaggctggtcttgaactcctgaccttgtgatctgcccgcctcggcctcccaaagtgctgggattacagccaccacgaccagcctagagttttaattttaatgtaagtctagattcctttccaaaagggcatagtaattcacagtaatatcctcatcagagctgagtattaccattctttgatttttgccactctgatagttaaaaagatggtacattgtgaacttactttcccctcattatttatgaaattaagcacttctgttgttggtaatttgtattttcacttttgtggattacccacttatactctttattcatttttttgtggggggatgccctttgttattgctttgaggagctttatgcatacaaatccattatctaacaaatgtgtttcaaatattttatgccagtcctcctcttcctcctcctcctccttcttcttcttctttttattcctcttcttcctcctcctcttcctcttcttcttcttccttctttcttcttcttcttttttaactttatggagacctttaccataggaaatttatttatttatttatttatttatttttttgagatggagtctcactctgtcacccaggctggagtgcagtggcataatctcggctcactgcaacctccacctcctgggttcaaacgattctcctgcctcagcctcccatgtagctgggactacaggtatgtgccaccacacccagctaattgttgtatttttagtagagatggggcttagccatgttggccaggctggtctcgaactcttgaccttaggtgatcgtcccacctcccaaagtccttaggattacaggcatgaaccactgtgcccggcaggaaatttatttttaagtagtcatattttttcttttatagcttccgtgtttcttgttttgctaaaagtgggcctcttgaccaggagttacataagtattctcctaaatatccttcagttattttttatgatttttttggtacatctagaatttatttgtttagagttcatttccccccagatatatagctaattgtgatggcaccatttattacaccagctaacattttcctactaaattgaaataccacctttgtggtaagttaaattctcttttactaaatgattatataattatttgcagagaattaacatttgtatgaggttaggactttccatccaattacacagtacacttttacatttcttttaggggaggggactgacttttggtctttcagtaatatttaattggttccttcatatcaatcctttctttcaaaatttatttcttagtaatttgtggttactgtccacatggtaagaatttgcactaccacctccacactcagtcacttccagctggttatggataataaagagaaaagctattgatttctgtatttttttcttatttttattacagtttactgcgttttctagctattaaactttatcttgatttctatttgaatttgcttcgggccaagtaagaagaaataatagtgataattggcatgtctttttcctgtttttaatgaaaatatttttagcttttcacttttaatatattgctattggttttatcattgtataatgtcactctttttcttgttgaattcttttagttctacttttactgatattacagctattcataattcctttttttgtcaatgatctgtttgctcatctgttattttcaatctttatcatttcatttaagtagtataacttataaacatataggtgggttctgttttgtaatctaaaatgttagtttccctctcttaacaggtatttagcttatgtatatttaatgtaattactgatatatgtggttgcattcctcctcttttacctcatttttactctttattttacttgactattgtttgtgcatgcatctgtgtgtgtgtgtgtgtgtgtgtgtgtgtgtgtacacatgtatttccctaaagtgattggctggtcaaaactgtacagtaccacataccccatccccaaggccccatatttacccatttagcaactttataagatgaaatccttatacttcatttatttctccacattctctgtttttgccttgtcaggccacaggtctttcctttctgccttctctgatacttcctcaaaacctgtgccaatcatacctgtagctgtggactttgctgagagagtctagtatttttagcacaagctgtaatgagagtgtcattgacagggtgttgcttctctttcagtaatccataccaccagctgtgtgatttgcctgtcatctatcttcacccactcatatgaactcactctcttactgtcctctctctcctcccctttgtctccatttttgcatttttgtctttagatctctgttctcatttagattttggttataggaccttttcaaatgggttacgtaggttgtatattctttgacacccatcatgacaaaactattaatacctttctttctgaaatgtgagtcatattttgcctagctttctgactcatatcagagttcttttctctccgacatatagaagttattctacagttttctaagttctggttttgcaaatgagaattcaacttactttccattgtaaactttacatttctcattctggaagagcatttgattttcagtttatccttgaaagtaaaaaatttgaaaaggatacgtcttgttgtatgtgtgtgttcctattaatcacactcagtgagccctgtaagtctagaggactcaaatctagtgattgtaatatgggagcaaaatgatgtactggcttctccacctgcagcatttattttctatattagtagtattattttatttatgtatattcagaatttataaatttaaaactagtaaaatatttaagaatttcaattacaaacatttaaacctaaatgattaagtatttacaaagataaactttaaacatattattcaaatatgttattagcagattaattaaaataaaatatcaaaataagcattacctaaaatgaaaaaccttaatctggaaaaaaaggtaaagtaatactattttttctttttaaaaaggtataattaggccgggcacagtagctcacgcctgtaatcccagcactttgggaggccaaggcgggcggatcacctgaggttgggagttcgagaccagcctgatgaacatggagaaaccccgcctctactaaaaaatacaaaattagttgggcgtggtggcaggcacctgtaatcccagctactcgggaggctgaggcaggagaatcccttgagcctaggaggcggaggttgcggtgagccaagatcgcgccattgcactctagcctgggcaaaaagagcaaaactccatctcaaaaaaaaaaaaaaaggtataataaagaaatccttagtcttgtgacagtatctttgttatgtagcaattatttttatgtacagatatttctacctgctgcctgcttttcctaattgtactagttggaggactgatgagaagatacagttataagctaattccttatttttctctgactcctttatcttcaagtcttcatatgtctggttcagtacttttgatgagctattttggaacttttgtgtgtgtgtgtggaaacacctatctttttattgaagctggatgtagattttgttttaaggaagcatgtgcggtttgtcttcatcttctctggtttcttcacatacagttgtaaatttcctcacaattacttgggttgattttgataactgtgttcataacccacttgcattagatttgcttggttgaatgtcatttttctctcttgaagattctggaaggagaggtgatcattttctaaacagagcaccttggctcatttcacatttttaatatagactgctactgtttgacttttcaagacgtatgtactggggaaagaaataaaagaaatacccacctccccgaatccccccaaaaagaaagaaattgggtgttctggtacttaataaaagcatagagtaccaaaaatggtattgtgatcactattaaattctcttttcaaatcagggaagttttcttttatcatttgtttaattctccatctattcctttttttcctttgagatgtctgttaattttcactattagatttcctggatttgttctttagctctttcatctgttgtataatgatttctatatctgaatttttctgttttgagatatttcatccactcgatcttttttgtttgttttgttgaaacagggtgtctgttacccaggcttgaatgcagtggtgtgatcaaaactcactgcagctttggctgggcatggtggctcacgcctgtaatcccagcactttgggaggctaaggcaggcagatcacctgaggtcaggagtttgagaccagcctggcaaacatagtgaaaccccatctgaaaatacaaaatagattagccaggtgtggtggcacacacctgtagtctcagctacttgggaagctgagtcaggagaattgcttgaatccaggaggcagaggttgcagtgagccaagatcacgtgactgcactacagcctgggcaacagagccagactctgtctcacccaaaaaaaaaaaaaaaaaaaaaaaacacgctcactgtagcctccaactcctggccccaagcaatcctcctgccttagtatcccaagtagctgggactacaggcacataccactgtatccagctaattttttaaattatttgtagaaacgggtttgtgctgtgttacccaggctggtctgcacctcctgggcttaagcaatcctcctgcctcagcctcccaaagtgctgggattataggcatgagccaccatgcctgcccttcatcctctgtgttactagtttagttctcaatagtaaccaggatcacctctttcagtttgcctgttaatttttaaaatttgaatctctctgcggctcttgaaagtctatttatatattataattgaatctgcttaagtgcatttattagctgtagttgtggtagttattgttatggtaaatgttacccacacactttcaacccaagaagccctctgttggaggcatggcgtagtcttcagaattgctggatccccatacgtaccttgttctgtacctcccaggaagtcaggtaaagctgatagggtcctggatcagtggaagaagaaaatttaatgtctcaattaagacattaattaattactttagaaaattatcactctccttatagaatcttcaagaagagagaaaaatgacattcaaccaagcaaatctaatgcaagtgggttatgaatacagcatcaaaatcaacacaggtaactgtggggaaatttagaaatgtgtatgaagaaaccagggaagatgaagacaaactgcatatgcttccttaaaacaaaatctacatcgagcttcaataaaaagataggtgttcccataaaaaaaaaaagttctaaaatgtctcatcaaaagtattcaaccatttaattgagacattaagctggtttggtcagcaaaccagctgaggcacaaggatgaagcctgccactcctgggttctcccaggaactttcagggacaagcagagccctctgccagcctcaagcgccagcgtccagctggcccacagtgccatccccacgcaggtcacctgttgtcggcaggatcaagcaggcgctcccaggaccaagcacaagcaggcaggggccatgcaggctacccagggggaaccactctccgggagcgggggccatggcgtctgcacgctctccccaggcgcgcctccgctggtcccccagccctcatcaggcagagcggaggaagaagtctcctccggagatccaggaagagcctgcgcccgccctcctgtgtgccctgtggcttctgcctgcttgcccagagtggccactgctttgctccagagaggtagtggagagggagctagggaggggggggcgccgcaggagcacacttgcaaaccagcagcttcgctagggaagaatttgctttcatagaaccatttttaactagagatggcttagagaagtggcttggaattctatgcaaagccacgatgtggattccaagcttatgggagcgaaagccttttctctacatttcacaaagagggcaagcttttctcaaatttagggggtaggggataagggggagggggtttagtttaatattatcattatagtaagaacaatactttatatggagtaaatttaaattttgtgtaaatacaactggatgtgattagggaaacatgagcatcatttgcgtaggctgggaagaagagacatttaacttacaagcaactgttagaaaatacttaaggtctcttacaagttgagcagtgctttcttttgtaatccacataatcttcgtatgtattttggattctgtgtctttcaaagattgtttatcaactttacaaggaatgtttataaatgttctctaaaatattttatctctcctcctcctcctctactctcctttcctgaaaaataaagatattggtgcatgtttacatcacaaaaatagcaacataattaattttaaaaaccagatgtgttatttttaatactaaaactacaacttttctatttttctatgaaaaggtcaacatgattgtgtgaccataatcaacaatttctttcctcgagagagactggattattacactaagccccagggactggataaagagccaaaactgcccccaaagttggcaggcccgctgcacaaaattatcaccacaacgaatcttcatcctgtcaaggtagtgtggtgtctaccgtatttgctttttatgtaaatattgcttcagagtttaaactgcttttattatacaggatcataattgtcttggggtgggttttgtagttgtagagcttgcagtgggctcttttggcctgttaatttattgaaggaacactctccgttgaaacctggaagtgagtgagcgagagagaaacagactaaaccatcaggaaaagccacgcaaagagatgggtttgctgaagcctagcttccacctcatcccaccgggagctctggagtgtgagtggctccagagaggcaaaggaattcttttgtattcatcagtctgttgttgggtggggcctgtctccagagggaaaggacagcctcccacatagtaccaagtgaggtggctccctttcaatgagggtagtcctctggagaaaagaccatagtagctgaccctgagagccccgggggcctggtatacaggcctggtaaaaaggatgtatgtgggggcactaacagcatctattacaataattgtctttctaagaaagattctgaaatgtaatcatgagcacatttttaaactaagtggctatttgatgcctttaaataacatagttcttccagtaattcatcaaatcagattttcaaatttcataggccaacacataagttcaaatggcttaactgggaaacttcaagagctattctgaaatatttcactgctattgtcttccagattttaaaaatacaggcttttgctgttgttgtttacacataattttttcaaaaaaatccagctaaacaagtataatttcctcaataatcatcacagaaaactacacagctacatgtgtgctacagtgatgaggtcctatttcaatttcagtatctatcacatgcttttactcataaagatttgatagtagttcagagctgtttaagtgagcaagatactaagttgtgtcaaaagttaaggttcttccttaacataaggcgttactatcatgtagtaaaatagatttccccagaagtttattacgaaagaagaatctgtggagtctgctgagcatcatgaaaatgagtggacagttcttataaggtgactcttctgaagactgacactcactcaaagatataagatccaaaatgtgtataatcttattactttgttgatgcatccctgtgcatctttcttgagtacttgaaggttgagaaacaaaccaaatttactcattgtgtgttcctccacccaaattaattttctaggcccttaagagagatgacaaactagtagatacctttcccatcagacagaagagtggaatctgctatttttattttagaaaactcagagtttttcttaatattctggaagaactgccagaggcaacacttgtgatactaagtgggcaaattcagttgtgaactgcatactcatgtttctagtggagattacagagggcttagaatttaacctttaaaaaatatgtattttcttctgtgttactgtttctctccctcccagcatacctagggaaaagagaactcccaagagaagcattgacctctgtccatggcactctctcaggcatgggctggctgggatggggagacaggtttctgtcagggtacagtatttctcaatgtagagaatgtgtgtggttctgtaagactcttgttcctccactgcctgagcaatacaggatattctggcttagactgacttgaagaagttccctgtacttttctgattcactgtctttcatatctatgtttctgcctcttcagattgcagtaagggtttgtggaattttttttttttttttttttgagatagggtcttgctctgtcgcccagcctggagtgcagtggtacagatctcggccttccaggttaaagcgattctcctgcctcagcctcctgagtagctgggattacaggtgcccaccaccacgcctggctaatttttgtattttgggtagagatggggtttctccatgttggccaggcttatggaataattttttatgtttacttggaacccagtctttcagggttaaatgtcctaataattattaatactctaccttcagttatctttgaaggtatatattttaagtaaattagattgagggcataattatgcagacaataatttgtaaaggtatatagtctgaaatagactacataatattttttggagtatgaagggggctatcctattatataccttcctccagaccagaccttgctttttgtaggtataaacaatctattcgctcgaaaccttttcttttatccacccttgggatctaaaagccacccagttgcttttgttactgtggcccatttttattgctctaccccctttttaagctagcatggcatttcctatggagtattatttaaaaactaataaccactgtgtaatgttaaacagcttttaaaacaacctcggaaattctccccaatacacacctcacttttcattacagtgcacctaatatagctgtatttgtgtctagattaagtggctgccgtagcaataaggatgcatttgttttcaaaagggatttggaggattgtgctgatgcccagaatatgaaggttatctaggagaaaaacaaaatcacagaaaaaaatgtcagcagagcagggtctctaagtgtacaggaggcagatgtgcacagaacaatcatgtctttgattattgtgattttcaagcccagtattgtagatttagcagtttttaaaaataggatttaaaaaataaaaagaattcaaaatgccactacataaacatattctcaggtagcaatcctttgaatggtaaaaatttatctagtttttaatgccaatagaaatatatttatttgctcctcctcattaattaataaaaaggatttcctttataatatattacttcataatgctgcagagattaaggaaggaaacaagtacaaatattattcttttgtgtgcagctatgtagttgtttcaataagcgcatgttaatgatgtggttatttgtcatttttcttggtgtatatttgtgctgtgtattaaaacatagataaggtctgatgtctccaaacaaaaaattattaatctgggctctgtttgaaattttttgaaagaattctcacttgtaagtttaagattctatagttgattataaatgccatatataaaaatactgatcaaacaactttaaatgattacaattagcagaagtataaacagataattaatgagtcttttcttctccaccataaattgtcaaagtatgttttggtagagagagttatcaataaggattctgattatacttacttcattaagtctaataacttattattaagtgctggatttttgtaaaacactagattgtgtataaatctaataaatgtcaaaaagtgaaattcgtttaattttacaaggacatttaatctgtgttaaatttctaattagagggctagctatgggctttactaatagatgatcttttttcatgcctaaagaaaagaatctaattcaggaaatctacctgttgttccctgacatgtatagtccctgggatattgatttagctgtaacaggtaggttagcaagtactgactggctgtctgctctgtgcatacagttgtgtccctgttacatttgttgtggtctttgtgctccttagttcagctagatccaagttcttgtcttacaaccaggaagaattagacaggtggacactggagagtgagtggagtaaaatttattaagtgaaaggaaagctctcagcaaataggagacgcagtgcagggtggttcccctacccaaaggcgggaaagtgccccatgtgcctgggtccaggtccttttatggactcagaaaggggagtgcatgctgattggtttgtgagtatgtaaaaaaggttaaagtgaagacaccactcaatggtgggcacaacagtgtagaaaaccagttaggaaagggtaggtgtatgtaaaataggtgaagggtggggatcaatcagaagaaattgagtcaaacaggaagacaagttctcaatccggttcaaggatttaatttgtagcttggctttcaggctttaaactgtctttggcttggaagtggggcttcaccaaggacccacccctattctctctaggcatttggctgcctcctgccactctcacattcatgtttacattactgttatgccaccatggatatttacagcagtcctttgcagacctacttcaaataatctaccctacaacaaagctaatacaaaaatactccatattacactaaatttgagcataatctgtgcatacataggaaatgtgggactcataacgtgtaagatttgatcattctaatatttcccctttaaagttatttatggcttcctctttgacctgttctcattactgtagatgattggaagcatcttcaggaaaatttccatagagaaatatagttaattggaaagtaaagcatatttcatttttagacttcattctgaaaaaatctcattttcttgtgcttaataagaattaatgagaattgtagttctcctagccatgaaattctagagctgagtaatgttaactaaaagtggttattgctcaatgatttgattctttatgtaaaatgtacaaatttgtcatgtttatctttagtaaaagtgaatttaacagagactgtaaaatcatgtgctcttgaatggcatactggcactgtggtgtaggtagatggaagatcacattataactttgatatacagagttcaagagattccactatttcagggtctttctatattagttctataagttctgggtaatttgcattctaacaaataacataataacttcatgatcctaaggaaggctttctttggtaatcttttgaaatcaactaaatggactacctaatttgtacatgaacaagtgtctcctttaatacctgagtacactgggatttcctctagatcgtgatgcttgtaaatgagaatcctctgctgacagaagaagcagccctgaataaatgctacagagtgatggatttgatttgtgagaaatgtatgaagcaaagagacatgaatgaagtattggctatgaagatgcattacataagctgtatctttcagaaatgcattaacttcttaaaagatggagagaataaactggacaccttgatcaaaaggtactctttttactatgtcgtttataaaatacactcaagtgaatattttttttaatatgaagcctcattattatgtgtttcaaaattaaacattttggcagcaattgctgttgttggactcacatttagtctttgacaaacagagaataatattatacttatattgagtgattattcagttctgtatcctttactgtgatgtttttgttgttaccagcaatttacagatgaggaatctgaggtttggagaggttaaataacatgtgtaagatcacaccgcgagaaagtggcccaagtccaaatttgagaatattttatgccctaggtcgcagccctaggtttgtaatggcatccagggtgtctctgttactgtatcttggagagctgtgtgttatgctgcttctctgaccaccagagatcaaattctcttgcatccttacctagaaaagggaactaagtctgaagggtgtggctctatgagagttttcattcttagtacaaataactgacatggtaataagtaactagctaatctgataacagtgtttagtgtgttttatggtggtagtcacctttgcatattcatttaatgggctggaaaaccttataaggcctagcctaacatataggttgaacagcaatttgaactgagcccgtcatcatgatttgaagagacaaagaaaatcataagtaacagaagaaactactaaaaactgttgggttcaactaggagagaatgcttagtgattcaactccaattacgctttaaaaaatatctttcagcttgttaaaaggccgagcttctgatggctttccagtgtatcaagaaaagatcattagagaaagtatcagaaaatttccttactgtgaagctacactcctccagcagctggttcgaagcattgctcctgttgaaattgtaaggctcctcttacctaagttgactctatcagtaaaacctaattcccacctattgtattgttaaaggcaagttctctttaatatttatttttattatttcagaatatttttaggaacaaaggtggagataggtttgcctgccaaacctgttcctgtttatttatttcccatctcacgatcctcttcttaccttattatggttcatagtttcataaacaggacgtcgctatgttgaaatgtagatggttagggtagaaacttacattttaagtacatccactatgtaatataggtacacacatgtacacttgtagctatatgaattatcagcacaaagtcatacactagatgcaagtatgaattgatcacctagggggatagtgtccaggcagtggggatgtagtgggataagccatgggaaggctcattgtggttcctggtaacaatctcaaagtatgcctcagcttcctataatccaccttaatgcctctgattagaaaatgtccatacttacaacctatttatacttacccactatataagtgtattttgttaactttatctgttatttaaatgacttactattcatttgtcatatattttaatttatttggccttttctattttgcgacagagtctgtttctgtcgcctaggctggagtgcagtggcacaatctcagctcactgcaacctccatttcccaggttcaagcgattctcctgcttcagcctcctgagtggctgggactataggtgcgcgccaccacgcccagctaatttttgtatttttagtagagatgggatttcaccatgttgaccaggttggtctcgaactcctgactcaggtgatctacccacctcggcttcccaaagtgctgggattacaggcatgacccactgcgcccagccaccttttctattttgaataggtttttgtttaccctatctatacccattcatgcttttatacgtttcaatcaaaaacttgatcagcttttgtctatcaggcaagaaattgatcctaagaccagtcccatccatggcttcctccctccctctggcaaatctggttcccttctctgtgccttctctctgggttgttatgtcattctcagtgtggaacatcagggcttcaagtgggctccagatgctcctttgtacattaagaattcacctagtctgagccataaaataaacaagaaagacctgagcagaaaagaccatctcataaagctcatgcattaatttgttcatgtgtgctccccctattttcaagagtttctttactcatactttttaatatagttggctatttagtgtttatgcttttggaagaataaagttagcaaattatgatttgtcaattacaaatgtgtcttggcagcacatatcaaagcccaaccaaccatgaattaaatagatgagggtttatgtattcacatatacatagatgcccaaaggtaggcagactaggtctggcatagtgacttaaaaatagtttggggacccaaacactttctcatctttcccttccaatattccttagctgtgtaggttctcatatgcatacttatgatctcatggttacgaggcatttgatgttcctcctccagctcacattcctatcccaggcaggcaggaagagcaaaggggtctatatctggaaaacataagctctcccagaagccctctgcctgtgtcacatgactttccttagctacacaggagtccaggaaaatttttttttttggcttttctaaacactcctcctctgaacaaaattacacttctgttactgaggaagctgggagaattgatatcagagaagcaactagcagtacctgttatgtgggatttccagcactcacaaatggttgctgaccttttaccttcctgggaaaaaacagaaaaactaaaacagcaacccagagttctttaaaaaaaaaaaaaaaaaaaaaaagcaggtcaatattgtggtcaacaagttatcctagctccatataatagaataatgtaattagagtttatagagtataattattattatttttatttatttattgaggggggtcttgttttgttacccaggctggagtgcagtggcgcaatctcagctcattacaacctcagtcttccgggttcaagcgattctcatgtctcagcctcccgagtagctgggactacaggcacacaccaccatgcccgactaatgtttctgcatttttagtaaagacgggttttcaccatgttggccaggctgatcttgaactcctgacctcaagtgatctgcccgccttggcctcccaaagtgctgagattacaggcgtgagccaccgtacccggcctagagtataatgattaatgtttatcccagtgatctgagtcatcaagaaaaggtttataataaagttaagatagtatttaatgcattttagaaagacttttctttaaacatttttgttctttgagagttttatgttcttctgtctggaagacttcatcccaaatgcctgtgattgtgcgtatcacagccattgtttactgcctaattggttttcatattctgcaagttctaaccctctgaagtgatgcccaaccttttccccgcatacgatggttctcagggctggctgctgtgagcttcactgtgttgttttctgacagtgctaatgcctgggccctcctgctcagcttttggttccctctgctgctgtggaactctggcttctgcctgtctcaaggctcagcacaaaagagaattcgtagcactttcatgtgaaagcagacccagtcattattatttgtattcaagaagaacatggtagtttcaaaatgagtgctacttttaaaatacttcttgaatctttgaatattttctttgactatcttgagtatacagaacagtgtaggacattgttaccaggtgatatttttaaacctctattatgtacagttggtaagataatataaaaacaaatattcttaggaagaaaaagcaaatactcaaatgaaaatgaaaattataaagagtgtcaaaatgctggtttggaacaaatgaacaaatttgaaaaactcagaacaaagaactattaggagtaggtaagaaaaatagaaacgctgtgattattttttgctaaataggttttagtagcatcgtctcagacagataaatgcttacccttataatttttttttttttaaatacaaggtcttgcactgtcaccaaggctggagtgtagtgacacgatctcggcttactgcaacctctgcctcccggactcaggtgatccttctgcctcagcctcccaagtagctgggactacaggcgtgccaccatgcctggctaatttttgtattttcagtagagtcggggcttcaccaagttggtcaggctgctctcaaactcctaacctcaaatgatctgcctgccttggcctcgcacagtactgggattacaggcgctagccaccacacccagccccttataattttctttgtaaaaaaagtttataggccaggcgcggtggctcatgcctgtagtcccagcactttgggaagccaaggcgggcgaaccacgaggtcaggagtttgagaccagcctggccaacatggtgaaatcctgtctctactaaaattacaaaatattggccaggtgtggtggctcacacctgtaatcccagcactttgggaggccaaggcaggcagatcacaaggtcaggagatcaagaccatcctggctgacacggtgaaaccccatctctactaaaaatacaaaaaaattagccgggcgtggtggcgggtgcctgtagtcccagctagttgggaggctgaggcaggagaatggcatgaagccaggaagcaaagcttgcagtgagcagagatcacaccactgcactctagcctgggcgacagagcgaggctccgtctcaaaaaaaaaaaaaaaaaaaaaaaaaagtacaaaaaattagctgggcgtagtggcgggcgcctgcaatcccagctactgaggaggctgaggcaggagaattgcttgaacctgggaggcggaggttgcagtgagccaagatcgagccactgcacctccagccgggtgacagagactccatctcaaaaaaataaaaatagataaaaattataaatattttttaacctattttaattttccattgcccactagtagtaagtttcacacatttggtttttcttaatactttgattcaattgctgcatgtgtgtttcttaacaaatttggaacataccaattataatggtgataatttatttgaattacaagccaacatcaagtaaatgagtttaaatatattgtctttaaaatacttagattgtactaaacttttcagaattaagacagttaaacatttttgatgtgccctataattgtctcatggaatatgaatattttctggatgtcagttctcagaaaaaaattctgctctggagttattgtcctaaatctgaaacgctatgggcttactgaattatccttattggaaaaatactttttttctagattaagggtgtttttttctctttaattatctggacatatgactgacttttcatatgttttgtacagaaaatggtatattctaaaagatttttgtcattttgtcttaaagcctgtgtaatctatagccttaatgatttcttcctttttgtgtcacattgtaggacggcagtgtccgtgggctgatacctctgtagtgtttccatggtgatttcagaatttgttttttctcctcttcatgcccactctagggttctgatcccactgcattctccgtccttacccaagccatcactggccaggtgggttttgtggatgtggaattttgcactacctgtggagaaaagggagcaagtaaaagatgttcagtttgcaaaatggtaagaatggagttctttttatttcattgacctctggtttagatgcagccaagctgatgattgagttttaatattctgtaagagtggacattagttttctaataaattctagtaacgaaaatattctatttaatacttaaaaagtagttttggaaaagaattaataggatcaatatagttctttactgtgtctgtcttctgctaaactgccagtcttcctttgcctctttgctgatcacctcatggaaagaaaggatatgaatgaatgaatatgagaaaataagagaaaggttttccgtggggcacgagaccaaggctggtgcagatgtgaaacctagaataggacagttcataaatatacattctttactcttctgatgttgactttaatgacagtgtcttcatcaacatatccttgtaaaactatagtttctgactgttaccagtctttaatccctatggactgtactgcccccttctgccagaattatctttgtaaaaggcatatctgattgtgttgttctcatatccagatactggacacatgcatgtgtccgtacattcacttaatcccataggtagcatcaactgcctgttgactttaaggttgaaattctccagcatgttgtatgaaacccattataatctgctgtgacctacttcttcagcttcatcttgtttaatgacttacttctctgaacctgtttcctgaattaaatgaaattccagaattaaatcaaactatttatattggttaattattactgcttataaaaacacactcaaactcagtgcttaaaatgataatcatttagtctttctctcacagttgtggttggctgttctcagctggggcagttgtgctccatgtgactctcatccttcttgtactagcaggctaggctgagcatgttgtcatggcaatagcaaaggtacacatgggcaggtagaaacacagaagacctctcaaggactagccttgaaattgccatgttgtttcatgctgttggttgaaacaaattacatggcccaatctgaagtcaagtctcctccccttcagtgcagagaactttgaaatcatgtgagaaagtgtatgaatgcaaggatgaatgaagaattggggccaataatacaatatatgtataagggcctaccacagtgcttggcatacagtaagtgtttaataacattcattcccatctcctttccacccctacttgcaaaaatataaggccatttacaaaaacttcttgctgttcttgaacatatcattcacttccctgttcctgcatttttgtactagatattttctccagttagaattcttctttcccatttttctgtctacctcgactcaccacagctagagtgagttgctgcttcctctatgcctccatcactcttacatcctgtactgtgttaagaaattatgtatttaggtgcctgcctctctcccttcttccatatctttctttttcttgatgctagctacctttgggacaactctatcttccttgtcattgtactgtaccaattctggcacatagcgggttcataataagctatttgctaaagtctttggtagactgtttgttatatattcattattgttttaaagtaaagctacaaactataaatctaaatcaatacaaagatactgtgttaggccgttcttacgttgctataaagaaatacttgagactgggtcatttataaagaaaagaggtttaatgggctcacggttctgaaggtatacaggaagcatggcatgggcatctgctcagcttctggtgaggtctcaggaagccttcaattatggtggaaggtgaagggggagcaggcatgtcacatggcaggagctggagcaagaggaggtgggggagttgccacatacttttgaacaaccagatcttgtaagaactcactcagtattgtgaggacagcaccaagggaagggtgctaaactgttcatgagaaaaccgcccccatgatcctatcacctcccactaggccccacctccaacatttgggatcacaattcagtatgagatttagaggggacaacatccaaactatatcaaccacatattatggttttaaaataaagtatggaaaatgacatttttatagcttagttcttggtttagtcatagttaggaaatcatacaacccaagctctggaaatgaaaataaaccaacaattgctttcaggtaatatattgtgatcaaacctgccagaaaacacactggtttactcataagaaaatctgtaagaatctgaaggacatttacgaaaagcaacagttggaggctgccaaagaaaagagacaagaggaaaaccgtatgtatataaaaaccgagttcactctgctttttagtggagagagagatgataggtgatcttaacacactgaaactgcgtcttctctggaagccataggagctcaggagtgaccgatgtaagaatcacatttaaattttaatgtgtcccgtttttaagttcttaggatatagtcagcctggacatcactggaaaacagagacatcaaattctgagggatgtagcttatttcatattttacattctagcttaggttactgccctggaacaatgggacccttaatgggtattaacttatattctgctcatgaaggattttaaagtctttgaataagggaattaattaaatttccactaatggctaccagaagattttaagggtggaagcctttaaattccttaattaaatttcagaactacaggtgaaattacagagtatatttataaatcattcattaaattgcagatctaatatacagatcaaatttctacaagtgtcatagcagtgaattttgtatttttttttctccatccctcttgaggttttgtgacccattttcatcagaaatagtgagttgcttcagcagtgattatcagattggagaggagaactgcccccaccctcatgcctcattccagagaatgtatcatatgttctgggggagtgcatgtaatttgaaaaagatgcctcggttattctgataccaggcatttctgcctccatctctcaaggaaccatatccgctttactactgggttgagatatactctcagtggaattaaatggtttgtacacaattaaaccatttatccttaagagaatagtcaggctttctgactgccatgccttctcttgttttcttgaccaaacttttttattctatgtgctaaggacagaaagtaacaaatgttcattactaacacactattgagggagaataagattgtcagtagaatgggcactcccagttgttaagcatcattcatgcaccaaacactgctctaaatgttacagacaactttattcttcaccaatgtaggatagcctttattacctgcatattatagacaagggaaacaacttcatgcaggcaattacctctccaaggacatcaaataaattcacagaaaagctgtattcaaatacaggctttgtcaaatcccaagcaacaatcttgatttagagatggctttggagccagcggcctgagttcaaatgctggttctgctgtttcactagccaggaaacttgcagcaagctaccaaacctctctcttctcagttttctcatttgtaaaataacgttagcgatgacagtagagatactaatatacctcatgtagttgataggaagattaaataatacatgtaaagcattgagaagagtgtctgacacatggtaggaacaaaataacttcttctttttttaatcagacggcaaacttgatgtcaattctaactgtgttaatgaagagcaaccagaggctgaagtaggtatctctcaaaaggattccaatcctgaagattccggggaaggaaagaaagaatctcttgaaagcgaagctgagttggaaggcttacaggatgctcctgcagggccacaggtgtctgaggagtaaaagccagagcaagtgccagtgtggatgatcctcaccctgcaagaagctggaaaactcctaggaatgcattgtcctcaccttgttatacctgcgtggcaccatggcaggattccacatttcatagaatacaggttttcaagcaaacccctgttgaccatgccctaatttcctattgatttctgttctataattgaatggatattcctatggaaaattttttgtttcaaaatacaggaaaaacattcctattacctttctgaggctggctttccagcaattgtttcaaaggaaaatagatccccttaaagaaaaaatacaggctttagggaacaaagggacaagcagaacaggtgtggaagagagattttcaggaagggaaaaatttatagctacagagggtagttagaaaaatcataacttatatgtgaataaaatacatataagcagcatttacggtagtggcattctacttattaagatgcaatgaaatgaagaaaggctttatgttcaaggacctttgccatagttcagctaattgtagttttatatagaaatgatcctgaacactctgaacttgacgtagtcctgcggtgatattctatctgcagtatttgtacctccagaatggcagatccctcagcaggaacaaaggcatattgacggttctctcagcgtatgcattaaaaaaggtacttcctgaaacttttgattcaataatgactaaacatactatgtacacaattactgtaaggctaattcacgtgccatactccacctgaaagcctgagttatcttgctataagcttttcatggagcacttcctttccagaaactgatttgtaactcatttagagaatgtcctggcgtcggtttttagcatatgtggtatttaaacagagctagaatgtgatgtctgaagataatgctgcatttctgggtttcttgtgtggattttaaaataaattgtgcctacaaatat

SEQ ID NO: 37795 - DNA, 6369 bp, Homo sapiens
gaggcacagacagaggcgcggaggctcggagagagaagacgtggagggagggacagagcctggacagcggtggacacggcatcgtgcgcggggaagagggcagcacgcagcaggcgccgagcgccgggcaccgagaagggcagcccgggtgatctccggccgtccatgcacagagcgccttcccccacagccgagcagccgccgggcggaggggacagcgcccgccggaccctgcagcccagactcaagttagtgggcaaagggaggcagcggggagtggagatgggtggagctggacttgggaatggggtccagagggcggaggtcgaggggaggacgtggggaagcaggacgggggtggggggtggagactgatggaaaagggggtgcgtcttcgaattagggggccctgggagcaggcaagcatctgatgaagctggatatgaaagagtagtacccaaatctccattcctggtttactctgtgggctccatctggcctaagagccccctgcaaagaatgtgggagcctccaagcaccaggggatgccctggagctcgagctggcatcagtgcggaaggtggggggacgctcagttgcctcagtccctcgttggcacggagcgcgcgggcccccggtgcctttgagttaaaggagcatcagcgggggaaagggggggtgacgagggaggcagggaggccttaggcgttccttcccatatctgtccctttattcacagagcggggaggggagtttcagtgtgcagccccttcatcaagaggccttgagccgctcccccactccacttgaagatgcgggtggaaaatatgggagaggagagtaggcgggagcccctgggcggttttcgcctacagacgctaccactgtgggagtgtgtgtgggcggaacggccccggagcagaacaattgcgcccctccccctgccacggcccctgagctgaaggaaaaggctgaccgaggaagtggggagtgtcactgctaggagaggggccactgaggagcactgggcagcctggaagggtggagaggttctgaggggagagaggaagcgtgcgttaagaatgcttaaccaggccgggcgggcccggtggctcaggcctgtaatcccagcactttgggaggctgaggcgggtggatcacgaggtcaggaattcgagcccagcctgaccaacatggtgaaaccccgtttctactaaaaatacaaaaattagccgggcatggtggcgggcgcctgtaatctcagctactcaggaggctgaggcaggagaatcgcttgaacccgggaggcggaggttgcagtgacagcgccactgcactccagcctgggtgacagagcgagactccgtctcaaataaataaataaataaataaataaataaatgcttaacccctgggaaaagctgagcggagaagagtaaggcaccacctggctcactgagtgggaaagccagggaaggtgccacaccctcccttttagccacctggggctgtggccccttcacagggaatgaagctggccagcagcgtccactgtgggggagactgggctcctacattcactttagtatgggtgacttcacttcagtgttgagactgctgagtgtttagaggggaaggtgaggattgtgttttgggggagagggaggtccagccatcccaggtcggtgctggtcagcctcagcgctcaagttcttcttgccccagaccaaaaagataaaagctgaagataaggttgtaagacgcttcgactcctacagacacaggccactgacttttggggcttcgggccagtctaggacggcactggcttgtccatgcctctgagcagtgcctgattctgagagtctgtactcagacctgggcactgggcaggatagcatccaaatgagggaggggaagaaaagcaggcaggaaagagggaacaattgttagtgtgggttggtacccagtagggggacttgcaccgactgcctctctcttgtgcccctccttctcaggcccagtgcccgagccatggcactgcctcggacgctgggggagctgcagctgtaccgggtcctgcagcgcgccaacctcctttcctactatgagaccttcatccagcagggaggggacgacgtgcagcagctgtgtgaggcgggtgaggaggagtttctggagatcatggcacttgtgggcatggccaccaagcccctccatgtccggcgcctgcagaaggcactgagagagtgggccaccaatccagggctcttcagtcaaccagtgcctgctgttcccgtctccagcatcccgctcttcaagatctctgagactgcgggtacccggaaagggagcatgagcaatgggcatggcagcccaggggaaaaggcaggcagtgcccgcagttttagccccaagagcccccttgaacttggagagaagctatcaccactgcctgggggacctggggcaggggacccccggatctggccaggccggagcactccagagtcggacgttggggcaggaggagaagaggaggctggctcgccccccttctccccccctgcagggggaggagtccctgaggggactggggctggggggctggcagcaggtgggactgggggtggtccagaccgactggagccagagatggtacgcatggtggtggaaagtgtggagaggatcttccggagcttcccaaggggggatgctggggaggtcacatccctgctaaagctgaataagaagctggcacggagcgttgggcacatctttgagatggatgataatgacagccagaaggaagaggagatccgcaaatacagcatcatctatggccgtttcgactctaagcggcgggagggcaagcagctcagcctgcacgaggtgagaacccccaggcctcctaggattgcccttgacttccaggtctccagccgcttacctctgcgagtttctacagtctccgactatctttcattatctcttgaccaggaccccaggccctgatcccctccccaacaggcccctaccccagcggccgcagtgcttccatcctcagctgagggggaagcagagatacaggcagcaccgagctgttcagctccttgtcactcaggaccccacaggagaggaggaggccccgggcattcctaggaagctgtgggtgctgacctctgtcttcccacctcagaaagctcccatgtagtgtcaaaaccaaagcaagcgtctgatggatgggcctcatttgtccaatggtgaaggggtgtgaggaggtctggtgaggcagcggggaagttcgaattctgactctcctggctgccctccctccacagctcaccatcaacgaggctgctgcccagttctgcatgagggacaacacgctcttattacggagagtggagctcttctctttgtcccgccaagtagcccgagagagcacctacttgtcctccttgaagggctccaggtgagaccccttccccaggtccttcctggactggaatcctgctatggagttagatcatgtcctaaccttcagctcaggcagctctaggcctgcttcccgcccacctggatgtcctgcttttggccaagtcagcttgtctcaggtctggtctctcctcccatccatgtcgggtccccccaaccccctacaacaatagtgcttgaactagagactctttctcggccagcttcttggcaaaggttttaaataacacatgcctctggctgggttctgtgctctgccagtcgagtggccctcgtcagcctcatccactttattcttacccatcttttcaggcttcaccctgaagaactgggaggccctccactgaagaagctgaaacaagaggtatgttttccggggtgcatataggggcactgggcagccttccccaatcccctcccttggcaggtcttcatttccccatgttgggcatccacaggttggagaacagagtcaccctgaaatccagcagcctcccccaggccctgagtcctatgtacccccataccgccccagcctggaggaggacagcgccagcctgtctggggagagtctggatggacatttgcagggtgagtgtgcctcagaacacttttctcttcattgagggtgggggagtaggggagggggttgggggaggagtgagccaggaggcagtgcctgaaacagggttgggagacctggctggagggggggcagaagggcctgtgggctggctatgtggttgagggtgggggttccattggctgcagccccttacctgaccagtgcccatgcccacagctgtggggtcatgtccaaggctgacgccgccccctgctgacctgcctctggcattgccagcccatgggctatggagccgacacatcctgcagcagacactgatggacgaggggctgcggctcgcccgcctcgtctcccacgaccgcgtgggccgcctcagcccctgtgtgcctgcgaagccacctctcgcaggtgaggcagccagcagtgctgtccccaagcaccccggccactcaggccccacacagcaattctggtgtcctggggccaggtgggaggaagagggatatagtcgtcagagagggcagtaggatggctgggctccagccagccaggccttggggtgcagagaggcagaccctgccgagctgctcccaccatggaaagtctggtcctagtgtagatctgtgaaaggggaactggggaatggggggacagagaaaagaggatgaaggagcaggaaggaggagcatcaataagggaagctcagatggcacttccaccaacccaggagtggggagcaggctaggagttgtgggtatggggatggggatgcccagcttggaagcagaggagcccaaagcagtgatgctttgtgtgtggaagggggaagagggagtgggcaggcggagggccgggcagccgctgggctgagagtgacgcagcagacaaagccaccaaccctggcttggtatttttaaactgtgcgtgggtgggaagtgggggcggggactggaaggggggctcttcttgagggaggagctcggaggctggcttcctgttctccctctgatttggctaccaaaaaacttggggggccatggtagagtggcctgggaggggcctgggagggggccagggatgagtgggggtggcagagcttgggaaggggggaggggagaggtcagagccaaaccacccccgcagctcctgacagaaccagaaattccagcgcaaccgaggaggcgggagagaaagagagagagacagacagagacagagctacgcacagccagggaggggagggggctcacacacatgggaatggaaccccccatacacatgcagtgggcaggaggcagtaattcaataaacctaaactgagcccatcttcacagctttctttgcccctgcttctgttcccaaccacctctgtctgcagccagtcaccctgcagtctcctaactgcccccttttccctgcagagttcgaggaagggctgctggacagatgtcctgccccaggaccccatcccgcgctggtggagggtcgcaggagcagcgtgaaagtggaggctgaggccagccggcagtgagggttggactggtgtcttcagacccaggacctcagacttctggctcacacagacccccacgctctccatccccggaatctagtcacaaccctggatccttcctctgcccttctcctgcctccccacctgctccatgggcataagactgtggggcttcaagcaataacaagcagaggcctggagagaggacacaaggagggtgcgtggtgccctcacccctgcccagagcgagggggcaaggactctgcctccagggcatctggggttttcccctccctcacacaacacactcccattctctttaggtttgcaccagtggtgtgagcagttggactcagtttggacaagggggaaagggggacttccctgggaaggtccagctaaaagtggcaacatttgcccccagaattgggggcctgggaacactggacctgctccttctcccctctccttccccgtttttgtgcttctggtttgtttctttaattaatttaacaagtgctgcagtttgccctcccattcccatctatcccccaagtcctttgcaatttcttccctgccctacataggggcggtgggtgtgggatcccttcactggccccctcgggaggcctgggttggactcagggtctcctccagctgggggctggaccgcagcacctatctgagcagttagagcgtctttcttttcagattgtgtacagtagattatttattttgttattttggaataaaatttattttatggcttagg

SEQ ID NO: 37796 - DNA, 88382 bp, Homo sapiens
ggcgggggtgggcgggcgcgccgggcggcaggtgtcggcgtcggcggcattcggcggcgatggagcggccctggggagctgcggacggcctctcgcgctggccccatggcctcggcctcctcctcctcctgcagctgctgccgccgtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgcagcgcgccgggcgaggacgaggagtgcggccgggtccgggacttcgtcgccaagctggccaacaacacgcaccaggtgagcgggcgccgggcccgggagccgctcgggtgcgaggtgccgcccgcgtgcccctcccggcccgtgcgccccgcgactcccggaggagaccccagccctgccgcgcccgcgtcccccgggccgcagccccgaaactgcggcgggcgggcgggcggagtcgggcccgggcggccggcggggctgtgttttgtcataggggaggcaatcttagacttccaccgcattcttttttttttttttaagttgtcaaaatctcttgaacatcgtttttcgtctgtataaataatcaggacccagtaacgctgttaggccccaggaaggtgaaggagtaattaactcttgagcgcttgcagaagttgggctgcgcagaagcaaaggtgtgtcctctctgggtcagtactttccgggtgggagaggcgggagttcaggaggcccgaagcagcgatctggtcaccgtgttttaatagttaaggggactagcttggaaatgagatggcaatatttatgtgatctcttttactgcttcagatttgaccttctgtcatggtacggaagtctgactagcatgtctatatcccgtggtgacaagattttcaatagttaagaaacgcattgcacatattctgctttgagccagctcttggtcaaaagactttcaaaattatgggatttctgtccctggggacaagcagctcaacctttgcacactactggactgacaaaactaattattaagaaagtcctggttccttgcttcagcacaacttgggcatctttctcctatttctctaaaattaacaatttaatccttgctagccacatttgcataatgtattttcaattctatatattttctcccttgcctgttttcctctttcaaagaaaatgaattgcacttgggggcagagatgggtggccaaggctctgtgccagcacttgtccttctgtaaccgtttttcagcgtcagccaagcctcagtctccctttggactgcctggttatctggaccatacttgttacctgtaatagaattctctgatctgaggacacaagacacaaatattcaggaataattgtgcttagtgtatcccgagcagcagctgtgtaaaggtagccaagctagtgctggagggtgagacaggttgggtagaatgagtactgggaagtcttcctacttgatgagaaaaaaaaatcgaatagacttccttctcacagtgggggattgagaaaggctttacaacactaatgcttaatttatactggaccacttccttccttgagctagctggtcacagcattcttgctccatatttcaaattcttctctcgctggttgacctaactttaggtctgctgctactcctggatttagatttactcctgtttttctttttctctttttttgtgagatagagtcttacctcagcctcctgagtagctgggactacaggtgtgcaccactatgcctagctaatttttgtgtaattactattttttttttgagatagggtctcactctgttgcccaggctggaatgcagtggtgtgatcacagctcactgcagccctgacctcctgggctcaagtgatcctctcacctcagcctcccaagtagccgggactactggtacatgcacccagctaattgttcttttctttctttctttctttttttaagaaacagggttttgccatgttccccaggctggtcttgaactcctgggctcaagtgctccacccaccttagcctgccacagtgctgagattagaggcgtgagccactatgccctgcctggatttattccttgagtcagagtcttcctggttagtttgaattgatgtgtcatttgtaatatattgattccaaagaaagaggttgaaaaaactggctcaggggttctaaggccaaatctgtggaagagtagacctaaaaccactcattctttgaagtccacatgtaaagaaattttcttctatttctttcatttagctgtttgcaataatttttttttagtttttctctcccagtctttttttcagtgaccttatttaaaatagctattttggctgggcacggtggctcatgcctgtaatcttatcaatgtgggaggccaaggcaggtggatcacttgaggtcagaagttcaagactagcctggccaacatggtgaaaccctgtctctactaaaaatacaaaagttagccagacgcggtggcatgcgcctgtaattccagttattctggaggctgaggcatgacgatcacttgaacccaggaggcagaggttgcagcgagccgagatcgcaccgttgtactccagcctgggtgacagagtgagactctatctcaaaaaaaaaaaaaaaaaaaaaaaaaaaaaagtttttgcgtttgttagtcatccgtggtctcttcttcagagatctcatcctttctgtatctggttaaaaaaaaaaaaagtggagcctttgtttaatatcatttaccttaaaaatggttaagtagtacttcttaaccaagaattgttatgtagtagcctgttcttctgtttatttatttggttttagaagtcataaaaaatcctgaactgtattgaagagatctagtatttttggaccgtttataaaacagtgtgaaataaaagcatcagcatgacagaacaactttttatcagagatattgtactttgtacaactggggaaggaaggtacatgtagaatcatttttcctacataacatgacaggattcgagtcccaagaaaaagcaaaagttcatggttctcttatttcttttaacttggtcctgtttcatttcaagccacattaattcacatcatcaatgtatgtgaatgccctccaaatgcctagatctgtgctagatgctggggtgccaagatacaaagaaaagatcattcagactggagaatgaaaagcctcagaaggttatagcaaactactagacctgtgtctgtggcttatgaggatatattagcatttaacctgtcttctcaagaaagcacggtaaagctaaagcataatagtgcgtttatattacggtttaaggagaccggtgtcctgatgaccactcaggcttctctgtccatgaaatccagcaggtttttctctttgcccaagcctccctttttctctctaaggttttttttctcatatcatttcttttcaatctattaatttaaaatatatttaaagtgcattgggtttattacacacagcatatattttttcacatagaagtcctaatgattaagtgctttattttaggagttgaggcaggagaggaaaacattttcctttctagttacagtattacaagttagctataatagactcatgggaaagtggaaataaaaaatactggctattactaaaaaaacaaacaaaagggatgacaagaaaacgaaggagaaagataaatagttataactttccaaaaattatgctccctaattttgttctaagggtttgacttaccatggtaaggtggtatagcactgccttatctggactgcctgcatttgaaccctggccatgtcactgtgtgatcctgggtgagttacttaagttttctgtgtctcagttcctaatctgtaaagtgaagataagagcacttaatttgtagggtggttgtgagaattaaatgagtgtgtgttaaattatatatacataatatatacgtatatgtatattattgtataaatatatatttgtattacataatatatgcatatgtaatattgtatttgtaatgagttatagtatgtattacaacatatcacattgtgttgtataatctatacatatgtaataactcattagaagaatgtctggcacataattagcactcagcaattagctatcatttataaatgctctcttcttagactcaataatcttccttttgcctggaactcaaaactgttttcatgccacatttttaactgattctttccttcagctgcttggagtattcatgacatgtataacctttgtacatgcgtgaaattgagcaggcctagaagactttattgttggttactaagttggattgcttcaaaacatttctgctgtaagcacccctttgagggtaggcatgaaactgtcttaaaggaacagatgaaatgccttggccagagttgtggtggtggctgacataatttccttacttctcattcctgtgtacagaccatttgacaatttccttaaaactttttaaacttatgatgaataaagccaggaactcttgcttattttctgtcctccctctgctcctgtcactaactacttctgtaaacataacttcccaacttctactccaactttaaagcatctggttccttaaataaacaggccctgtagagaggccgtgttgtatggggtgtcagctctgggaagaatgcgtgtgtttgtttgctggctctggcagggttgagtccaagctgacaggactgagtgtgcctgtcagaggcttcagggagctgccgctgaagacctcggcctgttgttgtgaatcgccagacctttgtaacacccggaagtctgaaggtcagtcctttaatgccccggaacttcctaactgcctcatttcttccaatacttggcctctcttcatcctaccttccctagcacccccagccgtctagcttatttaatagtctcttgagttctgtttcttccattcagctttggatcaaggagtaggaactctgtaggatctccttcttggtcctggttgagcagagtgagcgaaaccttcatgaagagtcttctctcatgcaatgtatagtcagacctttagcccctagagggatgttaaaatgacttatgcattggatatttcagtaagaagtatcagcagatttgatgaagtgtaatttatctggggaaaggttagtcttcatctgaagtttggttgggatgagagtagaaagctagccaggtatgacagatggctccaagggaatgcagtgttaacaattaggtaagttctctgctgactcaaatgtttggctctgtgcacagtgatttttaattagaaatctgagtctcatgtctgcttgtggaaataattggaagaaggcttatgttctgttcaatttctaatggctattttctttttgtgattattaacaacaataataggctttctatcctgctgttttgatcagatctttcatgtcagggtcacagatactattagcagtttcttctgcactctgccagtttccagtcaactctcgtcaacaggcattgggttctcagtgggtgactgcagagtctgcgttccccaactttgtcccagttggcctgttacccttgtgtgaccatcacatgctgggcagtgcttagcaccaagttgtaatggtcaggacgggggagtaacgtttgttcttctccctccttcctacctaatcctacccctcaattttttttacagaaagtgaactatgttttgaggctgcagaaatgaggctcagatattttatataattaggagctaatattaaggcagacaaagccatcacatttgacatgtaatttaaaatacagcttttctagaaacaacaaaactgtggcaatggctctgacaatattatgaactagatactgcatttgtagatttctacaagtttcagttccctttctctccttttgtcatcagtgtttttattgcatcttttacttctatttttaaaaacttggtgaaaacttgttcttcccactatgtggtctcagtgatttgtatgcaggtggatttgaggattaatggggcttgaagaacaagctgatcaatttcagtcagttctaggcagcttttttgttcttgtttcaatggtgactgcagtcaaagttgggttagtaatatgttgctttgagatagtttggttgaatgaatgttcatgacagattcctcatacctatgaaaatttttaggtgaaagatggaggctgtttttccttctctatccccaatctcaatctcaggaaaccacagtaaaaacaaaatccttccactcagaacctgtcgtgttttgccgaggaagttttctgtgaatgtaacttattttctgttttgtgttttagtctctggccctcgattcctcatctacagcacaagaagttttggactagctttaaaatttctttcaaaaattctatgattcatatgggagaggccagaggttgtgatcacaaatgttttcctggctgattccaaatttagaagcaaactgtggctgtttgacttcccagtcaaacttgaacatagcatggatttcacatttaggggtgttttactaccacctccagaacttgcttcagtgaaatatgcatgttcttaaagatagcaggagtactttttttcatgtagttatgaaagacatttttctcttttattttgggggtaatattttaccgtttgttccttgttggctgaaaaatctaatgctaataaaagctactagcttgaatagtccaaaagcaaacccaacagatagcagtaaattcatttttctttttccctttcctatagtactctgccaaaactggggctttttttcttcatcctggctgcctgtgtgtttgaaaatagatggtcagcttaccataaatatattcacatgtagaaacttatatgtgattaattggcttgatttatttttatcagaagaaaacgtatgtatgttccttctctggcttatgaatactatccgtcttatgtttgctttggataagcattttagtcttcctgtatgtcctaaaacgcgcgcgcgcacacacacacacacacacacacacacatacacacacacacacacactttctaatattgtactgaagccagtttgcaagtctggttccacagtacaattgctctgaaggaccaggagaaattgaactgggaaggaaaatttgtattaacttcaataattcccagacaagttagttcaaatcatttttatctagtatttgctatttgtcacaaaggattcaaaacataaatatgttgtatacaaaatctcaaagagatgtctcaatacccagatttgggtcctggctctgctgcttcatagctgtgtgattatggaaaatcacttaacttcagtggtctttacagttgttttttaaactagagcagcagctcttaggattgtttggagggtcaaatgagaagttttatcaacgtgttttgttaaaggtaaagtactatatagatgtcattcatttagacacttactgagctgcctgccatgtactgagtggagtccagacctgtgcataaacaaagcaaagcactggggctatcttaaggatttaggtgttcagagatgtttcactgggagtttggaagaaggcttgaccactgcagtgcagtgttctgggaaagccctctggctgaagagagaatcaaagtggaggtgatttttagggagatctgtaacggcacgaaggaagtaggaaaatccaagatatgttcaagggatggtcaacagaaactttattttagggtgaggtagttgatggggagtatgactaaggtttccaggaaaacatatagggaagttaaaaaaaagatagctcttttgtgggggatggaaagagaggaggggcgtgggtagtgagtttggcaaaaggacttacttgtgaaagagagagttttaacagatagtgctagacatgaggctagagctggaggaaccagaggtagaaatggggagccaagaagagttcccctttcagaggccggccattgctttggtcttggatgtgaaggtcccagaggaaagcagaacagaaggtgaggcagaccatcctttatacttgaagtgctaacgtttccaaaaagcactcctaaacttctggacctggttgaagaagaatgtgagccaaggcatgaggaagccaggagctgtaagacagtgatgcctatgaacagatttttctgaacatttgtgaacaaggataaggttgaactcttgctgataatgtgcttaatggtttgaatcatggattattgggccgattagctggtcagagcccttttgctgatgcggctggctgacttgcttactggccaagagctgggagtagaacacagatgtcccaacatggtgctgcatttggaagtgtttcataggagtgttgaaatcaatgcatttgctttagggataaggcaaagttatgagatcccagttataagtaatatagttgtgaattctactctttttctcaaggtcatagtaccctcaacagagctcaactagcctttctaggcctcagtttcccgtcacataaaatggaggattatcatgaagttttgaagggaagatatatgtgaaaatattttgaaaccttgaagtaccgtatgagtatgatttgtataattccttaataaacctgctgatgtgtcacagcccccacagggcctgcttgtcagccaggtgatcctgatagatacagcccttgagccaaaccctgaggagcatgtgtattaaagcagacggatgaggcataaatgcgtttggtttatcacttggcagagttggatgacaggcttgggtgggggtggcaagaattaaagtgagtcaagattggcagaaatgtaagacgtgtatgtagtggttttcttctttttttaagcctttgtgattatgtcaaacttttgttaatataattgatgatggtttgaggcagtagtttgggggaacaggatctcaggtattagatctggattcaaacttcagtggtgaccatggacaaattaacctctctgaaccttagatttttcatctatgaaatgggagtactaatactacctcttagggtcattgtgaagatagtacaggatttagtgtatattcttttgttgaggatttcttgtaatgattttcattacaaagcttctgacacattaccagttagatgcttaaatatttgtacatgtgcttaatttttttcatatctctaatatttctagagaattattataggtactcacaagaactgcatctggattaagacatattagccctggctaagcagggtgactcacacctataatcccaagatttttggagtctgaggcaagagaatcacttgagcccatgagtttgaaaccagcctgggcaacatagtgagaccccatctgtataaaaaaatttttttaattagcctggtatggtagcatatgccggtagccctagccacacaagagtctgaggtgaggggatcacttgagcccaggagttttgaggctgtcgtgagctatgattgcgccgctgcattccagtctgggcaacagagcgagatactgtcttccaaaaatacaaaaaaatttattaggggtaggtagtggtgcacatctagagttccagctatttggaaggctgaggcaggaggatagcttgagcccaggagttcaaagctataggacactgtgatcgcatctgtgaataaccactgtacgccagcctgggcaacatagtgaggtcccatatctaaaaggaaaaaaaaatgtactacttgtatcactggactcaggatgaaaaaagaggagggtgggagataggtttaggcagagatcatctattcaaaatgcctttctttctttttcttttttttttgagacagggtctcgctctgttgcccaggctggagtgcagtggcactatctcggctcactgcaacctccgcctctggggctcaagcagttctctgcctcagccccccaagtagctgggattacaggtgcccgccaccacacccggctaatttttgtatttttagtagagatggggtttcaccatcttggccaggctggtcttaaactcctgacctcgtgatccacccacctcggccccaaagtgttgggattgcaggcgtgagccaccgcgcccagcccaaaatgcctttcttgaagctatgggagatagagaagaaaataatcagattaataatcagaaaacagtaatcagatacctggtcatctggttataatagcttcaagcatatatggttaaatagtttttgttttgttttaaaacaaaattttaaattttaaacaaaatttaaaaatttaagagacatggtctttactgtgtcacccagactggagtgcaggggtgtaatcatggtttgttgtaaccttgaattcctgggctcaagtgatcctcctgcctcagcctctgcagtagctaggactacaggcacatatccctgtgcctggctagtaaataggttgaaataacttaaagttatttatttttatttatttattttttgagactgagtctcactgttgtcctggctggatggagtacagtggcatgatttcagctcactgcaacctctgcctcctgggttcaagtgatcctcctgcctcagcctccaaagtagctgggactgcagatgtgcaccaccacacctggctaatttttgtatttttagtagagatggggtttcaccatgttggccaggctggtcttgaactcctgacctcaggtgatctgcctgcctcagcctcccaaagtgctgggattacaggcatgagccactgcacctgaccaaattattttttaaagactataatttaataacaatttttcttccccttcattaagctttaatttgttaagagttaatggctctggtttaagttgatagctctgaaatagcaccttgcatatttcacccctttctttaactgagcagctgctgttagctttgcactctactgatctctgtgaagtttcaagaaatattagtgaaatgtgataggtacttcttaggaactttgcttgaaagaatagcggaccagaatgttgatggaattattttttattatgtgcatattgcttttttaaacttttaacaattatttaaaaatagagatgaggtcttactatgctgcctaggctggtctgggattcctgggctcaagtgatccttccgcctgggcctcccaaagtgctaggagtataggtgtgagccaccacacctggcctatgtgcatatttatttaacctactatttcaccacttcctggcctatattaaccctctgttccagttaaagtgatcttctaaccagtcccttcagctccccatatggtctgttgcttctccatctttgttttcatgggtttcttcctgtctgaatgcccttctagcccttgttagtttttcctgttctcttctataattttggactgtgccatgtaatacaacacttctgtcttgtgttcagtttcatttatagaagttttactccctaaatgataaactccttaaaggtagggcccagcttgtactatgagtccttcatcacttttgcctcccacaatgctgaagaaagagtagtcatgaaatgtgtagtctggagtcagacagacatgagattgaaaccttgctctgccacttaccaactttttgactttgagcaaattacttaacgcctctgagcctgctgctttctttataaattaacagtgagtaccttaatatataatactaatataataagtgcttagtaaaggttaaatattattgtttttctttaattcagcagttgtttgtcgagcacctatacacatgaggcacttatcaggtcctgggaactggtgtagaacaccagacctctgccttgatggaactttatggaccaatagagaaaatggcactaaatgatatataattataaatgtagtaattaccaagaagaaaaatagtaaccacaggaataattgacaggtcttttttagtctggggcattaggaaagattcactgagaaattatttaaactgatacttgaatagaattttgccaggaagagtatctcaggcagagagaacaacatgttcataaggcctgggtctagaaagagcttggcatactccaggatctggaagaaggccagtgtggttgtagcagagggaatgggggaaggggttagcgcccacacccaagggagaagcagcaagcctttatggttctctcggctcagtcagctggcaactggagcatatctctctgtcactttcttttctttaaaatgaactaagatataacaattaaatgcaaaaattatgaaatgtagctatttattgagaaatgaattgtttcatggaagtgactttcaaaaactaagcctacccttttataagtgccaaaggttttttgtttgcttgcttttttaatggaaatctttctaatatacttctctgccttcttggtcaacagtatgagcctaggtcactaagaagagaataaattatgctataccaggactgctgtggtttgaatgtgcctccccaaattcatgttttaggaacttaatcgtcaatgtaacagtattaagtggtgggtctttaagaggtattatatcatgagggcaccaactcatgaatggattaaggcctttatcccaggagtgggttaattataatagggagagagtttggtcctatttcttttctttttgttgttgttgttgttgttgagacagagtctcactctattgtccaggctggagtgcagtgttgtgatctcagctcactgcaacctccgcctcccaggttcaagggattctcgtgcctctgcctcccaagtagctgggattacaggtgtacgccaccacacctggctaatttttgcatttttagtagagatggggtttcaccatgttgcccaggctggtttcaaactcctgacctcaagtgatccacctgccttggcctcccaagtgctgcaattacaggcgtgagctaccatgcctggcctggtcctatttcttttctgtgtctcctgtgcttgcttccactttctgccatgggatgatcctctgcagatgcctatgccatactcttggacttcacagcctccagaactgtgagctacataaacgtcttttctttataaattgccctgtcttggatattctcttatagcaactgaaaatggactaagacaatgactcacagtattttaatgtggtatgacatttaatacccacaggagctattgagatatgtggggctatcttctcccatttcagatgtcctggattataaacttaatgccattgtctgcctgtttgcttctttgctgcagaaatgatattccctttgtaattcctcttgtaatatcctcttcctcttgctgttgtccctgtctgtctctacatatatcaccctcaaatttgatttgcttcctctctatgctgagaaagcagatttctaatattagacaattctaaccggtttaataaattgaattagagtgatggtctgcaaatttctcttagaagtcaaatgcacagatttttaatgcatgatagtgacatcagaggtctccttgcttcttttcggtgagtatccgggttgctgaggcatctgaatcatggaggttgctgttgcccctctcctttgaacactggcttattgtggagcagggagctgatctcgaaaacaacaaaaacccagatacatagcagttgaaaagcaaactgagtggctaaattattgatgagtcatagaattttaaagcttagagagactggaaagattgtcattctagcccccgcacttcggtaatgatgtcaggttgtgctgcccaatttcacgcagcgttttgtagagctggaaataaaatttgggttgactgattattagcctggtactctcctctgtatcatgctccctcagaaaactctgaataattaaatagatttggaaacttgtacattattttgtagttaattttttcatttccaagaatagacttcatgagaactgggacatttgtgatcttatttctggctcatgttttatgattctagcagtgcctaatttaacagaactatattctgttaggattttcttcctgcctgcaaaagcatcactcaggttgtgttctaggcctcactggagtttggaagcctaatcctagatgggcagtctgtatgggatcaccgatgccttgcctttgtaattctcagttttacccctgaggaaatggattcccaacagataagatgatttgtgcttaccttcccaaccagttagttactgagctaggcttaacgttcttttgtagttttattttcattgtgacaggctgacttctgtagattaaaagtctagtatgtttagcctttatttttagatttctgtacataagatgcctgttgataggttataatcttcagtagctcagagcatgtattatcacagcacatggtaggcatgcagacatatttgttgaaagagggcaggtatgtgaagaatgccatcattgaattcacttccttctttgcttgtcaaaaaggctgctcctgatggggtcaggccatcagcaagtggcttttaagctgggccttgccttgggaaaactgacccacatgcaatagtgcaggtgttagttttttcagtgttttatttttgatcatgtgtgtaactaaacatgtaagtttctcatgactggatttttttccaacctacagtgactcttgggaccaactttaaattttccaagcttatagtaacagtaatttaatttggtttctagtttaattagatgggaagatggttgtttccatgaagaatcttgtgaacagaacctagggggtattcagacgatcgtagaaatgaacattgtgctaattcatgaactctaaagtatgggggccccctgctttaagatggtaggcaataaatgcttggatgagtcttatatcatccgttttcaaggtggatgcattttagagaaggtagtacaagctgtcccctgctttctaacataatgaattcctgaaaacctatttgacagtcagatggcaactataaatgccagccagttacttctgcttcccagagctcccctaccgagggcagtagatggctgttggtaccatctgggacaccagaaatcactgttcaataggtaatggacaaaaggctctgaatgtgactctgaaaaggaagtttagtgttatcagtcattaatgatattaggaggtctaccttacatcaagaccacctatgttcctgtgcctcagtgtagcaggggctctttgacctatcctgtaaccttctggtatatctgttaactagtgtaatataaataagaataaactaacatgcgtccaggcgtggtggttcacacctgtaatcccagcactttgggaggctgaggcagacagatcacttgaggtcaggagtttgaaaccatcctggccaacatggtaaaaccccatctctactaaaaatacaaaaattagccaggcatggtggcatgcacctgtaatcttagctactgggaaggctgaggcatgagacttgcttgaacccagaaggtggaggttgcagtgagctgagatcatgccattgcactccagcctgggcaacagagtgagactttgtcccaaaaaagaataaatagataaactgatatggtctatgtgtactttttatatcaccctttcctttatactttttctttccttccttttttttttaagtaaaaatagcttacttatatagttttatttttaaaatgatttctgccaattggaggtgggatgagagtaatttatgcactctagaaaaactataaagaagagtgcacccctatcaattctataataccacttaaagacagttgctattgatattttaaagggtatccttccagataccttttttttttcttttttaagggacaatcttgctctgtcatccagactagagtgcagtggcacaatcatggctgactgtagccttgacctcctgggctcaaacagtgtatctgggacgacaggtgcttgccaccatgcctggctagtttttattgttgttgttattgttggttttttggaggcaaagtctcactatgtttcccaggctggtctcaaactcctgagcttaagcaattgttctgcctcatcctcccaaagtactaggattataggtgtgagccactgtgcccggcccctgataacattgtaaccataaatatgcacatatgatgtcacatgctgttttgtagcctgctttttactaatatgctctgagtatctttcaatgtcagtaaatacctgaaacattttagttttgggttttttaagatttttttaaacgtttcttctttttttccttgttcttgaaacatttttaatagcacctgatatattgttgtatggcataacataatttacttaacaaatctccagttcttcatttataatatacaggtatagtaatatctcatggggttatgtggattaaataataatgtgtgtaagatacctaacacagaagatgacatgtggggaatgttcaatagttgttagctgcagtaatcaccccaacatatgacatcttttataaaggtatgtgattatccccttatgacaaattcctaagaataggatttgctcaggcacatgatacggacgttctcagtttttatttgcatcaccaaatagctctccagaaaagttgcagcaatttatgtactcccacccaccgtagaagaaggtgctctggtccctatgccctcactggatacattttgtcaagtcttttaatctttgccagtctgaaaggcaaaaatgtcatatttttctttttctttcttggctcactacaacctctacttcctgggctcaaaccaccctcccatctcagcctcctgagtagctgggactacaggtgcacaccaccatacccggctaatttttttttttttttttttttttttttttgtggcgacagggttttgccatgttgcccaggctggtctcaaactcccaggctcaagtgatcctcccgccttggcctcccaaagcctgggattacaggtgtgagccactgcaccggcctgttctttttgttttagagattaaatagcttttcaaatgtttattggccatttctttgtccttctatgaattgggtgctcatgttctttccctattttccgaaaacctgtttgaggttttggcctgtttcctactgatttgaaaaccctttctatattaatattttgtcatgttacaaataattttatattaattgaaaccctttctatattaatactttgtcatgttacaaatatttttttccagtttttttcagctttctctttggtgttttgcaatttaaactttttacatagtcagagtaaatccttaagtatgagttctgatttttgtaccatttttgtaaaggtcttcccattccaaggttataaaaatattcgcttatacttctagtatcattttttgacacagggtcccactctgtcacccaggctggagtacagtggtgccatcacagatcactacagcctcgaactcccaggctcaagcaatcctcccacctcaacctcctgagtcgctgggaccacaaactcatgctatgccaccacacctggctattgtttttttgtttgttttcttttttggtagagacagggtctcactatgttgcccaggctggtctcaaactcctgggctcaagcagtccacccacctgggcctcccaaaatgctaggattacaggggtgagccactgtgcctggccatttctagtatttttataatttaatttttttacatttaaatcttcgccctatatggaatttatttaggcattttaagaagggagttaggaattcagctttttattttattttttttccaaatagccagtttttccagtgttcttataccactaacttgaaatgctagctttatcatgtgctaaaagaaacctcatccattcctggatctgttttgctctattgattagtctattcctgcgccagtaactctgtcatgggattaataaatttttccaaaagtggcaataatttcatgctcatctgctcctggtagaatcaagctgacatttcacccagctactcttaaacttcttggcttctgtgcttcctatcctagggtaggattaggtcatctgaatgactgtatttgctctgggctcctcagggtactggcttttggactgttaagcacagaaacagcatatttacatagttttccttaattttgacctgtttctagatcatacgtttagctgactccttagcaatatgaagtgaccagatcgtgttctctttgtgccaaatgaagcttgtccaacccacagcccgtgggccacatgtggcccagggtggctttgaatgcaacccaatacaaattcgtaaactttcttaaaacattatgagatttttttgtatgatttttttttttttagctaattagctattgttagtgttaatgtattttatgtgtggcccaagacaatttttctgccagtgtgccccagggaagccaaaagattggacaccccaacaatctgcctcttaggcatgctacattagagcaacacagctattttttttttttctttttgagacggcgtttcactttgtcacccaggctggagtgcagtggcgcagtctcggctcactgcaacctctgcttcctgggttcaagcaattcttctgcctcagcctcctcagtagctgggcctacaggtgtgtgccaccacacccagctaatttttgtatttttagtagagacggagtttcaccatattggtcaggcgggtcttgaactcctgacctcaggtgatccacccgcctcagcctcccaagatgctgggattacaggtgtggtgtgagccatcatgcctggcctccagttattgtttaccagaaacaaaacatgcttcacttctccccacactctccatttgaattatcatttatacaactaacacataacatctttatatatatatatatatatatatatatatatatatatatatatatatatatatatatatatatcattcactctaccttctgttggctggactctctaacatagtactagatgtttttatatgattcattattttgatattatagaacattcttcggtaatactgtgtcagaggttttgggttttcccttcctatagggattattccgcctttcagttatttctggcaacaaagctttatcctctgctcatatttcatttattcttcttactttgccttgattacagcaattgagccataacttattggctcattattttcaggcctatgtatcatcagacacctttcctgtctaagtgatccagtggcctctctcagctttctttgggtctttcaagcaggagtactatttctaaagtgtcttcttaaatatatttccttttcactatttttattttccttctatttcaaccttaactttctttattctgaccttgagattcttcttattattattcttttaaatatagaccgggtctctctctgttttccagactagagtgcagtggcatgatcatagcttactgcagcttcgaattcctgggctcaagtgatcctcctacctcagcttcctgagtagctagaactacaggtgtgtaccaccatgcctggctgatttttaaactttttgtagcgatgggggcggggtctcactatattgcccaggctggtcttgaactcgtggactcaagtgacctcccacctcagcctcccaatgtgctgggattacaggcatgaaccaccatactcagcctgaaattctttttttattttaacaagtcttaatagcatttactgtatactcagcattttactagatggtgatattaatagattttatttgtggtgttctttgaaaattttcaagatacttgcatattatcttcctgtgtgttctacctgcaccgctgccttctctcattgccttgctcttgcttatatctgcctcccaactctgtaaactctgcttaaatctcagtagtcagacctttatttcttcacttgaaatttgaatttctcttctatatagactacccctgctcagtgcctctaaacacttcgacgtgttcagggcatctttaccaatgtttagctacgtgaagttaatggtaactacaatgggaaagagaggagtaaggtcaccatcatgtgtgaacatctaagaacacataccagtgtataacagtgtcttggctggctggaagagcataggaataaacgctattcagccattatttactgagacagcagtaaccgtgttagaaggaagattacatacagatcaataatgttagttcaggacaaacagctatcatgagttaaaaaaaatactaagaaaaagaaataatgttagtagcaggagtttgtgatagacttttacagagatgtttgtggagcatctaataaatataagaccttgtgctaggcctgatgggtaataccaaattatagcgtctgccattaagaatttatagcataatttgagaggaagacaaatatgtaaatagttctacatgtatagtttacatgtacatatagtttacatttatatataaatataaatagttatagtaccaggagtgtctgtgaatgctgtgaggataatgcttaggaagaggagatcactttgagctgtgataattacaaaccagaatggttggttttacagtgaaagatgggacttaggctgtctttcagatctttttcactggtatagtctgtcccctgtggctgtcaaaaagaaacacccacaatagaatgctgaggagcaatggacaagtgcagaaacacagaacttttcctttttgaaagttgcatttttcaacttttagatttaggggtacatgtgcaggtttgttacctgggtatattgtgcgatgctgggatacaaatgatcccatcactcaggtagtgaacatagtacccaaaagttagtttaccagtactcacctgcgtccctcctctaataatcccgtttctgttgttgccatctttatgtccatgagtacccagtgtttacctcccaatataagtgagagcatgtggtatttggttttctgtttctgtgttaatttactgagggtaatggcctccatgtgcatccatgttgctgcaagggacatgatatcattcattttatggctccatagtattacatggtgtatatagaccatattttctttatccaatccactgctgatgggcacctaggttgattccatgtctttgctattgtaaatagagctataattaacatagtgcatgtgtctttttggtagaatgatttgttttcttttggatatatacccagtaacaggattgctgggtcagatcatagttctcttttaagttcctttttttttttttttttttgagatggagtctccctctgttgcccaggctggaatgcggtggcgcgatcacggctcactgcaagctccgcctcccgggttcacgccattctcctgcctcagcctctccgagtagctgggactacaggcgcccgccgccacgcccggctaattttttgtatttttagtagagacggggtttcaccgtagtctcgatctcctgacctcgtgatccgcccgcctcggcctcccaaagtgctgggattacaagcgtgagccaccacgcccggccctttaagttctttgagaaatctccaaatcgcttttcacaggggctgaacattccctccaacagtgtataaacactcccttttctccacagcctcaccagtatctgtttttgtgtgtgtgtgtgtgatgttttagtaatagtcattctttctagtatgagatggtatctcattgtgaaacctgcatttttgaaaaatagtttcacttgctatagaattacagcttgactgtttttttgccagtactttaaatatgttactccactgtctggcttgcattgtaggaagagtcggctatcattctttgtttctctgtatgtaatgtcatcttttttgtggatgcttttaagatttttctctattgctgattttagattatttgactatgatatgatgtgctttggtgtatttttcatcgtgtttcttgagcttagggtttctgagcttcttggatctctgggtttatccttttcatcacatttggggaaattttggctattatatcttttttttttttttttgaaacggagtctcactgtcgcccaggctggagtgcagtggcgcgatctcggctcactgcaggcaccgccccctggggttcacgccattctcctgcctcagcctcccgcgtagctggtactacaggcgcccgccacctcgcccggcgaattttttgtatttttagtagagacggggatggtcttgatctcctgacctcgtgatctgcccgccttggcctcccaaagtgctgggattacaggcgtgagccaccgtggctattatatcttaacttttttttctgtctccagcccagcctcctctagatgccctgattgcatatataatcagctgcttgaagttgttctacttcaaaaagaatgaacagagccatcgctgagctgtagaacaactttaagaacatttgtagaaattgtagaacatcttctgaattgatagctctgttcattttttgtctttttttatctctgtgtttcactttggatagtttctgttggtatggcttcaggttcacactcacctcttctacagtgtctaatctcctgttcagcctatccagtgtttgtttttttgtttgtttgtttttgagacggagtctcactctgtcactcaggtggagttcagtcgtgcaatcttggctcaatacagcctccacctcccaggttcaagcgattctcctgcctcagccttctgagtagctgggactacaggtgtatgtcaccacgcctggctagtttttgtatttttagtagagacaagttttcaccatgttggtgaggctggtctcaaacttctgaactcaggtgatctgcccgcctcagtctcccaaagtgctgggattacaggcatgagccacagcaccctatccagtgtacttttcatttcagtcattgtaatactcatttctacaagtctaatttaagtctttttcttttctttctttctttttttttttgagacggtgttttcttgtcacccaagctgtagtgcaatggtccaatctctgctcactgcaacctctgcctcctggattcaagtgattctcctccctcagcctcttgagtagctgggattacaggtgcccaccaccacacttggctaatttttagtattttagtaattttcgtatttttagtggagacgggattttaccatgttggccaggctggtctcgaactcttgacctcaagtgatccgcccaccttggcctcccaaaatgctgggattataggcatgagccactgggtctttaaaaaattttaagtctttaaaaaaattttttttctttaacattctcaatccattctctaatttcttgtggagtacagttacaactgttgcaatgtccttatctactaattatcttgttatttctgagttagtttgatttttctcttcattatgggtcctgatttcttctttgcgtgcctggttatttttaaaaatttattttaagagacagggtcttgctctgttgctcaggctggagtgcagtggtatgatcatagctcactgtagcctcaaactcctgggctcaagagatcctcctgcctcagcctcccaagtagcgagggctacaagcatgtgccaccatgcctagctgatttttttaaattgtttttgtggaaatgggggtcttgctacattgcccaggctggctttgaactcctggcctcaagtgatcctcccacctcggcctcccaaagggctgggattatagacataagctactgcacctacccacctgatgatttttcagttggatattgtgagtcttagcttgttgggtgctagatatttttgtattcttttaaatattcttgaactttgttctggaacactggttacttggaaacagtttgatccttttgggtcttgcttttaagcatttttaggcgggaccggcacagcgttaagtctggggttatttttctttaccacagaggtaaatgtttctgagtactctacccaatttccttgaaataacgaggtttcctattatggttgctggtaacaggaattattcctgttcctgtgtgaggtctgaatattgttctctgccgtcctttcaggtaattatttccctggcctcaggtagtttcctcacatgcgtgtgctgatgggtgttcagctgaagacttggtggggtggctggggaggccccctgctcagatctccagaattttttttctgtgtaagtctttcttctctaatcttctgccctgtgaacctctttggcctccccagacgatatatcagcttcctctcttcagtttaggaagaactctggactctgcctgggtgcccctcccctgcactgtgcctgaaattctctccaggcagtaagccagttagctgtagggtcctccttgttcagttccttgtctttcaggaatcgtcgtcctttgtgcctggtgtccaatatcttggaaacagtcatttcatatattctgtcgttttgggtttttttttcttttcttttcttttttgagatggagtcttgccctgtcgcacaggctagagtgcagtggcgcaatcttgcctcactgcagcctccgcctctcgggttcaagcaattctctgcctcagcctcccgagtagctaccgcgcctggctaattttttgtatcttttttttttttttttgagacggagcctcgctctgtcgcccaggctggagtgcagtggcgcgctctcggctcactgcaagctccgcctcccaggttcacgccattctcctgcctcagcctccggagtagctgggactacaggtgcccgccaccacgcccggctaattttttgtatctttagtagagacggggtttcagtcgaactcctgacctcgtgatccgcctgtctcggcctcccaaagtactggggttacaggtgtgagccaccgcgcccggcccattctgtgtttttgttttgttttgttttgttttttattagctgtttccggtagaaaggtaaatgtgatccctgtcactccatcttgaccagaagcagaagtccacccagaaatgaacttttacatttcatactcatgtctgtcatggggaagttaagtgggcctggccttatccttttacttgggcgtcatctttttcaaaacttcataagtagttcttaaagaattcaatatttattgcgtgcccactgtgcactatgctgtgtgttagctgctgaaatgtatgggcttgattcctttaccagatggacctcaggtctagtggggaggacaggcaaggttcttgtggctacaattaaaagtgctgtaatacatattttgaaagatctaagatgccactgcagtgtagaatgacatgtacgttgtcttaaatattagaaatgattctggattaggattgatggctttgtgctgacttgtgaattctgtctcctaaccatgaccaggttgtctgccctttcctggacatccgtatttttttctcccattgaagtggcaggattgaatctgtactcttgggtccctagctctcctggatttatctcctttccatatgaccttttctttctgcttaacctttgggcctgctgtaacatctcatttcatttttcttttttaactttcaccagtataagaatgttagagactgaaatattaaaaaattaattacatttgctataggtagatgagtttttcagtgagtttgcccattttcaaaagcaaatcttcattggttatttggagtgggtgggagggacagcttaagggcagtagaaaaccacagttttgctagtaaatctggcctacatttccaaaggaactctttggatgatgagtgaggtccattaccatttcagttgtttcagtgaagctgagagttgccggtgacacgtgataatcctcctcattctgtagttgagcaataggaaaatgtgggtaatgccagtctgcattgactgggtcggctgtgtagagcattgcctgaaaagtaaaagttgcagtcctgattggctcaagactgatatcttacagcctgatgaagacaaccacgaattccagtgccataactgatggactttttcttttctcttagttatgacaaggaccttccttggaaagataacctgtgtttagatgactgtgatcttagcccttgtgatctgcctggtgcttgtggtagctctggatgttcctgtttttcctgaaggacctcattgatgtcatttcagacactatcctcactcaagagaatgtgaggttttgctatgtgtgaaatatcatataagacacactgctatgtcagtttttaagcctctggtttcagaagctctggcagccctactttttctcagatgcctggcaagcctgcatgtctgaatagcccttctttcctgcagaggctgtgagaagctctgccgagcatttgagagttaaccattatttacggagcaagacctgcgtgaggcactgattgtactaacttacaaaaattgtgtaagagattcttttgacatcaaaggtacttacggtccagaggggaaatcacatacgtgaattcggaagcccattcaagactgcaagagaaaattcgaagataaacaaaacagttcatgttttgagttctgtttctttagatttctatgtgggattggtggcttgagtgaccaagtagctggcatcccaaccatttatagacatgttctattttgaggttgagtttgtggtttggggaggatgtgtaatcattttcaacaaatgcttactgagtgtgcaaagtattcctgtggaaggcacagggagtaccaagaagtataaagttacattccccagcttccaaggagcttctcatatctgggagggcaaggcatgtttaagattttaaaatcttagtaagattataagtcttaagaaaaaagcataatcatccacatttattagaaatatatactgaactattaaactgtctaagaaatggggcttgggtggtgagcatgtggcctggaaaagagaaggatcttcactctttgctatatagactctatatagtatgtaatttctatatggtttgaaatttttgccaagtgcagttattacctctttggaatttttattttttttatcagttacaaaaattatagagaacagacgattgtattaatacatataatattaaccttgaatatctctatgtggtaggattatgagtgacttatctttattatgcgttcttataattgtctacatcttctttaatgaatatatattattgtataagtagagaaaggaagtatttgaaaaacaaaacccaaaaccacctacaatgattattataactatattttaacatgcttactatattttggatataatataccagctttcccttttttacctccttactctcactgcaactctagtaaggttgttttattattatcattattactattgttattaaataaaaaggtgaaacaaaggcatttgcttcttgcttctgcccgttgtcatttttgagtgagctagactagaagtaaaaggaatccagttacgaacttttcagctatactgtaaaggatgcccagaaaaatttaaattatgttgatttggttacaattacgcctgccagtgtgggctatgatcttttgttttaaagcatcctaaaaatactttgctatacctttatatttagttctgttggagaaagcaattagattgtcccatctcccatctccccatctggtgcagtaaagaaaactcatctgcttggcttactttgtgttagagagaatttaaatttccaagttatttgtgattcacattaagtagttaaatcccatccctcccaaattttgtactgggaatccatacccactttgtaattatgaacttaattactctgaacagtaataaagttcagatatttaaagaagccaaagattgaaggagagtggctgtcatttctaaattaattttttttccccttatagcatgtgtttgatgatctcagaggctcagtatccttgtcctgggttggagatagcactggggtaagtcatattttgagtctgttatttcagcccagcaagaagatgataacagatttggggaagggttaagcacctaatatcatttcttcctgaaactgtctttagcctcaatcacagaaaacacatgtttgcaagacagactttcaggaagttgtagttgtgttggttttgctttagaattgggaacatcttttttgcgggggggtggggacggagtttcgctcttgttgcccaagttggagtgcgatggcatgatctcagctcactgcaacctccacctcccgggttcaagcgattctcctgcctcagcctcccaaggagctgggattacaggcacccaccaccatgcacagctgattttttgtatttttagtgaagatgaggtttcaccatgttggccaggctggtcttgaacgcctgacctcaggtgatccacgcgcctcagcctcccaaaagtgctgggattacaggcatgagccactgcgcctggccgggaacatcttctgaccaccttcttccacggtgggaagatggacaccttttcagtccttggtggctgcttagcatcaagatgagcaagaagaaagatgaaagtgctctgtactgagaagggaagcgcacaatgcttggggaaacccctatatagaaacagaaaatgtccattaaaaacatcctggcacttttcctccaaattgtattgttcctgtgtcctttcctacaggtgtgttgagggactgtggtgcccatgggctcatggttgttcatctgttggtccctgcccctgccacaaaggaggtactgccaggattgggggaatggaaggaggatcagtcagctccttatccctcctgatatacagctgggctcccactaggaggacacgctgaggatacattggcccctggtcttaaatcaggacttgttgcctggctgtcttattatcctgcttgaacaagagcaggggcaacatctcctgccccctggtattccataatgcatgtgtcatagcattgaggcacatgatagttatattagaagcctaaagaaataaaatcttggtgctgaaaagcaaattgtaaatttcttattttgattaatttttaaactttcagtagaatttctttaagcatagttcagttttttctaaaatttgagttgtaccctaatttccatgatttacccatttatcttagatagttggtatctccaagaatttttttttttttttttttttttgagacagagtcttgctctgtcacccaggctggagagcagtggtgcaatcttggctcacagcaacgtccacctcccaggttcaagcaattctcatgcctcagcctcccaagaagctgggactacaggcaagcaccaccacgcccggctaatttttgtattttaagtagagatggggtttcaccatgttagccaggctagtctcgaacttctgacctcaagtgatccgtccgcctcagcctcccaaagtgctgtgattacaggcgtgagccaccgtgcccagccatctccaagatttctcatatggctttctgagactccctagactcttatagtaatccatccagaatcatttcctcatgcatagtttttggtagataaggtactgaaaaaatgaatttcatgaagaaccaacggcaaggagaagaaaaagacagacatacatgacacagtgatctctgtgagaacacccacgctattctagactctgtaaggagaaaagggaagagggttcttgcctgagagtatcttacaataatttggatacaaaatagttaaagccttcttttattttaatgtgtatttgagtagtcagcctcactgcttcaatggaggcaatggggatcatcccaacaaaatgagctgaggactttctcatcattctcagccctagtaactagatccttctagactttggggagtactacaaagtagggatatcaaaagtcttttaggtgttggcttaatctcgaacacatatcagcatgtgattggaatatcttttttatttacggaatgcttttttctctctccaggtcattctagtcttgactaccttccatgtaccactggtaattatgacttttggacagtccaagctatatcgaaggtgagatcaataacacgcgttggagcatttcactaagtaacattgagaatatagattctcccttttctagacatgatggcacgtaacagttgatgtaaaagatcttctagccatcctaagttttcaccagactgtcacactcagcacatgtttttgttgttgttgttgttgttgttttttgagacagggtctcactcttgtcacccaggctggagtgcagtggcgtcatcttggctcactgcagcctccacctcccaggctcaagccatcctcccacttcagcctcccaggtagctgggactgcaggcacacgctaccatgcccagctaattttttgtattttttgtagagacagggtttccccatgttgcctaggcttgtattgagctcctgggttcgaatgatccacctgcctccaaaagtgctgggattataggcgggagccactgcacccggcccttagcacactttttaacgtctactctttttttttttttgagcagggtctagctctgtcactcaggctggagagcagtggcgcaaacacagctcattgcaacctctccctcccaggctcaagccatccaccatcttcccacctcagcctcccaagtggctggcattacaggcacgtacctccatgcctgggtaatttttgtattttggatagacagggtttcaccatgttgcccagtctggtatcgagcgcctgggctcaagctgtcttcccacctcagcctcccaaagtgctaggattacaggtgtgagccaccatgcctggccttagcatctaattagcaactgaaagaagtatgaaaagggacctggttccaaggaggttggtttgacctgactcaggggcagaacaataaaggaagatgaagaaagagtgtatagtgctgtgtgtttgtgttcatttatatggatatttatttgtgggaaggtagtatggggtttaaaaagtctttctatttagtgtgagtacaaaatggttttttatattcctgaaatgaaaatcttcattgtactttcccagcaaatatttatacagcattttgaggcctaagcagattatttttaggtaagaaggaggctctcaggtcggacctaccaaagtgctttgtagtgttcacactggcgatgatggtggtaacatgtgttctggaaccacaacctatactgtgacattggtgaagttttagagttgtcttctcaaaggtatgacttggttaaaaagtaggttccgttccttagcagtaagattcaagaccaactaactcctagagattgctgaatgattgtgtcttctcaatcatttatgtctgtctcattttcccctagagacctaaagaagtaatgacataccagcagatgatatagaaactaccctagggtcagggtatctcccaggagtaatggtactttctcaaggttctttatttgactgctgttcttggcccaagtgggagtgaacccatgttcaagctctgaaatggattagcctaacctctcttccccgtgaggtatgaactttgactacatctcctgggcatggagccagaggtctctgcccttcaatacattgatgttggtcccagagaggcagcaaatacctttaggccaacaaggaattgccatctaactacagtgtaaattccatgaaggcaaggttcttgactaactggggtccccaggatctagccaaatgcctaacatatagtaggcaggcagcaaataataattgaataaatgaatgaatgtcttggcttctttataatttttagatggttaattaaatttttttaaatataggattgactatattttagaatcttggtgctagaaagcgctatagtaggtgactttgtttattcaatcagaacagtagttgaaccattttagatgaaaaacatcctatttggggagagaaaaatgcattttaaaatgtgtaactttgcttcagtaactctttcctgtggttaagaatgtttgctattataaattccctcctcacaaaattagctgggcatggtgtcacacacctgtggtcccagctacttgggagactgaggtaggagcatctcttgggtccgggaggttgaggctgcagtagctatgatcacatcactgcactccaggctgggtgacagagcaataccctttctcaaaaacataaaatatctcctcatgatagtttttcttaccaacctgtgtttcattataaaagcagtataatcatattataggacatttgaaaattttaaaggaaagaaaaaagttcaccatacagccacgtgtaatcttaatttgtttgcagtttattatcttgaccttcccctttgatgttgtatcatataattgtagagtattgggaggcaatgtggaatagcaaaatgttgccaagctttgttggcaagtaggctcaggattgaatcacagcactgtcattgcaaacagaatgaacttgggaaagtcatttaacctcctaagtcttttttgtcatctgtaaaaggacaataataatgcccacctcagagccgttgtgaggtatgctctgcagtgcctggcatggagtaatagcttggtgctgttagttgctgccatgccaatgatcagggatggcatgtagccagcaggtactggcattgctgtaccagttgttaaaatgaatttgaagccttcaggcagattgcctgcccccagatgcctccacgtcttctacaaatgcacactgcaccccctagcccctgccaacatgcaaatgttactaacacctggcattatgacctacatccatgctgatgggtcggtactcataccttcactctgctggtaacccctcatttttttagattgacataatttacttaatcattgttccattggatagttaggttgtagctgtttttttcgctgtaactaatactactgtgatcagtatcatacatatttgtgtcataggggatgtttatttctagttcactcttcagtagcaaaggaaaacctccactctgatggatgtcaacgtgttttaaaggctgtttgttaaatgcctctttctctaggttgagttatcttctatacctaatgcctcaacaacttaagacaatcaaaaccaaaacaagaaccaatactgccatgtcactgtttaaataccaccaccatcagactcagccttttttcagcctgtttttgtctagtcttgtgaaaaaccccgctttcctgacatactttactagagtgcaattctatttgtttctgatatagtataatgttaccaaggtacttttttttcatgttacccagcagttttttgtttctttttttgtttgtttaaccacattgactttgaatattaattatctcttccctgccatgaagtggaaactgactctgtacccacttccagagtttaggcggaaactgtaaatatgccttgttgcctttccaactgggctggcctggcttaaagtgactggccaaccaagtcaaccatgtcaaacatgccaaccaagaggcaactgttgtttcagaaatgagaaagggaaagaagcagtttgatcaaaatgggtcctgagtatgctgaagttgcccaattaccgataaaagcccattgaacccactctgaagatttttctgtttttcacagcattggtgattatattattcgttagaccatcttcgcatactaaatcttatatggttaaaggttcatttggatttgaaataaaaaacagcaaatcacatgccacctgctctgtgtattacagcatgaagtctcacaagaatagaaggaagttgtctctgttgatatacagaattagagggagtatacttctgtctttaggccatgaaaaagaattattgaaggatttgggagattatatgtatgtgtatgtatgtatatgtgtgtatacatatgtttctgtatacatatgtttgtgtgtatgtacatgcatacacacacatatgcatattttccatttaagggaatcatatttgtatagtataaattttgatttccttataaggaatattagttttataatggattatagagtatgtttgtctctcacttgcacatatgaagttaaagaaataaactagctacaattaagatgataatttgatttttggcaactaaaagatattttccatctttttgttttatgatgtcttgagtccaacttttcattgtataatgtacttagtgaagcaaatgtaggcattattctacaccaatgttatatacctaattattaatatcacaaagactgctgggctattttattcctggtgtttctattgagaattgctcaaatttccctattaagaggttttgcattaaaatatattacatagtcaatgtaagtttttcagaatgttacttgagatttttttaaaaggataacttaaaggtatacaatgcaaagtgctgctagtgcagtaaaccagcttcttcaaggcatgttgtgtaacaacctttttaatgatatgctcagttcagttttcactgcagtagattgttaacaatgactgcatatttcagttacaaggttgggataaattccatttacaacatatattttcttgcttttttttttttaaagaaaaagtatattaaaatgtgatgatggcattttacctttaatacaacttcacttctatacacgtaaagttgtcaatcagagtaagatgaagacccacaaatacatattcatgttccttctgattaaaagttctgtgatttttttatttacaatatcttactctctttattttcccacttgtagtttcaaaatttctacagaaaacatgtatcctttcccaataatgataaaacacaacatagttaaataaaaacacaaggtaatatcagacagtgggggaaaaagacactgaaatattgggaattaagtttattatgaattcaaatcttgccaatattacccagcagtagtttcaggtccatgattattttgatacattttaataaactacattctccctattgatcttttacctggaaatctcagtgcagttggttgtcattattagtgatagttatgttctgtaaagttgtcatgaatattgaattagttaatagtgaaccattgctcctagggggacatatagggttaggtttctgcaaacttctggtcacagcactcattttcatcaaatgatcaatacataactttgttttatgtgtgtttctgtttaaagataccttatttaatgtgtattattgattcattaacactgaattcatggccaatagcactagaactcttgcccaaacaaggcttgtctcatatactcgtatttcctccatgaggcacatcaaagtcttcttgtgtttaggaacactaaacagcttgttgacactgctcttggaggctatttaaacagaaaaagtaccccccaaaaaaagcataaacttgcaaaaacctaagtagaaaaaaactaagtagaccgtaaaaaggacacttatttatagtattagaactgaacacaaaggcaaagcatcaccttgtttgacctcagctgggaatgggtacactgggtgactcacatttttgctgctctatgaatgtctataaatgactggcaagggaccatgagtactgatttggggattacaaataaatttaagaaggtaaacaaatttacaaatatagaatccatgaataatgaagattgtataagctttctcaattagtaaaaaccacaaaacaataatatttttaagagtttaccatcatccttgttacttttatgttataatttatagtggcttagtcatggcaaaatgaacaaaagaaaatgggtagaagcagaaagagtttttgaggtgcatgcttgaaaaagcctacatagctgttaatgaaacttaaagatgattctggtgaaggctcagaaagaaaagaggagggctgtagagaaaaattccatcttagagaatacctaagtaatccatggtagaatattcgtaaaaatgtggaccacaaaggccattatgatgggtttctggcagaaatgaggaacttgttgttggacagtagagaaaaagcaatccttgttataaagtggcagacaactaggctgaattgtgttcatgttctagtgttttgtggaaagtagaacttgcaagcaatgaaattgcatatttagctaaaacaatatctaagtaaaatgttgaagttgcagcttggttcctcctgactgctcgtagtaaaatgtgggaaaagagaaatgacttaaagacagaattattaagcaagaagaaagcagtactaaaagatttggaaaattctcagtctatctaaattgcacagactgcaataataggatgtgaataattaggatgtggccaagtgaccatttgataaagagattagcataggtgtaaactaagaactcaatcagtcaccccaacaggaaaactgccagtttgaacccaatgagggaaggctttcagatttcaaggaccacagagctattcagttgcgtatgtgtaatcttctttaagacaaggccattcagggatcaccaaggctgcctcctcaatttcaaaagaagggaccatcacccaaagccatgggagaagggccacccagatccttgtgggcctaccccctttctggcaaggctgcagagcaagaacacaatcccagcgtgtctgggaagaggagggaccccctccccaatattggacctgtaggacagagcatagagccaaagagaattgttttcaagctttaatatctaggccaggcgcagtggctcatacttgtaatcccagcactttgggaggctgaggtggaaggattgcttggggccaggagttttgagaccagcctgggcaacatagtgagacccatctctaccaaaaaaaaaaaaaaaaaaaaattgagtgtggtggtacatgactgtagtcctagctacttgggaggctaaggcagaagaattgcttgagctcaggagttctaggctatagtgagctatgatctcatcattgcaccccagcctgggtggcagagcaagaccctctccttatttatttacttttgacacagggtcttacactgttgcccaggctggagtgcagtgtcatgatcacggctcattgtagctttgagctcctgggctcaagtgatcctcctgcctcagcctcccaagtggctgggactacaggctggaaaccaccatgctcaactaaattttgtatactttgtagagatgggttttcactatgttgcctttgggaggccgaggtgggaggatgcccagccttaagacctactctttaaaaataactaaataaatatatctcatgaagtttgcctgtattttagacttatttggagtcacctttcgtcttttccatttcccttttttggaatggaaatgtctatactgtgcctgtcccaccattgtattttggaagtgcataacttgtttggtttcacaggtacacaactgaggagcagtttgcttcaagatgaatcataccttgagtctcacctttgtctgatatagatgatatttagatgacactttcaattttagactttagagttgatgctggaacaagttaagactttaggccagatgcggtaactcatgcctgtaatccctgcactttgggaggcagatgtgggaagattacctgaggtcaggagttcgagaccagcctggccaacatggagaaaccctgtctctactaaaaatacaaaaattagctgggtgtggtggcacatacctgtaatcccagctacttgggaggctgaggcaggagaaccgcttgaacctgggagacagaggttgcagtgagccgagatcatgccattgcactccagcctgggtaacaagagtggaactctgtctcaaaaaaataaaataaaataaaaaggcttttgaggctgctgggatgtaatgaatgtattttgcatgtgagaaggacatgagtttggaggaatggagtggaggggcagggtgggggtgtcaggatgccgtacactgaatgtttatgttccctctgaactcatatgttgaaattttaacccctagtgcgatggtattaggaggtgggaccttcggtaagtgattaggtcataagggcagaaccttcaccagtgggattagtccccttataagagagaccccgagagctcccttgccccttctgtcatgtacggttacagtgacaagagggtaatctgtgaagcaggaagcagaccctcaccagacagcacatctgctggcaccttcatcttggacttctcagcctccagaacagtgagaaatgaatttctgctgtttataagccacccagtttataatattcttttatagcagccctagctaaaataagctctattccaaatatatttgtattttagcattattttcttgagttataaacatgtgcatgtttacaccgtggatacatgcaaaaatgatcatttatttttggtaaccagaaaatggatattagtgttgatgcatagaattgttattaaaaagacttgtttctttttttttttttttttaagacggagtctcactctgtcgcccaggctgcagtgcagtggcacgatctcggctcactgcaacctctgcctcccggggtcaagcaattctctgcctcagcctcctgagtagcagggatttcaggcgcgtgccaccatgcctggctaatttttgtgtttttagtagagacagggtttcaccatcttggccaggctggtcttgaactcctgaccttgtgatccacctgccttggcctcccaaagtgctgggattacaggcatgagccaccacgcccggccaaaaagacttgtttctaaagcagttggtttcacagcattttaactgtttacttatcattcgacggctgttcataacgctattaattatcatatggaatttgaaaattagatttatcaaagttgcttcatcaatttcctcttcgtgacataggctgatagaaaataaagtgctaggatcacgcctctaattctagagctttgggaggccaaggtgggaagattgcttgaggccaggagtttgagaccatacatatcttcatgatatgtatgctgatagaaaataaagctacatttaaataaagcattatgttaaaaaatatacccctgggcccaaagtggccttgctagaaccctacttaagtcccagcaggttgatactagttcattttctccatttatttaactgactaaagtaccagagtgctgtagcaggtgattttttgttttgctcatgctggtttctttttttgaagggcagggatgtgtttgttgtgccaagttcttaaaaagcaagcaggcttgccaacaggtttgtggagattctctggggatgtcatgaaggaggaccaatttgtaaactagtactaatcaggctgcttcaacccctttggaagatttacagagctgttgatgatacatgcactgtagagctgggaattgtttatgcacatctcttggccagctgtcaggaagataagagctgatctactgcaaagccaaagaaagggtaatataatataggactctgttgggtggcgcccaattgtatttcatttatctaggaattttctgtgtgtgtgtatgtacttaaggaaggatagagtcattcagacaacttagacatatgtagtttgtttcagcatattatcagggacctctacatacacacatggatacttcccttctgtctccaactttctcttagctgatctcttctgccaggtcataagcccccagcaagacagaggaagaccccagtttgtaagggaaaaaatcctcacagataattaaaagttatctccagtttagggctaaaggttcagagaattggactatagtttcaattttgcccttaattaactagttgacttttgataaattgccttcccttgcaactcctcatctgtgaaatgagggagttggacaagatgttcacttcagccccttacactgctcatggttctgcaattctttatttgttgaggccgctaccaaaacctgtaacatcatttacatcatgtacattcaagcttcgcttaatgatggggatacattctgcgaagtgcatcattaggtgatttcattattgtgcaaacatcacagagtgtacttactcacacctggacagtatagcctgctacacaccacagctatatggtataacttcttgttcctaggcaacaaacctgtagagcatgttactgtactgaatactgtaggcagctgtaacacagtactaagtatctgtatatttaaacatagaaaaggcatggtaacaatatggtttcataatctggactcaccatcatataaacagtccattggtaaccaaaacatcttcatgcaacacataactatattctatcattgaagaccactgcagattacatttatctgtgtgcagaaatttgcagtgcacagcagtcttcattgatggatacttaaatttaatgaacattaagatttagcattttgtattgtgtaagagagctatacatagtattaaacctgtcagggttagacagctatggaatttttgcttttattttccagaatctaaacatggattcgaatacttctcaaagatattgttggaatgaacttttggaaaaagcttggaaactctgagagttgagattaagtttgtttgtttttcctagctgtatttcatgtactgagtgccttacagacttctgcctagggatggtaacttctatggggaaaaacttcaagaacttgctacagcttcatttacagctttttcataactactgtggattaatagattagttagaagcctttgggagcactttgcatagatctcaccttaaactaacctgaataataagggaatagttgattctgtaactaagtacagaggaatgacaggcttcagggtcgattcaattcagtgtcataggctctgcttctcggtattctgaaattaccttctctgtgctcccattgtgacagaatgacgatagcagtctttactgtgtgttcacatactgcatcattggggtttctcaaccttagtactcttgacattggggccaggtaattctttattattgtgggactgtcctgtgccttgtaggatgtttggcaacatcgctggccactacccacttaatgccagtagcacctcagcccttcattgtgataatcaaaaatgtctgtaggaccgggcacagtggctcatgcctgtaatcccagcactttgggaggccgaggcgggcggatcactttgagcttgggagtcaagaccagcctgagcaatgtggtgaaaccccgtctctacttaaaatacaaaaattagccaggcgtggtgacacggacctgtaattccagctactcgggaggctgaggctggagaatcacttgagcctgggaattgcaccactgagctgagattgcatcactgcactccagcctgggtaacagagtgtgatcttgtctcaaaggaaaaaaaaaaagtctgcaaacattaccaaatgtttcttgggggacaaaagcaccctgattgagaactgctggtctgaaggaatatagaccattttatcaggtagctatcataagtgggaggcagtgtgcttcctagaagaccccaaatttcccacccaccttttatctcccattggctcatcctgagtcactccccgattcctgaacccccatcactggtgagtgggtttgtgggggggggggcgggtggaatgttcttcggactcaccagggcacctctggagctaggaatgtggctattcagggtgagccgagtctctcagcatgattggtggaaagggagaatgaaagctgagtaggaactcagtaatatccatgaccactgcaccctaaatttgccctttttttcttcctctcagtgaggattatgggaagaactttaaggatattacagatctcatcaataacacctttattcggactgaatttggcatggctattggtcctgagaactctggaaaggtgagactcattcttgtatacataaagcttgtgcttgataccacatgcagagctgtcagatattagtattggcatggtccagtgattcacagtaatgtattttagtttagtattgctatatttatattttaaaattaaacacaattttttaagggtctcactctgtctcccaggctggagtgcagtgataccgtcacggctcgctgcagccttgaccttccaggctcaagggatcctcccacctcagtcacttgagtagctgggactacaggctcttgccaccactcctgggtaatttttgtatttttttgtagagggttttgccatgttgctcaggctggtcttgaactcctgggctcaagcaatccacccacctcagcccctgaagtgctgggattacaggcatgagccactgtgcctgccttaaacacaatttaatatcgatcatataagaatggaactctgagcacacaggtttatttgtttttgttccccgcccaaggtgcaccaaagcccttaataattatgcagcagttgcttaacattacaatgtatataacctatgacaacattttagttttttggaaaactaatctcagttagcctaatctaggcttaaacccacagatatgatgtcccagctcagttcagggtgttatttttttataagaataagacccaaggggtagagtggaacaactaatcagtttttataactcttcttatttctagaactaaaatttcttaactaatgtctggtgaaaatggtgtaagaactcctgtgcttgcatagatagtatcataccctgaatcagatctttcctcttcctatcaggtggtgttaacagcagaggtgtctggaggaagtcgtggaggaagaatctttagatcatcagattttgcgaagaattttgtgcaaacagatctcccttttcatcctctcactcagatgatgtatagccctcagaattctgattatcttttagctctcagcactgaagtaagtccagttgaggaacatggtttgccttttgcattttatagtctcaaatgtactgtcttagaaggatcctttaggaaatgcttttaatattggacttctttcaagtctccttatggcatgaagtatgtatttttttgacgttttttcctatttggtaaaggacacgatttccacatgctatctattccaggtaagtgtgatgcctagttgtcactgtaatttttttaagtgactaaatgtatggtattggagtaatgaactagaaaacagtttaatttaatcattcttgtgctacaagggacaagcataaattgtcaaactcctgatgttgtcattgttccttttctatgatcaaacaacatctttctaatttttttcttttttgttatgtcctcagtttataaaacatactgatttctgtctttgaccctcatgtattaaatatccaaagtcttaaatccctgcgctccctaccacgttcctatactttccccagagaccagtgtgtttccctaaccctcccacttctcaaagttctctgaggaacacattcagcttctcctttcctggaggaccagtctcctttactgtggttaagggcccaaagtggctgagttgctagactataataatcagaattatactttacatttttatggccttctctcatcagatagaaacacctgaggagctagttcaagaggcacatccctttgcccaaacccagatataataaatcaatgactactgttgtggggtggctaatatttttagcaggctccccagctgagcctgagcaccaaagtttgagagtcattgctgtactgactgttttggggtccaaaacaagatcatcaaccgtgaacaagtcaggctgagcaaaggatgacataggaggacgaagggcactggaagagaggtctgggttctgggctttctgtggggagatttttgagcagaggtgaggctgaggggcaccaggagggccagagttatgttttttttgcttttgtttttttttttttttttttttttgagacagagttttgctcttcttgcccaggctggagtgcaatggctcaatctggtctcactgcaacctccgcctcccgggtacaagtgcttctcctgcctcagcctccagagtagctgagattacaggcatgtgcacccaggcccagctaatttttttgtatttttagtagagacagggtttcaccatgttggccaggctggtctcgaactcctgacctcaggtgatctgcccgcctcagcctcccaaagtgctgggattacaggtgtgagccactgtgtccggcctcagagttagcctagcagtggaggccagaggaaggaaactagcttgctggggagtaagcttcagatcttagaacaacaattcctggaaattggcctccagccgcttaagctgaaagcactataagggagcaaggagtgaacagacccatagagctcccctttgactactgcatcttccttaccaagtgtctcagggttattaaaacagcactgtcctcaggaagagacagatacagtctgcttctgtacctgaaatttcttccatttaagggtaaatctgaagtacatataattgggatggagaagagggaccaatttgtactaaagtgcaaatcagtggtatcaaattctgccttgtctttataagtagaattaggtaaattagaaatgctaggatgtgagtattaccaggggagaaaaagttagaggagaatggtgggtgagagtacaggagtactgaacataaattctgcctaaataagttacatttaatttcagctagactaggacatctctgtcccatctccactgaggcggagctcagtaagctcacattgccggtgtaatgttgtcagtcagaattttgttaagtctctgctacatttcaaactattggccaatccctccttttgagaactctaattgtttggcttctgtgacattattccttttagttccttccttaacctcctttcagcctacccttaaatgcctactcctcatttcactgagcattctcttccactcttaccatttagctaccaccacctataatgtataagattttcaaatccttatctctagccctggctttcccctaatgcatcatattcctgtcttgctgccccctgaatatctctagctggatgttccacaagcaccttaaatcaatttaaaactgagcttcctccctactcttctctcagacctgatcttcttcccttaatccttatactagttaatgatatcacaatgcatcctataccccaaccaggaaactagagtgaccaacttacatgcatgtgcatgcacgtgcgtacacacacacacacacacacacacacacacacacacacacccctacctctcatcctgccctgcaggagaagtcatcccgttctactatgctagcttctaaattcttgcagagcctgttcctcatggccagtgttcaagacctcattagctcttaccgaactaatgtggcagtcattccctgcttttccttgcctctagtctggaccctctgaaatccatctttcccattcacgtccaagtactccacctaagaaagtgaaacggactgtgtcatcctcctgcttagcacacattcctcctgagagcacctcatatgcaataaaccctggagtccttaccatggcacagaaggaaggctctctgtgagctggcctcacctttctgcctagcgttagttcctcatttgcttaccttggaatttgcactcaggtaatgcctgatggcttttagctccctgcacacactgcagggtttatgacctccttgcgtttgctaatactagtctctctttgtgcagcaacacctcatctccctgtttgccttcttttggtcccactgctcatcatttaaaactcagtgcacctgtcttcttcaggacaccatctctgatgcaatgttcctcctctcctcacttctatactagaccatattttataactctgcatagtgttgaactttcttcttatctatgcgccttgttaaactgtgagccccttctctcagcagggagtgtgtcttattcatctttgtatccccagtgcaacatctggtacagtgcctggcacataataggcacttcatacgcatttgttattctgaacttccaagaccccaaaagggcccagataaactacgtgtgtgtctgtggagctcgggcagctctgatggagcttcagtatgtgtttttcctgtcctgaatgattggatatgaaatattaaaggtcatacaagcaactacacaggataaagctagaattttgataagtcatttataatctttcagaatggcctgtgggtgtccaagaattttgggggaaaatgggaagaaatccacaaagcagtatgtttggccaaatggtgagtaacagaagactccatctgtgcagagccctaaacccttcctgatagcgctgccaaaaatcacatgaataaatattgagcacttactgtgtgccaagtactcttcagggtgccataagagatattggagaggggtgtgacacaggccttgacctggaggagcttctcattctgctggaaaagaagacttagtctcacttaaatgttagaacataaagtataaaacaaggcaggtgactgagttgctgctgcctgcccagggttcattctccatgaatggtgacatcaattaaaatacaataaaatatagctttaatttagggatttaaatacttctccatgcccagatttaccctcttgtctagagttccatttcagtcatgtagaacatggcaaggaatcaggaagaaagctgaaagagcttccagactcctgaagtcacattgcgcaccacaactcattcacttttctcggagagattccctgcccctccgggtgcctgcttaaagaggatggagtggagggagctcttacttgggagtctcgtcacctttgttctgtcctcactctgctgctagtcaggggctcaacctttctgggctttagttttttccttttgtgaaaggaggcttatttggagaatgtggggatggctaagcaagaactgaattaacaggcttcatgcctccaaaatctgattaggctcagaatgttgtttagagcctctttctcctttccctttgactaatttcagctaatttgtgaatcccagtttatagcagattggttacagaggtaggatatgtaactgctgcaataagcacgtaacagcattagaattacagcctgagagctggaaggaggtggaattactctaaaagagcagacaaaaacttagagaataaacagtattaaattatttagtgctagatcaagaaagtacacctgtgttagtaacttctaatgggaacactgtgttatagtttgatagaattgatgttcatgatgatgacccacaatcccaagagtttcctgtactctaggaatcaggaaagtgtagaatacagatttgaaatatgtctaccaagattgattaaaatattaaatatattgcttaaataaagtaggccttttctagaaatgttcttgttcttgagatagggtattgctcttttgtccaggctagagtacagtggcacaggcatggcttaccacagccttgacctcctggacttaagtgatccttctgcctcagcctcccaagtagctgggactacaggcatgtgccaccatgcctagctaatttttgtatttttattttgtagagatagggggtctcactatgttgcccaggctggtctcaaactcctgtgctaaagcaatccttcctcctcagcctcccagagtactgggattataggtatgggctaccatgcctagccccagaaatgtttttttaatgaggtttttatagcaccactctgttacacatgccacatttgctttcgttttatgtattctaatgaattgtatttgtaccttatacagttttatcaggaaggaaggaattttttttttcttgagacggagtcttgctctgttgcccaggctggggtgctgtggtgcaatctcggctcactgcagtctccacctcccaggttcaagtgattctcctgcctcagcctcctgagtagctgggattacaggcatgtgccaccacacccagctaacttttgtatttttagtagcaatggggtttcaccatgttggccaagctggtctcaaactcctgacctcctgatccgcccacctcagcctcccaaaagtgctgggattacagggcatgagccaccgtaccaggtggaagtaatttttaagataactaagttaaattgtttcactcctgatggaactaaaacatgtaggtcatgtgtaaataatttttttttctttttttaagataaggcctggctctgtcacccaggctgggatgtagtggcacgatctctgctcattgcagcctctgcctcctgggctcaagtgatcctcgcacttcagccttcccagtcgctggaactacaggcatacacctggctaagttttgttaaattttaatcattaaaactcatctttagccaagtgcagtggctcatacccctaatccaagcactttgggaggctgagatggaaggattgcttgagaccaggaattcaagaccagcctgggcaacagagtgagaccccatctctacaaaaaattaatgaaaaaaaaagccaagcatggtggtgcacacctgtagtcctcgttactcaagagaatgagatgggaggatcactttagccgaggagttcgaggctgcagtgagctgtgattgcaccactgcactccaaactaggtgacagagcaagactccgtcacttaaataaacaaacaaaaccttatctttaaaactaaaaagttattttaaaataggattttgttttgtatcctatgcaaggtttttacttttgtaacatgtttttttttttttgtttagtgtctaaatatgaataaccaggatgctgctgtttactcacctttttagatctctagtttctaggaatttacaaccaaaagttctgaaagaacatgctcaaaaccaacacctttttttggttgcaatccagtaagtgccaggagggtctgaatctagttccctgcaaactccctttccaggttacattttaaataattcaacctccgacctagttgtccatttgagatggaagaactaaattatttaactcatacaaagcattgaactagattctgaagggaaacagcaaagtatagtacctgccctgaagaagctaatttatatagtaggaaaggtaaggcatatactatgcaagtaaaataaaaaacaggcaaatgcatgccaagtggctgtgcagatggtacagtgctctaaaacagagtttctcaacctcagcactaatgacattttggatcaaagaattctttattgtggaggaccgtcctgtgcatcataaaatgtgtagcaacatccctggcctctacccggtagatgccaataacacctccgccacccacccctcagttgtgatgatcaaaaatgtcagaggcaaatgttgagagggtgagtagaccagcatgactgcctgaaagagttcacgtaaagaagtggtggactgtagacaacacatgggccgggcagtggggagcttgacaggcagagctgtgaaggaccagggctcagcgcctgagaagtggtgcttgtcagtgcctgtgaatgaagcttgttagacctgctaggaagtttgtgagtaaggtcaacacagtccttcagcagtcttaaaccatttcttttccctgtttttgcctcattgtaggggatcagacaacaccatcttctttacaacctatgcaaatggctcctgcagtaagtatattttagtcccagaaaataatgtcctgttgtccattcatggtagaattttctgggttgtgcaaggtagaaacataaaaggtccctccattctcctgaaattgtaatagctaaagaaagctgttagtggttattaaaatcttgaaagtaaaaccaaattactacactacccagatcaagtaaaaatataggctatacgtagaggcaatatttaatcttagcaatgtatttatgtaaagcaaatattatgctacagacaatagcaaattgaaatgcatggttatttctacaggaaagcaagggttgtgtttgtgtttgcagaagcagctggcttcccaaactctgacacaacttcaaaacagaaagcaaaatctttcatttactcattcaacagatatttgagcacctgctcatatgctaaacactgttctaaggatggagagaagaaaacacccaaggcctgccctcatggaacgtaaattcaggaaaaccaaaactccagctgggcatgatggttgcatgcctgcagtcccagctacttgggaggctgagacagcaggattgcttgagcccagaagttcaaggacagcttgggcaatgtggcaagacccccagcccttaaaagaaaagaaaagaaaactcaagacaatttaaaataggataagataattccaaactgtgccatgaagaaagtaaagcagcatgctgtggcttttttttttttttttttttgagacggagtcttgctctgtcgcccaggctggagtgcagtggcgccatctccgctcactgcaagctccgcctcctgggtttacaccattctcctgcctcagcctcctgtgtagctgggactacagacgcctgtcaccacgcccggctaattttttgtatttttagtagagatggggtttcaccgtgttagccagggtggtcttgaactcctgacctcgtgatccacccggctcggcctcccaaagtgctgggattacaggcgtgagccaccgcacccgtctgctgtggctttgatgtttttatgaaacactgtattagaattaagtaatctcttacctttccattgagcataaaatctgaaatgtataaaataaaacacaaatatgaattgcctatatctaatgctgtatcactttttttttttttttttatgagacggagtcttgctctgtcatacaggctggagcacagtggcgcgatctctgcccactgaaaactctgcatcccgggttcacgccattctcctgcctcagcctcccgagtagctgggactacaggcgcccaccaccacgcctggctaaatttttttgtatttttagtacagatggggtttcatggtgttagccagtttggtctctatctcctgacctcgtgatccgcccacctcagcctcccaaagtgctgggattacaggcatgagccactgcgcctggccgctgtatcacattttatgttgtcacttgattaacatgcatagtatttaaaatgctttagctataaaattaagattgattctaaaacaactgctttgaactaggctcaccagtaagtgaaattttaattaatattttgtcttgtttaagaagctgaccttggggctctggaattatggagaacttcagacttgggaaaaagcttcaaaactattggtgtgaaaatctactcatttggtcttgggggacgtttcctttttgcctctgtgatggctgataaggtaggtattgccctctcccctttggggtctgatatttctgcaaatatctctcgtatagattctctttattacttggcattgacagagtttcttgtctttttgttatatttagtaccactgtgagtgttaggggtgattctttttgcaaaggctgattgactgataggctactctgcactttggccttctgtcaccatgtgaattctgttatcttttttgggattttttttttttttgaaacaaagtctctctctgttgcctaggctggagtgcagtgacgcaatctcggctcactgcaccctccgcctcccagattaaagcaattcacctgcctcaacctcccaagtaagtgggactataggtgtgcaccaccacacccggataatttttgtatttttagtagagatggggttttgccatgttggccgggctggtcttgaactcctgagctcaggtgatccccccgcctcagcctcccaaagtgctgggattataggcgtgagccaccgcgcccggccaggatattttgatccagtgtttgggcattactcagacaatggacatctgtagaaagcaatctcttgctcattatccaagaataaaaatacaattagataacattaattgagtgcctactatatgctaggtactattctaagtcccaggaatatggcagtgaacaaaacagatgaatttcctgctctcagaacttatgtttaagggggaaaataaatactcaaaaaataaatatgaaggctgggggtagtggctcacacttgtaatctcaggactttgggaggctgaggcgggtggatcccttgagcccaggaattcaagaccagcctgggcaacatgacaaaaccctgtctctacaaaaaataagaaaattagccaggcatggtggcatgtgcctgtagtctcagctacttgggaggctgaggtgggaggatcatctgagcctggggaggttgaggctgcagtgagctgtgatcatgccactgcattccagcctgggtaacagcacaagaccctgtctcataaataaatataaatgtgagtgtgtgtgtatcaggtaataattaaagccgcgaagaaatctaaaacagtaagaaaacaaagtgtcaggagtcagtgctcttttagacagactgtttaggatgggctctctgagacctaagtgaaacaagaacttgaccatgtggccatctgggaggagagtaggatgaggcacagccagtgcagagaccctcagactggagcatgcccgatcaatccaagcaaaggggagaagggcagtatggggggagcacagagaataatagtccaaagtggggccagagggggcctggccagaccttatgtggcctttgtagatcacaattaggatgtgggccttactcttcttgtgttgggagctgtgagagggttgtgagcaggggaatgctgagatttggcttctcttttgaagaataggtgtgcgcagaacagcctgacaggggcacgcgcagaagcagcgggagcgccgggagctctctcaggagtccaagctggggaggtggtagcttggccaggctcttggcagtgggtaagggggcaggtggtgagactgtggatacatttttaaacatattactaataggacttgctgatggatttgatgtgggttgtgagagaatgagtggaatcaagggtacctttaagagtctgtatcctgagcgcctgaatggtggtgccattttctaggatggcaaagactgcaggaggagcaggttgtgggagaaaaatcaagaattctgttttgggccgagcatggtggctcacgccttaatcccagccctttaggaggctaagacgagcaaatcacttgaggtcaggagtttgagagcagcctggccaacatggcgaaaccctgtctctactaaaagatacaaaaaattagccaagcgtggtggcgcaggcctgtaatcccagctactcgggaggctgatgcacaagaatcaactggactgtggagacggaggttgcagtgagccaagatcatgccactgcactccagcctgggaaacagagtgagactctgtctcaaaaaaaataaaaaaagaattcagttctgcatatgagacacctattagatatctgaatggagatgtcaagtgagcatttgggtatatgaatctccctaattgctatggtatttgaagccatgtgaccagatgataccttctggaggagtaagtaggtagcaaagaggtgggaggactgagcaagccctgaagcacccacaactgaaaggttggaaagagaagaatccagcaaagaagactgagagggagggatccgggaggaagagggaaatcaggaccattgagttaggtgcattctgagaattatccactggagttggcgacgtggaggttgttggtgaccttgacaaaagcacttcattggaagttaaaaggccgattggagtgacttcagtgagaactagagatgaagaagtaggcagtaaatacagataactctccaaagccattttgtaatatcctcccaataaccctgtgagctaatagtattacctcagttttataggtgaggaaattgagtaacttacctagggtcaaccagtagtggaatcctgctggaaatcagactcaaattccagaggtagcttcctatgctatactgcatatatggtataatgctgtctacagaattaaaattttgcgatgtacttttgaactctggtttctacctacagtaatgagaataagattcaaagtaatgagacatgttggtataagttgaataagttaaatgtacttatcactgaactttaaagagtatttaatctaaggaaacaccgacattaattctcatgctcaggctaactgtatctagtagcgatgttaagctatttatcagagagttaagttttaattgctttcttaacagactcttttcgtcagccaaatactccctaatcagtttccttatagtaatttccgactctccttggcctctttccagcccatgcctgttcccttcatcctggctattctgagagacttccttagagagaaggcgtgttacatcttgacttcccttgtgatctcccaaacatgggtttcatctctattttctagacccttaagtatataattctttaaattatgcaagcactgtatgaaagggaccaaacttttatgcagtagtcatcattttaagaattacctgagtgtatgcaaatggctataaagccaacctaatgttctcatcaaatccttagctctactgaaggaggtggactatcagagaccaagactatactatcttacagggccgcatcagaatgaagaattcaaagagaaagccaagatagccttacttagaatagaatggattgttcctttacctagaactttgctaggggctagaaattgctttggtaattggtactatgacctttcattcatagcaatcgtacccagtagagaaatggataatagtagttatttaaaacattcttgttcatgtccctgcccatggcatcttggcagaaaattagaaagataaatattgacatctgttctaggatacaacaagaaggatccacgtttcaacagatcaaggggacacatggagcatggcccagctcccctccgtgggacaggaacagttctattctattctggcagcaaatgatgacatggtattcatgcatgtagatgaacctggaggtaagagctttttagtggcttacccttaaaagcatagagatgtaagctttgagcagcttttatttttacatgtcgagttttcctcttacccctagaaatttattagtgccctactgatttttctgtcctagagatcatctgtagcccctgttaaaaatgccacttgttttggtagcttgtgtgtatgttcaggtgttctagagcagagctgctcaaagaatggtcagcagactggtactgatttgcaaactatctgttaccagataagtacagaaattgagagcaagagtttggaaactcttctagccttttgacaaagcaattttatgtctgttggatctaatgacaaaaaattaggggtttatggctgggcgcagtggctcacacctgtaatcctggcactttgggaggctgaggcgggcagatcacgaggtcaggagatcgagaccgtcatggctaacacagtgaaaccccatctctactacaaaaaatacaaaaaattagctggccgtggtggcgagcacctatagtcccagctactcaggaggctgaggcaggagaatggcatgaacccgggaggtggagcttgcagtgagctgagatcgtgccactgcactccagcctgggcaacagagcgagactccatctcaaaaaaaaaaaacttaggggcatatattttgtttaccttttcattttctaatgattagtttttattatgttttacaatagcatcagtttgtgacatattggaaatcttacaaattgatccttcactacagatagtttgagaagcattgttctagagtgtaaagatttaaaaatatgtaaactaaacatagggcctctcccaccaaaatatatctgggaagagtttttctgtagcatctgattaatttattcaacaaactcagcatctgccatattccaggcactaagctgggtactagaattaaagatgggcataaagatcttgagtatcaaaccttgattaattctcaggtctgagtcttcatcatgaagagacacaattggctactgtgtttggtcaggcaggtaatcgtgtgtggttagactattgtttttctctttggttccacccaagacttagtatttttgtttgtttgcctatttcagacactgggtttggcacaatctttacctcagatgatcgaggcattgtctattccaagtctttggaccgacatctctacactaccacaggcggagagacggactttaccaacgtgacctccctccgcggcgtctacataacaagcgtgctctccgaaggtgagtctcggcatcgcagtggtgtactgtgccttcagctgcatgtggtaggatttgaggcttcggggaacctgtcccctagtaatgttgcttgccaagccaacaagcctacccatgtacatttttttgtttccttttttttttttattgtggcaatatgtctaacaaaatttgcagtttttaacattgtatagggtacaattcagtagcattaagcacagtcacaatgttgcacaaccatcacccctatttccagagctttttcatcatcccaaatagaaattgcaccaggtgcacaagcactcctcgttccccacccagtcacccagctctggtaaccaacattctattttatgtctcaatgaatttgcctattctaggtagctcatgtaagcagaatcatacactattggttgttgtatgtctggcttctttcattttgcatattgtttcaaagttcagccacattgcagcatgttttagaatttcacttattgctttttaagactagaatatattcctttgtttgaatatagcaccttttttttctttttctttcttttttttttttttttttgagatggaatcgctctgttgcccagactggagtgcggtggcgtgatctcagctcactgcaaccttggtctcccaagttcaagggattctcctgcctcagcctcctgagtagctgggtttacaggtgtgtgccaccacacccagctaatttttgtatttttagtagagatggggtttcaccatgttggccaggttggtctcgagctcctgacctcaggtgatctgcctgccttggcctcccaaagtgctgggattccaggcgtgagccaccatgcccagcctgttttttattcctccattgatggacacttaggctgtttccattttcagctcttatgaatactgaatgctgccatgaacattgttatacatgtaactgtttaagtcaatgctttcagttcctttggggatatatgtaggagtgaaatagcaggatcacatgataattccatgtttctcttttggaggaaataccaatgggttttccacatggttgtaccattttacatgcaatacaaaaggattccaatttctctacttcattgcaaacacattatattctcctatttttgtaacagcactcctaatgggagtgaaatactatctcgtttatagctttgatttgcatttctctaatgactaaagatgttgaacaactttttatatgctcgttggccatgtgaatatcttcgttgaggaagcttctaattgagtcctatggatggcagtgatttttaaagttgtgttcactgatgctcctctggtgcttatgacaatttttgcacatagtagatgttcagtaatacttgccaaatgagcctacaaataaacggctgaacagccttgcactcaaaaccatacagtgaacacacttgaaaaacatttaagactgagccttaagtatgataggcaggaatggggagggaagggcattttcagctgaaggaagtacacatgcaaagtatcagagtcgctgggcgcggtggctcacacctgtaatcccagcactttgggaggctgaggcaggtggatcatgaggtcaggagatcgagaccatcctggctaacacggcgaaaccccgtctctactaaaaatacaaaaaattagctgggcgtggtggtggacacctgtagtcccagctactcaggagactgaggcaggagaatggcgtgaacccgggaggctgagcttgcagtgagccaagaccatgccactgcactccagcctgggcaacagagtgagactgcatctcaaaaaaaaaaaaagtatcagagtcacaggagggtttggcctggtggtggtggtgagacattgggtgatgccgggggaggagggatcaggaggacagtccagcagggacagaccaaacccatgcaaattcaggctccctattttaaataagttatgataaatagaactaggagtgaggagagcaacaacaagtagaaaaaaagatgttttgaatctatgttgtttaggtaataaagtgagtcttctatattgggagatgtaggcctatgagaataagcctgaatttgacccacttcctgctcttcttggtaagggtgcatagcagtagccagccagggttcttcttgtgttctactcaatggctctacagagctcacctttccttaggcccagttatacaaataaacacattagtctcaagtacaaagactcttaaagtgtcattttatttatatatttatttttcggtaggaggtaggggctgtttttattttgtaaagtcctggcagtggcctacaaagtcctggagatatggctcccggtttcctccctgactcacctccagcgcttctctttccatctgccctactctcatcatactgtccacctgccagttcttaacacagcaggtacacatgcacatgcacagattagagtttgcaccgacagttccctctgtttctccagatgtccgcaaggctgatatgtctgtactcatgtattactttttgaatgagaccttccctgactatcctattttaaattccagtttgccctcgcctcctcacacacacactatcaatccacctttagctgcgcaagtattttccatagtacttattttctagcatactacataatttacttatttactatgtctagtgcttgtctcgccctaccggaatgtatttttcacaatatttgtctgtttagttcactgatacattaccaaaggcttacaaaagttttcactctgggtgtagtggctcatgcgtgtaatcctagcactttgggagaccaaagtgagtggatgacttgaggtcaggagttggagaacagcctggccaatatggtgaaacccagtctgtactaaaaatacaaattagccagacctggtggcatgcacctgtagtcccagctactcaggaggctgaggcaggagaatcgcttgaacccgggaggcagaggttgcagtgagccgagatggtgccactgcgctccagcctgggtgatagaacaagactctgtctcaaaaaaaagagttttcacatagtaggcactcagtagatgtttgagtaaatgaattttccttcatttgcttccttgtttgctttttcttagaaaactcaaaggagcccaggcacagtggctcacacctgtaatcccagcacttcgggaggctgaggcgggtgaatcacctgaggtcagaagttggagaccagcctgaccaacatggtgaaaccccgtctctactaaaaataccaaacattagccaggcggcaggtgcctgtaatcccatctactccagaggttgaggcaggagaattgcttgaacccaggaggcagaggttgcagtgagctgagattgtgccattgcactccagcctgggcaacaagagcgaaaatccatctcaataaataaataaataaataaaaataaaggaaaactcaaaggatattatctctgaatttaaaacctgcaacagtttatatcattgaaaataagaatggggaagagacgagggaaaaaagaaaggtacaagaaagataggatatggagtagtggagagacaataattcagagttattaatccagaactctgcacacttactgaatctcaagagtccctaaaacaaggctagtgtcatggccttgtccgaataaagattaggatgccttcctgtggtagattttacttcccaggcaagcaaacagggaaggagaatggacatcagcctgttcatgttggtaaggagttaaaaggtatttttttcaaagagtatcagtcctaaataatttgtggaattaattgggtcctgttcaggtgggacaccttcttcaaatatcttttttttttttttttctgagacaagagttttgctcttgttgcccaggctagagtgcaatggcatgatcttgaccccctgcagcccccacctcccgggttcaagtgattctcctgtcccggcctcccgagtagctgggattacaggcccccaccaccacacccggctaattttttgtatttttggtagagtcagggtttcaccatgttggccaggctggtctcaaactcctgacctcaggtgatccacctgccttggcctcccaaagtgctgggattacaggcatgaaccactgcacctggcctcaaatatcatatttaaagtgctgctccgttaccaacaatgagccgttttgtgaggtgttacaagcttgtcggactccaggtgctatacggtctcaggagagagtcatgcagtgataaagtgaatctaacctaggtacttccagtgtatcagacttaatgttgttctcttcccattcagataattctatccagaccatgatcacttttgaccaaggaggaaggtggacgcacctgaggaagcctgaaaacagtgaatgtgatgctacagcaaaaaacaagaatgaggtttgtttactctaatgtgtgcagagcacagcagcctttccattgtgctctgatcagtgccagccttttggatgatgaagtttcatacttgattagggtcctcagcataaggtggaaagtttggagatgagagtaatgaaattaacttagaatttcggaagtaagaactgaggaaaggtcaaaatactatggattatttgtcttttaaagaagaacaaaactgagggctaacaatttgtggttcactaaactgctgaattaaaacaatggccagaggggctggtgattagttaggggtcagcttggcagctgggagactttagaggttctgcaagaagccgcagctccaccattcataagcagtgcacagccttgctcatcggaaacaagaggaagaggatctggccttcctttccctctgcctaggctcccatggccagtgggtggtgacctgcttagtgcacagggacgcaaggcagcccctgttgcagagagtttgggaaccggaactacgcaggtgtcactccaggagatctaaagcctggagtgacaggccttggcaggcaaggaaaaaagggaaaaaaaaaacaagctttttatctggctctcacagaatgtgagcttgggggacagctggagttccttcagaaactgaagtaccggtagttcccgaaccctccttagtatctgtatcactgacatacactttgcttttctaggtggggttttctgttttgttttaagagcctcaaatgatgagagaaagtgtgccttcctacaccaccccaacacactctcctcctttacactcgcaagcactgttgcatctacccgactttctgacccctgtttcccatctgtctgccttggccctgcccagccactgccctcctcaccttaagcctgggcaggttcagtggcctctgtgtttgccttgctgcctgcaggctccccatgcctctccctgcccagcgctcgttgtggctctcttggcctgtgatgaatggcctctgtccctgacctggtgagtaaaggttctctcctggtgggccctctgccaccttttcattgtcattgctcaccttatccctgacacaccccttgtaaccaaccccctgccattccctgaacacccacactattcctggaggaagttgggcctgtctcccccaaccccagttgactaggattggtggaaattctaaccaccctcagtgaccatccagttagagctaatcattcctcttcatttcattaatagtttgcttgaacctcttctttttaaaaaaatagtagtaaaatatacataatataatatttattatcattttagccattttgaaccctttttagagtgttaactttcattcggctgtatacctcaactagtttctgacaatacatttcttttttccccagctttatggaggcataattgacaaaaattgtatatttacaatgtacactgtgatgttttgatatatatatacattgtgaaatgattatcacaatcaagctaactaacatatgcatcacctcacaattatcttttgtgtgtgtggtgagaacatttaggatctattctcttagcaaacttcaagtaacaatacagtattctagactgtagtcaccatgtatattttccctcagaagcttattcatcctgcataactgaaactatgtaccctttggccttcatctccccataccccaagccccaaaagccaccattctactccctgcttctgtgagtttgacatttttacattccacttataaatgagatcatgcagtatttgtctttctgtgctgggcttattttacttaacataatgcctcccaggttcatgttttcaacagatgacaggatttccttcttttttaaggctgaataatattccattttctttgtccattcatccatctgtagacgcttaggttgattctgtagcttggctattgtgaataatactgcagtggacatgggagcacagatatcttttggacataccgatttcatttctcttgaatatgaacccagaaatgggattgctggtagttctgtccttcattttcttttttttcttttttttaaagacacagtcttgccccgtcaccaaggctggagtacaatagcacgatcttggctcacttcaacctccgcctcccgggttcaggtgattctcctgcctcagcctcccaagtaactgagattacaggcatgtgccaccacgcccggctaattttttgtgtctttagtagtgacggggtttcaccatattggccaggctggtctcgaactcctgacctcgtgatccacccgcctctgcctcccaaagtactgggattgcaggcatgagccaccatgctcggccctgctgttattcattttctaggaaaatttcttacggtattgcataatggctgtaccagtttacattcccaccaacagtgtacagggttcccttttttccatgtccttgccaatacttaccttttatctctttgataatagccattctaacttgggtgagataatatctcattgtggtttttatttgtatttccctcatgattagtgatgttgggcattttttcgtatacctgttggccatttatatgtcttcttttgataaatggctgttcaggtcctttgcccattttttagttggattatttgttttcttgctactgatttgtttggatattaaccccttataagatgtatggtttgcaagtattttctcccattctgtgtattgtttgtcttctctcttttggtggtttcctttattttgcagaagctttttagtttgatacaatctgatttgtctgtttttgttttttgttgcctgtgcttttagggtcgtatccaaaaagccattgcccagatgaatgtcaagaagcttttttccctatatttccttctagtagttttacagtttcaagtcttacatttatgtctctaatccattttgagttgatttttgtacatgacatgaaataaggattgaggccaggtgtggtggctcacgcctgtaatcccagcactttgggaggccaaggagggtggatcacgaggtcaggagatcgagaccatcctggccaacatggtgaaatcccgtctctaccaaaaatacaaaaattagctgggtatggtgatgtgcacctgtagtcccagctacttgggagactgaggcaggagaattgcttgaacctgggaggcggaggttgcagtgagccgagaccgcaccattgcactccagcctggcgacagagcaagactccatctcaaaaaaaagaaagaagggttgaaatttattcttctgcatatagatattcagttttcccagcaccgtttatttaagaggctgtctttttcacattgtgtgttcttgacacccttgtcaaagttaagttgacaataaatgcatagatttatttctgtgctctctattctgttccattggtctatttgtttttaacgccagtaccatgctgttttgattactatagctcaataatatattttgaaattaggtagcatgatacccccagctttgttctttttgcttgcaattactttggttattcagggtcttttgtggttccatataaattttaggattttttctatttctgtgaaaaataccattggaattttttttaagaggcaaagtcttagtctgtcaccctgactggggtccagtggaataatcataggtcactgcagcctcaaactcctaggctcacacaatcctcccacgtcccaagtagctaggtgtgtaccaccacacctgtctaattttggtactttttggtagagatggggtttcaccatgttgcccaagctagtcttgaactcctggcctcaagtgatcctaccacctcagcctctcagctgggattacagatgtgagccaccacaactggttgttttgttcttgatgtaccttaagtacctaaaacagtgcctgaaatatagcaggtactcagtaaacatctgatgaattaacgtgtttggattgttctgtgttgtcacagaaagagggttatttataaccatataatagtaaaaaaagacagtcaaaataataggcattacatttaatctgtagatcactttgggtagtatggacattttaacaatattaattattccaatccaggaacataggatatatttccttttttttttttttgtcatcttcaatttctttcatcaatgttttgtagtttttagtctttcacctccttggttaaatttatccctaagttttttttgttttttttttttaagtttttttcttgtactattgtagatgaaattttcttgatttcttttttggatagtttgttgttagtgtatattgtatttttatatgttgattttatattctgcaacttttttgaatttattagttttaacatttttggtggagtctttaaagattaaggatttttatatataagctcatgtcacctgcagacagacaattttacctctttctttctggtttggatgctttttgtttttatttctttttcttacttaattgctccagctaggacttccattactataatgaacagaagtggtgagaatgggcatctttgtcttattcctgatcttagaggaaaaggtttagcttttgactgtttgagtatgatgttagctgtgggcttgtcacatatagcctttattatgttgaggtatatcccttttatacctaatttattgagagtttttatcatgaatgggtttattatgttgaggtatatcccttttatacctaatttattgagagtttttatcatgaatgggtgttgaaatttgttaagtgctttttctggatttatcaagatgatatgatttctatccttcattctattaatgtggcatatctcatttattgatttgcatatgttgaaccatccttgcattccacagatagatcctacttgatcatggtatataatctgtttaatatgctgttgaattcagtttgttagtattttgttgagaatttttgcatctatgttcatcagagatattgacctgtaattttgttttcttctagtgtccttgtctggttttggtagcagggtaataccacccttataaaatgagtttggaagtgttccattctcttcaatttttggaagagtttgagaaggatcggtcttaattcttctttgaagaaagtttgctagaattcaccattgaatccatcaggtcctaggcttttcttgttgggaggtttttgattactgattgagcctccttactcatattagtatgttcagattttctatttcttcttcatgatacagtcttggtaagctgtatatgtctagaaattcatccatttttttctagattatccaatttgttgatgtatagttgttcatagtagtctcttaggatcctttgttttttctgtagtataagttataatgtctcctcttacatttctgattttacttgagtcttttctttttttcttattctaattaaaagtttgtcacttttttatcttgtcaaaaaaaacaactctaagtttcattgatctttcctgttatttttctaacttctatttcagttatttctgctctgttattatttcctcccttctgctaactttgggcttagtttgttctttttctagttccttgaggtataaagttaagatttttgagatttttcttttttcttaatgtagacatttatcaccataaactttcttcttagaactgcttttgctgcatcccttaagttttaatatgttgtgtttcccttttcatttgtctcaagttttttttatttccctttgactcattggttgttcaagaatatgttgttcaatttccacattcatgtgaattttccaattttcctccctttactgattctagtttcataatgttgtagttgaaaagaacttgaggccaggcacactggctcacgcctataatccttgcactttgggaggctgaggtgggtggatcacgaggtcaggagttcaagaccagcctggccgacttggtctctactaaaaatacaaaaaaaaaatagctgggcgtggcagcgggtgcctttaatcccagctactcaggaggctgaggcagagaattgtttgaacccgggaggcggagcttgcagtgagccaagatcacgccactgcactccagcccaggtgacagagtgagactccgtctcaaaaaaaaaagaaaggatacttgaggtgatttcagtcttacatttgttaaggcttgttttgtggcctaacatatgcactatcctggagaatattctctgtgcacttgaaaagaatgtatattctgctgctattggatagaatgttctgtatatgtctgttaggtccatttgtatggtgttgttcaagtttgctctttccttactggttttctgtctggatgatctatcattgaaagtaagtattgaagtcccttactattattgtattgtcgtctacctctttcttcagttctgttaatgtttgctttatacatttaggtgctctaatgttgagtgcatttatatttaccaatgttatatgctcttgatgaattgacacctttatcattgtgtggtaactttctttatcccttgtgatagttttttacttaaagtctattttgtctgatataaatatagccacccccggctggacatggtggctcacgcctgtaatcccagctctttgggagaccaaggcgggcggatcacgaggtcaggaaatcaagaccgtcctcactaacatggtgaaaccctgtctctactaaaaatacaaaaaattagccgggtgtggtggcaggcgcctgtagtcccagctacttgggaggctgaggcaggagaatggcatgaacccaggaggcagagcttgcagtgagctgagatggcaccaccgcactccagcctgggtggcagagcgacactccgtctcaaaaataaataaataaatatagccacccctgctctcttttggctaccatttgagtggaatatcttttttttatctctacttttagcctatgtgtcctcttacacacataggcctttacagatggcttcagcaggggaagcccttaccaggtagctcatccagagattcttgggggggcaactgacaggttctgcaggtaggtgggcctggtgccttggtctttgggggtagcttggaggctgggtcctctgcggcaggcctggcagtggaatccactagggtggaccttttaagtgggtcttcaggtgaaacacctggagcccggtaagtagatctgcaggagccagcctggtgcaggggtgggccctaccctgagcctgcaggggctggcctgatgcaggggtccacttggctgggtctgtgagagtggacctggagcctttaagtttcttaaagacaagactggatcttatttcgaaccaccatcacatcttgtacggtgtctgaagtatatcaggtgcttatcaagtttatttgtgtagagtcagcctttaaacattgttcagaggctttgatgtaatgcaaaaataaaataaacggagacaggttacccatgaggaaatatttgcttccagatattgtagtacatttcagaatcaagagtatgccactgagctacaactcaacaacaaacaaatagcctgaataaaaaataggcaaagaacttgtatagacatttctccaaacacaatatagaagtgactaacaagcatataaaaagaggctcagcatcactaatcattaggaaaatgcaagtcaaaaccacaatgaggtatctcctcacacagattagggtggctactattttaaaaagtgttggcaaggatatggagaaattggagccctggtgcacttttggtgaaaatgtaaaatggtgcagctgctacagaaaacagcatagtagttcctaaaaaaaattaaaaataggattatcatatccagcaattccacttctggattatacatccaaaagagttgaaagcaggttctcaaaaagatatttgtacaaccatgtacatagcaacattattcatgatagccaaaaggtagaagcaacttgtgtctattgacagataaatgagtaaataaagtgtggggtgtgtgtggatacagatacacacacacacttaaataatatttagcctttaaaagggaggaaattctgacatatgctattaatacaacatggatgagccttgaggacattatgccaagtgaaataagtcagacacaaaatgacaaatattatgtgattctacttatatgagctacctagagtagccaacacaaagtaatatggtaaaaatcatagaaaacacaaagtaaaatggtagtttccaggagctgggaggaggaagaagtaggtaacagttgcttaattggtgattgtattttataagatgaaaaagtttagagatgtggttgtacaacaatgtgaatatacttaacactactgaactatacacctaaatagtaaataaatagttaagatagtacttttacctaggtctgggttaacttaaagctttattggaagggttttgtgaaatgattaaagaaattgtatctttatctttggttctaatctacgcttttgtttcttttcacagtgcagccttcatattcatgcttcctacagcatctcccagaaactgaatgttccaatggccccactctcagagccgaatgccgtaggcattgtcattgctcatggtaaggaacctcccactcaccacctccaactggaacagtggctgagcacactgaaactcagccaacaggctttgaacgctctgagaagaaacaatgtggatgcttttacattcctttggtagaatttcttacattataacaacactttgggtttttcatcaacttttatcagagagagcaacacaacttctccgaagtttttggtggttttctttcctactaaaagaggcttgatgggaaataatcagaataaattcattcaacattattctctctggagtaaatgctctctgtttcattgcctatttgtgctaatgagatggtggattatattgcaggtagcgtgggggatgccatctcagtgatggttccagatgtgtacatctcagatgatgggggttactcctggacaaagatgctggaaggaccccactattacaccatcctggattctggaggcatcattgtggccattgagcacagcagccgtcctatcaatgtgattaagtatgcatgaactcatctcacacacactgtctgcatagagggcaactgggggaatgttcttcagtttattggggggatgttacagactataattcaaatttttgcatttgacagaactatagataagattctagaaaggattgcttttaattggcaactcagattaaatggcattgttttttcttctgactgcctttagctaacatatttgtcacttcttaaaaacattctttctgggttgggcgcagtggctcatgcctgtaatcccagcattttgggaggccaaagcaggaggatcgcttgaggccaggagttcaagaccagcctgggcaacatagggagaccttgtcccttgtctctaatattatttcaatcaaaaaaaaaaccatatatatatatatgtgtgtgtgtatatatgtatgtgtgtgtgtgtatatatatgtgtatatatatgtatatatatgtgtatatatatgtgtatgtgtgtatatatgtgtgtatatatatgtgtgtgtgtgtgtgtatgtatatatatatatatatatatatatatatatatatattctttctgtctacaaaattattatggaagcgttcaagcactctagattgaaaatgacttcttaagtacaagttctgagctgggtgcagaggcacacacctgtaatcccagcactttgagaggccaaggtgggtggattgcttgagcccaagagttcaagaccagcctgggcaatgtgacaaaaccctgtctccacaaaaaaaaaaaaagaaaaattagctgggcgtggtggtgcacgcctttggttccagctacttgggaggccgaggtgggaggatcacctgaggaggtcaaggccacagtgagctgagatcgtaccactgcactccagcctgggtgacagagtgagatcccgtctcaaaaaaaaaaaaaaaagaagtataagttcttataaaataatttgattgttatttatttatttatttattgagatggagttttgctcttgtcacccaggctggagtgcaatggtgcaatcttggctcactgcaacctctgcctcccaggttcaaatgattcttgcgtctcagtcacctgagcagctgagattacaggcatgcaccaccacacccagctaatttttgtggttttttgttttgctttgttttttgtgttttggtagagacggggttttgttgtgttggtcaggctggtctcgaactcctaacctcaggtgattcacctgcctcagcctcccaaaattctgggattacaggcgtgagccaccacagccagccttaaatttattaatttaaaagccagttcttacctgggtcactctcctgtctttcctttgaaataatttctgtaaaggtatttactttcatattctctctgaacaaatctcttccttatcctgttaactacagacgttaaaagttaaaatagttggctgggtgcggtggctcacgcctataatcccagcactttgggaggccaaggtgggaagattacctgaggtcaggagttcaagaccagcctgcccaacatgtgaaactccatttctactaaaaatacaaaaattagctggtgtggtggcacgttcctgtaatcccagctactcaggaggctgaggcatgagagagaatcacttgaacccaggaggcagaggttgcagtgagtcgagatcgcgccactgcactccagcccggtgacagagtgagactccatctcagaaaaaaaaaaaaaaaaaaaaaaagttaaaataattgtcagccaataagccaccacctaaatgtaaggggttttgtctggtttgggatcaaaaagccagagtggttttctgaattcccagtacacattgatcctctgtcatgatctttctgtaattgtggtttcaggttctccacagacgaaggtcaatgctggcaaacctacacgttcaccagggaccccatctatttcactggcctagcttcagaacctggagctaggtccatgaatatcagcatttggggcttcacagaatctttcctgaccagccagtgggtctcctacaccattgattttaaagatatccttgaaaggaactgtgagtgtctcctttgaccttttctaccagaaacttccaagtccattttcctaaataatcaatatggtttaatttcttttagctggaatcagcagatgcatatgcatatgaaagaggattgacagatgttctgtgtgggtgattaagtaatggaatggcatcagaaaaacaacctcctcctcggtgctagcactgtccaggagaaatatgagggccacatatgtcatttaaattattctgtcagctatattataaaagtaaaaagaaaggtgatattaataaaataaacttaatatatccaaaatattatcatttcaacattaagcaatattaacggcccagaaaataggttcagaaaaggattcacaatgttcattgcacagtgtttccaaagtgtcacaagcaaaccctaacctcactgccaaacaaagatgctggcattatgctaagaaataaggggaatggccaggcgcggtggctcatgcctgtaatcctagcactttgagaggccaagataggcagatcacgaggtcaggagttcgaaaccagcctggccaacagggcgaaactccatctctactaaaaatagaaaaattagccaggtaaggtggcgggtgcctgtaaggtggcgggtcccagctagttgggaggctgaggcaggagaatcatttgaacccgagaggaagaggttgcaatgagccaagatcatgccattgcactccagcctgggcgacaagagcaagactctgtctcaaaaaaaaaagaagggggataaagaaaaacactggaaaaaggatgacctgtagttaagtgttggcataatacaataaaagacttaacgtttctagacactctagttgaatttggtcctttgagactgtcgtgggctcatttcctcagcgtgttgatttagtgactcctgaaggagcagacccttggtttggacctcacatttccataagacgttcaaatagatttaatgcctgagggtcgctgtcatctaaatccattcagtagactgtacagaagctggcttgggagttctcccctcagcaggcagctcccagttacccctaaagtgtaatgtcattaaaagatttgttaagcacctgctctttagcaggctgtatgctggtcttcatatcccaaaggataaaacctaatccactgtctttaggtcacagcctttgagtcatttttccagtagatgatacgacatactaagccagaaactaggtttatcagcaatatgcatttgagagccggtcaactgagctagaagtctaggaaaaggatgttttcccttcttccttaagccaatgaacacatggtgaaattgaacctgtgctcttggctaattagtatcttgtcctaaacaaagagctccctggtcctgagtggagaatatctggttgcttacctctgacagctcctactgactgagggcgtaggtgtgcaagacacacacagcagcctcttagtttggaaggaacttgagagattttctatccagcttcccacttcaaaacaaatagggtttttcctaatcctcagatggatgttgagatggaaggaatactcttttggcatgaggaaatgcgattgctagtaggctctagactagtgtaactttttgtttgcaattccaaaatgaaggaataggttgagtcagacattcccactttccctctccttgttcttcctatagcctggcagctgcctcccgtgggtgggttctgtgctgtgtactttcctgaacagtgtgtctctcctttaggtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctggtatcagcattcctcagatttctctgtctccctttccctgttggaggaggtgaaagacagttttcttatagggctaacaaatattgaaatccagccgggtgcggtggctcacacctgtaatcccagcactttgggatgccaaggcaggcagatcacttgaggccgggagttcgagaccagcctggtcaacatggtgaaaccctatctctacaaaaaacaaacaaacaaaaaaaaattagcagggcatggtggcgcacgcctataatcccaagctgctcaggtggctgagacacaagaatcacttgaacctgggaggcagaggttgcagtgagctgagatcatgccattgcactccagcctgggggacagagcaagactcttgtcccaaaaaaaactgaaaccctttcccccaagagtggagaactgctgcttcttatcaaggaagctgaggcacagagaaaggaaaccagaattgttaataatgaaacagatagcacgtattagacagttaattattgggcagaaccagcaacaaacccgagaaatcctgagttgacagtggtgtgaaggagaggagtgatataagaaagaagagaataaaacaaacaaaaatctgtagaaaatgaaaagacagaaacaccaaaagaagtggtagaggagcaaagaggaaattggactttagaaaacagcctgaggccaggcacggtggctcatgcctgtaatcccagcactttgggaggccgaggcgggtggattgcttaaactcaggagtttgagaccagcttgggcaatatgatgagaccctgtctcaaacaaaaaaaaaaacagaaagaaagaaaaagaaaaccccttgacagcatgagctcagcaggcagacactaggttttggatcctctgcaagaatcaaggcagagagatggtggttggtcctgagactagaggtgacatcagtatagtcatggtcccatcaaggtttagaggccatcaaagtggactccctagagttcaggaccatccagacttaaggattagttacttggctggcattgggttagttgattatataagggcatgagtccctggatagcttaaatgaggtaatttttgggcaaataagaggaactgcttcacatcacagatgataatcttttggaacttgttacctgcaaaagatactgacacaagataaaagtagatcctaaaggatttggacaaagaaggcaggcagatagcagccatggccctttatgtcatgttctctcaaatcgcaggtgacagtagaatataggtctgaccaaaatgcaggtctgacccagtgtggtttctcctgcatggctcacacctgtgtgtggcatgattaagggtcctcccttctctgtttcagtaaggatcacctttggtgttccagtagggctggaggtcatcgataaacctgtaacactgtaaagggttctctcctatcctcgactccaaatatgccaagctcttcacctgtgcttctgctcttctccagcagtgccatggtttttcagacctccatgccaccgcacatgatgctccctctgcctgaaaagtctttccacagtccctgcttcacccccaagtctggcgacttcccacttagcctttcatacttagctcaggtatcaccactagatgggctttccctcatctagacccccagagttcccctattacagcacttactaaattttaattactatttataggtttgcttccatcattaagccccaaattccttggaagcatattctattcgataataatatagtaatcatgatagcagctaacatttattgagcactaactttatactaggcactatcctaagcaatttacatttaacctcgcaacagagaggacatgactgatatgcccgtgggaagtggcagagctgggatgtgaaactggcatcccaactccagagcccacatgtttgggaagtgggtcctttatgagtgagaagggtactcacaaaaatccagaaatttctgattgaatacctaaaactcttatccgaatttcctcctgttatttgaggggtgatatcttcagcatcttttgttctccataccctctctcctaaatacttaccaggaaaaccttgaaatacaagcagcatccatatattccccaaatactcattgaataccagctatgcgcaggtaatgaaaagtgataatggaaaatttgttgcaaaacagaaggtgccaggtgccatggggatttagaaaaggaagagaacatttcatgtagagctgaaaggaagtgggtcaaagaaggccttgttgaggaggtggtatgagagctgagcgttgacaaatggtaggatttgaccatgagcatctgggaagaagcagctcatcaatgccagtggactgctgcaagcagagacaccaacagcatgatcaaggaagggtgtcctggaagataggccattggggaagtcacagtagtcatgataaagaagtaagtagggcccagaaggaggatcctcaggctaaattttccactgagatagtgggaaggaaggtaatgtcatggacgaatacggaaatgataaggagagcctggcacaaaggagaaaacatgatgtattttgaacatcttatttctttgaggttttgtcagcatatttaggtgggatatccagcatgtatttgaaatataggattagaactcaagagaggtaaaacctggaagttttagttgcaaccaaaaatagttgtgatcactaagggagagcagatagagaaaaagtaagagaatgcattatacctgccccctgcccccggcaaaagactacatttatgggttaggaagaaagaagagcaagcagtggcgggggcagcagagggcagagaaacagatgagtgcagctttaccaatgccaaggttggcaggggcacaacagtatgtcagatgctgcagaatgggtggtctgggggaatgagacccgagagggctccactgaatttgatgattattgagccttaggggcactgcagacactcattttcttttcttttcttttttttttttttgagacggagtctcgtgctgtcgcccaggccggagtacagtggtgcgatctcagctcactgcaacctccacctcccgggttcaagcgattcttctgcctcagcctcccgagtagctgggattataggcacacaccactgcacctggctaattttttgtatttctagtaaagacggggtttcaccatgttggccaggctggtattgaactcttgacttcaggtaatccgcctgcctcggcctcccaagtgctaggattataggcatgagccaccacgcccggcccagacacttattttcaaagttgcagaaggggtcaaagccaaaatgcgtggaagaaaaaataaatgagtaaaataggacaagtaaaaaaatattcttttgagaaatgtgggtagtaagggagaggtgggttaaggaagtaatttctaaggtcaagacatgcaggctaaggagacgctgccagctgagtgggagagattgattgttcccctcatactcagggaagcaaggccccagggcaggtcggaggaggggaaccaaggatgctcatggagtcagccctggagattgtcagcagacattgtttctttggggtaaacaggaaaaggagagcagtgggtggcactatggagagatggggtagaatggaggacagaaaaaggtgttcacatggaaggcaaagactatctaagaagctaagaggaacagaagtggggaagacagaaaaatttgccgtgtactgcaagggcaacataataatgacatttggaggtaaagaaaagaattgctggctgggcacagtgactcatgcctgtaatcccaatacttcgggaggctgaggcaggtggatctcttgagctcaggagtttgagatcaggctgggcaatatggcaaaactctttctacagaaaatacaaaaattagcaaggcacagtggttcacgcctgtaatgccagcactttgggaggctgaggtggacagatcacttgagcccagtagttcaaaacaagcctgagcaatttgtcaagacctcatctttacaaagaattagacgagcatggtggtgcatgcatgtggttccagctccttgggaggctgaagcggaaagatcacttgagcccagatggttgaagctacagtgttcatgccgctgtactccagcctgggcaacagagcgagaccctgtctcaaaaaaaaagcggggagggggaagaaaagaaaagaattgccaagtatccctgagttgagagctgctgctgatgctgaggtttctgtgtgagtctccacccctctgcaggctgcatcagtcacctccctgcgcctgagctgcctgcagtgcacagccttggggccctagctagtcctacccccaccaggcctgacccataagcttcttttccttaataaggccctctctggcggggcacggtggctcacacctgtaatcccagcacttttggaggccgaggtgggcgtatcacaaggtcaggagtttgagaccagcctgaccaacatggtgaaacgctctctctactaaaaataaaaaattagccaggcatggtggcatgcacctgtaatcccagctactcagaaggctgaggcaggagagtcgcttgaagccggaggcggaggttgcagtgagccaagaacacgccactgcactccagcctaggcgagagagtgggactccatctcaaaaaaaaaaaaaaaaggccctctccgtgtctgttttcctaaatcgacctccttcagaggtgtcacaggacttcctgagctactttctaacaacccaagactggaatgttaaccatccactaccccacataacccttcattgctagtcacttaacggtcttccagctgctttgaaaggtactttatttgctgactcttgcagtgattttggctactaccgtccagaaaatgactccaagtgtgtggaacagccagaactgaagggccacgacctggagttttgtctgtacggaagagaagaacacctaacaacaaatgggtgaggtggccttttctcccttgtcacgatggatgaggtgttcttgttcagagtgaaagctgcttctctccacactgagatccaagccctactttagagcactatttttggcggggttggggaggggcaggatatgaaggcctccttcaagggtcaactacaggaggtgagccatgagtgcttggtgtcagaggactcaaccccaccaacaccacgaggcagagcaggagaacaagctcggccagatcctgcacccctgcctcccgcccaaccacccccaggaagggaggagaggcgagggacccacaggcagaatgacagaagcgtcccatccgccatgaacgtccatcgctcgtctggcacagtttaggcacagccagggagagctctgtctgataggactttctttggtgatggaagtgttctgtaatttgctgtgcccaatatgatagtcactagccacacatagctgtggacactagtgtaaccgaggaactgaaattttcgttttaatcaattttaagtagccaccatattggacagtgctgctctagacgggcctcattacctcgctcccctgataacttcccctctcccattttgtaccacttgttaatgagcttttttggggtcagatttctttggcacagtctcttaggtagaaagaacaggcatgtttctgacagcaggggacagagatgcttagtttgcttaaggcctgaaactacacaaaatatcccccaaaacatccctgtggacattccccccaggcctgaaacatgacgtaaggatgggaagcttttcggcagcttttcaaatcttgtttccaagaaataggcaggtacccaggaatacatccttatcttctgttaccaaatcttctttgcctggtaggtaccggaaaattccaggggacaaatgccagggtggggtaaatccagttcgagaagtaaaagacttgaaaaagaaatgcacaagcaactttttgagtccggaaaaacaggtatgttaaaataggtctagttttcaggtacaaatgggattttgtgttctgctaagaaaaatcaaagttaaagcatcaagagttttgttactgataaaaagtggtcaaactacttctctcaggcttcccttatacaggaagctgttagcatgaaggatgggtcatgtaacccagtgataagctcaccctactgaaagctcttttcttattgagggttgggggatgatattctgtaaagttgtaaaattcttaaaatcatacagttgtggaaatttctgaggctgagagtcatttaggaaaacaaaaaggttgtctgtgggctgggtacagtggctcacacctgtaatcccagcactttggaagtccaaggcaggcagatcactgaggtcaggagttcaagaccaggctgtccaacatggtgaaaccctgtctctgctaaaaatacaaaaattaaaattacaaaaattagctgggtgtggtggtttacgcctgtagtcccagttactcgggaggctgaggtaggagaatcatgtgaacctgggaggtggaggttgcagtgagccgagatcgtgctgctacactccaacctgggcaacagagcaagactccgtaccaaaaaaaaaaggttgtctgtgaagggccatgacctggaattgtgcatgtgtggaagagaagagcactgggcaataggtagggtggatctctgaccaagtcatgttaagtatgttcaaagtgaaaaattgagctatggtaatgggctggttttgatttaaatgaagcaagttacctgtcgggcatggtggcttactcctgtatagtcccagcactttgggaggctgaggtggggagatcagttgaggctatgaattggagagcagcctgggcaacatggagaaactccatctttacaaaaaaaatacaaaaattagccggatgtggtggtgtgtgcctgtagtcccagctactcaggaggctgaagggagagaatcacctgagcctgggaggtcaaggctgcagtgagccatgatcatatcactgcactccagcctgggtgacagagtgagatcctgtctcaatttaaaaaaaaaaaaaaaaaaaaaaggttatgaggctgcatccaaatctgtagcactgaactacctgtggaactggagatgtgtaaagaggaaacctcttgataatgaaacactagaccagcagcatgacttcagatgctcaacagcaggcccgtttcccaattcgtaataggagaggtcaagctggatcacctgcagtccctcctctctgctgttctaagggatgagggactgacaaggggtgggattaaggagatgatgggagaggagtgtgtgagtgtgtgtattggtaagggggcgagttcctccttctgtgcacccttgtcctgggctcctggtgactctcctcagagtgttcgtgtgtgtgattgcacaggactcccacccacagggacacagcttgtcctagaatccagctctgcctcctctgggatacattgaaaacacacactccctatttcccacccagaagcaggtaggtcacatgcaaacagtgatatgataaggcttatttataataatatataaaaaattaagtaaacaaataaatcttggtgtcatataatggcctgcctggttcttctgacacagcttcttcccagataatggccctgttctagagtcattcagcctactgttacagtagtctccctttcctactccacccttaagccccaagacttgtgaacagtggtagtgtgaagcaatcatacttgatctaggcagttgcccaggcttccagtgtaactttgacatttaaaccacagaatttgaaggttcaaggcagttggagctaagatgactctctgccagctataatattctcctggtaacactgagatggttcatcttggggggttggaaaagagccatcattaagcgcatcaggactgcagatcattcacaaagagatgaggggaatgagtggctgccttgacctcagtcctaggatatgcatgcctaaaacttttgtgtttgtgttttaatttctcaagaattccaagtcaaattctgttccaattatcctggccatcgtgggattgatgctggtcacagtcgtagcaggagtgctcattgtgaagaaatatgtctgtgggggaaggtaaggaacacagaagtcaatccaaggtactgagttcaagccagaaggctgatctagggcatatggctgagtctactcttggcaaaaactaggtacttgcagtactgttcctgaaaaatcaggcccaaatcttctcatgtcgtacatttttcatatgtcaaccatggactgtgctttctgtgtctgtgatgcgttcctgagtgtataaaactgagaaagtccacagtcctgtaagaagtgcacccctgctgtgtaccaccgagtgttaaggaggtttctgttcacaggttcctggtgcatcgatactctgtgctgcagcagcatgcagaggccaatggtgtggatggtgtggatgctttggacacagcctcccacactaataaaagtggttatcatgatgactcagatgaggtgaggctatttcttcttgaatggtagtacccccccccccaaaaaatacaagaaaataaagtctgtcttctattcatgatcaagatatgccagggccaaggcgacttaatgaccataagatttggcaagcccagaaactaggtgattgcttttgaaataggagtgttgtggtctgtcggtaatatggtgcatgtctttttcaggacctcttggaatagctcttcagaggagctggacccagcatggatggtggaaccacagtacctcttacactccctgtggctccaacttcaggaaataaatttcccattgcgagggacccagctctgtttctgctgcttccatcaaagccaaaaggacctacactaaagaaatgcagggtgggggtggggaaccctgagcacttttttacaattggctctgagaaaaagggagacattttaaattctttaacttcttatttctcgtcctgtctctttgcaaagtatgggcttttttgtttttgttttttaagggaaacgaaatggaattcgaagggaccttttcactaaccccacttctgtgtgttctgcatggcgcctgccccagggcatctgccaactccagtatcagctctcacagtgtacttggtaccatccctgggctctgctggcgagacgaaacagctgtagagatgaaaacaggctgcagaggctggcacagcctggccggcttttctccatctggggacagtcctactccaagaacactgcacaccagctcctcacacagatcccacttactctttttttttttttcagagaccacagaccacagtgatttttcttttcccttgtttaattaggcaatacccttgttaattgccctttggcaactaacttaaccatgtgcttcccacacagtacatcaggaaaacttacagggcaatatttttaacttggggcaggaagaagggagcagcagagaattgactagatatagcacctattaaaagagaactcttgcttcttctgagatttttcaagctgtgctttgtgtgtgtgccagtagacttacgcaaggacagggtacaaacttagctggaagtctgcccaggctgaatgatctcttccctagagttgattgtcgggtacacagtgtgaacccccgaagacggaacctcacagtcttccatgttcccttcttaactgtcgtgtggctcgttgctaaatcatgacaatggctgcctatctgctgcttcttaggttgctgttgtacatggaaccaggactagagattttttcagatttatagacttaaaaaattagaattttattaccaggctttccttctcaccccttttttctgactttgccaagtaatttgttgacacgaaaattttggaggaaccaattgaaaacacacttccagtctagatgatgctttgtgtgatacattaagttcttattttggattaaaagaagttttccatttgatacctctctaaattaaataaattatagaatgtagttgggtggattttggggtggccatatagtaatggaaagctgcaataattagttttaatacagcttgaatatttgctatatagaaatatagtatggaaagtttttggtcttaatgtagctactgtgcgggtcacagtttctcccaatgattatgactgggacattctttggtagataccatttgctactagtttattttgtggctagaaagtcagttttgtgtgtttttttttttttttatttgaagtgccaaattaactttagtcagaatgtgagcagatggctaagttctctcctccccagaatggattaacagctgcgtggaaagtgggggagagagtggatggagacttttagagatgttaaaactgcagtagaatgaaatgagtcagggagcttcagttagaaaataaagttgaggcagtttttgtgaagataatatggttagggctggagtgcactagtctttttgcttattcattttgcatggttttaaaattaaaaataattccgaagatacaccagctcacaaatgaaaacgtcagcctctgccccaccctccctcctgcccaaagtgaatttggtactcagaaaagaactgtttataccactcacctttctcccagcatgtactcactgtgggcagatgcaccaatacatggtaatcctcttactcattttaagacgtaggaaactcaatattcttctctaaccatatacgatagggctcttcgcttttaatgatatctgggatttctgtggaacttggcaaattttcagagcaccttcactcacataatgtcatttgaacctcacaatgttcttgggatggagtcagttgttcagggtccccgtgtgtgtgataagcagtgctggctggctgtcttcagaactcttggaaatctttacacatgcgagtgctaaccactttgagcaaggctgccttcttgtagatgacttgctgttctttatgacagggatcagtggcatttgtttcctagcagtatttagcacctttttgccaccttggtgaacagaaaattgtattttcctgtctttcatggctgaaaacaaaagtaatgggaattttaaatacgtttgcagaaactgcccctcccctcattgagggtcactgctcaagagtgcaggagtggactctccactgatgggtctccctccccatcctggtttccaccccgggctggctagctctgttggtttgaagactgacagccagcctggctcattctcattattggctagttagctttctttatcaacctgctcactcacaaatgtgtgccctcagccagagagtaagaaagcccaaatctgttacagcttctaaaaaaatagatttctaatttgtcctactcatgttaggagcattatctttgaaggtaaaacatagtgtatcattgtgtaaactcccaggcttgatgtagcagaagagatcatttctggaggcttcagcaatggaatttagcattataagagagattggacaaaccagtccaaagtggtccgagttcttaaatccaggtagggaactcactcttctttcttctctggacctaattgggcattgggctttagtgagaccacagaccaggcccgtctctcctgtaggcttttaattcaatggcaactctatttcaaagaataaaagcctttggagagttgcggcagttctgggggcgggctcaggagagtccatagatcagccgtaactggaacgtagaatctacgtctgcctctgaatggacttcccacctcctctctcttgctctgatgcttgcctctgggcctctccatgcccaaggtggtctttcatccttgacaggctggtaatgtgctggccacctccagctcctgcatcgagtctgtaaaccagagctggttctcatggccttcgtcacgataccaggatacggaggggagcccagggccatccatacccaccccagggtaacggggctggcctggcattagtcattatttagtttccaggccaaccatccagatagagattccctctttcctttgagcagtgctctcaagagctccgtgcctgtccacaatgacctagagtgcatcctgctcattgtcagtgtagcccctcgcccctatattcatccaggatacttggaagtgctaaaataggaagggattcggctttcaactttgctaccatcttccctgaagcaggaaaatgaacatggacttaaatgttctttgaaaaaaccaaagttttaagatttgctgtgtgatgaagtgacagggagggccggagtcagcaggtgccagactttctgttctgtctgccatgggtttgtccagctcaggtagctctaggagcaccatcctgccctagcagagcccaggccttgccctcatgaagcatcattgaaatagcaggagcatgttgatttcttggttaggttgcattataataacaagagtcagaacattaattcgaaacaacttgcagtatgcatttcttcacaccagtacattcttaagtgtacttgtttataaggaataacataaactaatctgtacctttatatatatgtgtgtgtacatatatacatatataaactgtatagtgtacatggtaatgatttattgctatgccccagatccttaatgtagttctcatcctccgcatgccctcagccacaagcgggtgactgactgttccctgatgatttggcccacctcctgtgtttggacctctagggaggagggttttggtcatactctccttatcctcgtgcacagaaatgctcagggtccccatgtgcctgttgttcagccctctctcttgttccctttctgagcatgtggtccttccccaggctgtgggacagctgccttcccacgaaagtgtaaagcagtattaagatcattactgcatgtgccctaaaaacccaagttttctattcccttaggacagaaaattgcatgtgaggtgggataatcgagtttcagtgacccacgtcagttacacattaaagccagaccccatgataaaattccacaaaatggaaataaaactcaaatttctttagcattgtgtaaataaatctgaatgtgtttaactttgtactggtaattttctgtatatttggaatatttgggttaaaaataaaacagactggactttgttacctgacctac

SEQ ID NO: 37797 - DNA, 82832 bp, Homo sapiens
tagacctcagcttcctctgtcaccatggtgccggctcggctgggcccggcggtcgccatggtaactggggcgggtcgcagggtcctggcaggctgggcgcatgcgcgcggggactacaagccgcgccgcgctgccgctggcccctcagcaaccctcgacatggcgctgaggcggccaccgcgactccggctctgcgctcggctgcctgacttcttcctgctgctgcttttcaggggtgagtttgcgcgtttccgctgttgggagactagggtctgggggcgacggaagcagagcgggccgaagctgctggagccggtccgggcgaggatagcggtcctggctccgagggctcccggggtcccgggccggaggggcggcgcgcgcccgcgtccccgcagccagggctgggactcgggcctggctagggcgggggccctgggacgcccggcagttggaccggggcggggagctaatttgggatggggggcccgtcccaggcagtgagtcggtcccggacagccgtcggaccccgggggcgggctcttctcgggcggggtcctgtgctgggcggtgggctcatcccccgggtgggctcctcccaggcggggtcctgtgctgggcggtgggctcatcccccgggtgggctcctcccaggcggggtcctgtgctgggcggtgggctcgtccccggggtggacccctcccgggcggtgggcacggccctctggagggagcgcggcagctgcggcgtgggcgctggaacttgctggaagaccctgcgcagcagtgctgtgctctccagaagggacggtgagcgggggacgtagctgaggaccggcgaggcagagctccgaggcctggcgggctgcttggtcacagccctctggggatctgcagttcatttgactcgacacaaaggaactgcttttcttttacagaaataaaatggatatcaatccagtaccttttttgtctctggcctggccgaggagaccacgcagactcttatccggaaatagcattcggggcatttgatcaagacacactaataaacttgatagttttgtgcattttctttccctctgtttggaattctcattagatccacattttcctggacagttgtacagaggactaaaatagctttcctttagtgagcttgtactgtctactaggcactttggagccattatctcgtttactcctttcagcagctctgtgagataggtttcattaatccattttcagagtcaagtctagtctgctttccaaggctgcattctaagtagtgaagcctcaacttcatatttacctaaagcaggacaccacactcttcccctggcagccatccgcaggtaaccagaccaggacctttttcggttcttagattattttattgtttgaattgccactgtcatcccatgatgttttccagaatatacaaattaaaacacggagggactgtttaggagtgaaggtggacagattttggaaaacaaagcattcctgtgtttggtgctttatgctaatgggatgctcgtgatgggctgtgacaaaagatgagttttagcgtatagattatgtacgctaaggcaaagtctgtatactttgcctgaaagtgattcccaaaaccaaatgctgttgggagataagtgatcaaaggctagccaggggacaagggtgtcaggaatgtccagcacccgctgtgttggtcacactgacactgtcctattcacagcctggaacaactctctattgttgaaaagatctgttcacgtgaaagtttgcagtttttgttgcagaagcatttggcagtttagctcaggaatgaatttcaacttggtagtttgttaataaaactagaaaatgcaaagagcttcacttacccttaacctctgatttccttcccctaagggactagttttgtggcttttttgctggtaggggctgggattcacatgcagagcgtaggaggaagaatcaaattttgcaaactagttctaatgacaaataatcgaggtagtaggatgtatgaatccactttgaaggcgtgtagctatcttttttttagtaggggctctttttccattatttggtttatgctttaagctaccctaaaactgttcttccagaagtcatgactactgtgtcctttttattttttatgattattctcaattgctattactatttattttcatcttaaaaattttggttcttgatataacagcaaacatttcttttgtggttaccctttgccaggctctgttacaagaatttaatgtttgctaatttatttaatcttgataactctaagaagtcgttactattgttgtgcccttttgtggatgagggaacagaagtatggagagattcagacccttgtcgggagtgttatcctgtgcgttttaaatgggaaatccttcattatttgtgttaatccaatttttagttatttgtattattccatttgacggtggagttcttttaatggatcagtttaaacagattatcaagttttcaacactatgtggtttgtatataaaatattcttttgttgactcatgacaggtgcagttcagctttacaaatgttatgccacatggcttttttgaatgattgtgtactcattagtgttaggtttccaaatctttgatattctagagagaagtgccttatttagaattaaaacagcaacagttttcattcttcagataagacaacttgtgtgctgaagcatatcaaaatctgaaaatcaaaatttctgggaaatttttgaaaaaatgtttaattcttttatttgcatctgtttggactccagtaacgttttttagaatggcatattcttttatgttctaattcttaattatctggcagatataatcattgtcagacttgtgtgtatgttttaaaaaaaacaaagaacacctgtcttgaaagcatgcagtactttatatcagctgctcattcccacatgacttgttgatgggcatttgttcttcagtgcttcaggctaaggagactgaatggataagtactagagatacttaatcataagtaattgcagtattacattcaggcagaattatccacacaacccctaagctccatggaacttgttcttaaactccatggggtgggtttaaatcagttcttttgaaagcaaccagactttcctcaagtataagatggccacataatgtaacagacgcagctatggatttagtacattcgactagcagctgttagagatgtggtattagcaaattccttctccataaattctttgaattttttaaaagcacaaatgtagtaaaagaaaggaaaatatgtgtgaatgaagttaggatgtatggagtctgctgaagaataccctagtggtgaagttggatttttttttttttttgagactgagtttctgatgcagtggcatgagctcagctcactgcaaaactcactgcaaaactccgcctcccaggttaaagccattctcctgcctcagcctcccgagtagctgagattacagatgcgtgccaccttgcctgactaatttttttattgtttttagtagacatggggtttcaccatgttggccaggctggtcttgaactcctgacctcaagtgacctgcccgccttggcctaccaaagtgctgagattacaggcgtgagccaccacgcccagctggattctcttttaagatatgtttatagttggccgggtacagtggctcacgccagcactttgggaagccgaggtgggcggatcacaagatcaggagatcaagaacatcttggccaacatgatgaagccctgtctctactaaaaatacaaaaattagccgggcgtgctggtgcttgcctgtagtcccagctactctggaggctgaggcaggagaatcgcttgaacccgggaggtggaggttgcagtgagctgagattgcgccactgcactcttgcctggggtacaagagtgaaactccgtcttgggggaaaaaaaaagatgtttatagtcaggtggtgtgaatgttatgctgtcaaagttgaatgcaaatttcagatctttgcatgtactctcagaattctagcagtatatgcaaatagcttcactggagtgtaaagcgatcccgaaagaaagttttggtaagcacattcttttacacctagtttagcaaggacagtatccactgtggtactctatatggagagctaaagccttaattgactgtctctctgcttcttggcatggcacacagaaagcttcctgagagttagcccttgtttctgatgtcccaggaatgctgtagtgttttgtgttggtgtgtttcttttggttttaagtagtatttgttatgtgttatatattacatttcccatgagtagttaatacatacagcagaggtttcagtgctgcttgtataaagacatcaaactatttaatagagttaggactatatgaacattttttcttacattatctttcatttgcagtttcccaaggtttctatggttcagccttcttcctgaaaattattgccaaaatcaaattctgccatagtcatgctatctgctatgtttgacaacctcagcccacagtgatccttcctatctctaaataagcttagatcatagtctctagttcagtttagtacaacacccatttattgagtatctatgacgtgtcaggcactgttctgtgtgctagggttgcaaaatgggtaaaacatcgccagtccttaaagagccagggtaattgactccgatttacattgggctttagttgttaggtgtcagtgcattgtattttctcaatgataataaacattttgttggtaacagaggctgaatttaatttttttgtatctttccagaggtgattctagtaaatattcagtttatctcactttgtcacttgaaagtgagttaacatttcttaaacactctctttgtgtcgaggcatttttaaaaaaatgtcttatttctagtggccctaggaacttctggaaaagtgtcagtttgtactacagtagttattctggaagaaagagaatggtaataatttattgacttggtttaatttcagaatctttctgccatctgcttttgtgcagttacaaggttaagaaggagaaaaagatggagaaatgcttatgatatcatttaagtgacacaagctgcaggtatactagtatatactgtatgattacgattacacaaaacatctatgcttaggggaaaaaacaggatgagaatgaaccagactgttgataggggctgtttatgagtggaagtgttacagcaaattgttttctgcttttctttgtttttgttttcctggttgattcttgtattcctttgtctgttttccaaatgttctttgatgaggatattttttgtgtaatgaaaaaagttgcatcttggtttggcttccagtagatacaatagtggaattttaaatttggcactagtaatgggaaaatataatttgtttgtttaatgtgatagcatgtggattgtgcctttttctagcttcttaatatcagccacattggatgaaggagtggctgactggaagttcagttgcttgataatgtattgtttgtgactcatttgagagattagttgccactgacttttgggtgggggagtcagctgtggtgtcctcagcaaatggttagctggaaaactgagagctgccgagattaccggcctccccccttctttttgaacacactgacaaaacgatctgagtaatggcctttgttcacctgttcaaagcgagccaaaatttattgagcacctactctgtggcagcccctggaagatctctgttttcttcctcttgagtgataaaaatacagggtgaaattgacttctgttgaaactagactctgaaagatgtttcccgaagcactctgtcagctgatgtgccccatcacttcttcctgcccaacatggacttccctgttggatgtctttctctaaggaaaatatttaatgtctttagaatgaagtgcagctgcctggaagcttagagacaatgcaacaaatccaaagacagctgctttttttttttttttttttggcaggggtggggcatgtttttcctttaaagcatctctgtcagggtactgaaacttaatcagccaatccatatttatttggtagtctccattttcatggcagtaaagcattccatgggcaaagcaggagaacttaagataatgtcttccctttaccagagggaacatatagtttagtcaaataacagagcagcatttgggtaaatattctgtgggtttagaagtgagagcacttactctctctgggctgacctggtagaggagaatttcaaaaaggagctggacttgtacagataattgactgacttaagtatagatttgggagggacagcggtgtggatgggaaagtggaggaaataatgtgggcaaaggcatggacttgggaatgcacatgttttgttttgggatgagtgagttataatgattaataacacctgccaattactgaaaactatgtgataagcattgtgcttattgctctatctggggtcttagtgagcttgggcttctatgacagaataccacaaacagggtggcataaataagacatttgtttcacgggctctggagcctcacctgggtaattttttgaacatttttttgtagaaacaaggtcttactatgttccccagtctgatcttgaactcctgagtttaagggatcctactgccttagcctcccaaagtgctgagattatgggcatacaccaccatgccctccctgaatttcttttcagttattctacttgttatatgttgtggtttgtatacctgtgagtttctttctttcttgagaattctcagttcttatccattcaaatatcacctagcttgtacctgcttaactttttctttctgtgactgcaattaaacatgtttagtcattctgtccttcaatactgttaacctcctttgtcattttttcatgttcttgtctctctgtgctattctgggttctttattcatttttgttttacagctaactttttctgcttccagctgtatctaacttattattgataaccaatcaatacacagtttttccaccaattatattattcatttctaaaattttcttggttctttttataatcaagttgttttttgcttgcttaatttttttactccttttcttttcttttctttcttttttttttttttttttttgagatggagttttgctgttgttgcccaggctggagtacaatggtgcaatctcggctcaccgcaactgccacctcccggggtcaagcaattctcctgcctcagcctctggagtagctgggattacaggcggccgccaccacgcctggctaatttttgtatttttagtagagatggggtttctccatgttgatcaggctggtctcgaattcccgacctcaggtgatccgcctgcctcggcctcccaaagtgctggatcacaggtgtgagccaccgcacctggcttactccttttcaaatttttaaaacattgtgtgcacagctgttttgtattccatatgtgatatttcaaatatctgaagttcttagagatctaaatctgttgttatttcttatgacttgtacatatggtggtttctttgcttgtattataaatggatatttgattgatattaatctgtgaaaatctaggcctaacctaaggatactttctcttttttctattggtgtgcaccaccacactgggggaagtattttttattttatttaatttttttagagacgaggtctcactatattgcccacactgaactcctggtctcaggtggtccttcgacctcagcctcccaaatagctttctttgcaatctcactaacatctattgcttttttttttttttttttttgagatggagtcttgctctgtttccaggctggagtgcagtggtgcgatctcggctcactgcaacctctgcctcttgggttcaagcgattcttctacctcagcctcccaagtaactgggattacaggctcctgccatcatgcctgactaatttttgtatttttagtagagacagggttttgccatgttggccaggctggtctcgaactcctgaccttaggtgatctgcccaccttggcctcctaaagtgctgggattacatgcatgaggcactgcacccggcctgttttttgattatttaatagccattctgactggtgtgagatggcatttcgttgtggtttggatttgcatctctctgatgatgagcgatgttgagcatttttttgtatgtgtgttggccacatacatgtcttttgagaagtatctgtttatgtcttgcccactttttaatgggattatttttttcttaagttccttatagattctggatattagtgtgtcaaggatgccttttttttttttttcttgagacagagtttcgcttttgttgcccaggctggagtgcaatggcgtgatctcggctcactgcaacctccgcctcctgggttcaagtgattctcctgcttcagcctcccgagtagctggggttacaggatcctgccaccatgcctagctaatttttgtatttttagtagagacagggtttctccatgttggccaagctggtctcgaactctggacctcaggtgatccactcgcctcagcctcctaaagtgcaagccaccgtggctggcgcctttttttttttttttttttttttgaaacggagttttgctctttcgcccatgctggaatgcagtggaaatctcggctcggaaatcactgcaacctcaagtgattctcctgcctcagcctcctgagtagctgggattacaggtgcccgccaccatgccacgcctggctaatttttgtatttttagtagagacagtgtttcaccatgttggccaggctggtcttgaactcctgaccacaggtgatccgcccgcctcggcttcccaaagtgctgagattacaggcgtgaggcaccgcgcccggccaaggatgctttttcttgagagtgcagccttccactgagtgacagtgcctgtctctggggtgactagctgtttcaggatccctggcattacttaaaaatctcaggctctgctttcctcttgcctacctttctgctggtccaagggctcagtgtccccactggagtgtttttttatttgtttgtttttaagctggagtctcgctctgttgcccaggctggagggcagtggcatgatctcggcccactgcaaccaccaccttccaagttcaagcgattctcccgcctcagcctcctgagtagctgggattacaggcatgtgccaccacacccggctaatttttgtatttttagtagagacggggtatcgccatgttggccaggctagtctcaaactcctgacctcaggtgatccacctgccttgatctcccaaaatgctgggattacaggtgtgagccaccgcacctggcccactgaagtgttaaaatgaccctttgctctcagtttaacactcctacccatctttctgctctctggttttagcctacagctatattggtttgtccttttaaagatttccccgacttccttgtgagacatggaataaaaactatgacttatgtgagatctcgttgttggagcagaagggccctccagggcatctaatcagctacacttgtgaaaacaggaattggagctttacttcacctgtttcccctctcttaatggaagagtcacacacccttctttaagtgttcttgttattagggtaatgtttttgttttccttttttaaatacaaaattatgggccgagcacagtggctcacgcctgtaatcccagcactttgggaggccaaggcaggtggatcacctgaggtcgggagttcgagaccagcctgaccaacatggagaaaccctgtctctactaaaaataaaaaaattagcctggtatggtgacatgcgcctgtaatcccagctgcttgggaggctgaggcaggagaattgcttgaacctgggaggtggaggttgtggtgagccaagatcacgccattgtactccagcctgggcagtaagagcgaaactctgttacaaaacaaaacagaattatgaacttaaatatttgctttttttttcatcgcatacacccccaggaagttctgatattcttgagggttggggttgtatgcctctccctaagaatcactgctttaaggatggcgctctgttatttaaaaaatataccaaaccctacaactataatctctgtccttgaattagtttgtctgaaaagcaaacatctatcattaacttaaactttggagaattatagctattccacactagacagccacctgaaacagcacctacttagtctactagtaacagctatagatgaagacattcagggacaaaatacaaaggtaactttaccgagctttccagctgaaatctggattccgttctccacaggatgaagtgctggtttactgaaaggtgccgtctgatgtaatgtgtggacaaaaaccacccactgcatctctggaaggctccgttgtttgcagcctttcagatagttttctgggtgaaaaaaaaaagcactgtatcgtgggtgttaggcattttggattcatttcctagctttgcatgtgattcattttttagaccttggggaaataatattggttgtaatccaaatcacttgaaagtaatttaaaccccacctctctcacactaccaccaaaacatccacatttctttccctttcttattatataacccaccttagatatatgagttttagatccaaaggagtgactttgtaggcatataatttgtaactgattaattgaattagttcatatttgttaattataattgcatttgaaggttttgaaaatgtagtcaacagaaatatcttcctcttctgaaaatttaggtgtgttttgtagccaggtaaacttggtttgaagccttcctctatcgagagaggttggaaaaatttattcagaaccctcgtttttgtttgtttgttttgttttgttcttttttttgttttttaaatctacagctttacttactagatctagtgttttaagaattcctgtgtttgtttaccatgaagaaaaaatgaataaccaattggttgggttgttatttttaattcaatctgatttctaagcatcagatatgaagttttcactctgaccatacttggtctagctgataagtccactggtgataaagaatgagcttagaacctttgctgtgaatcactaaagcagtagctgagtaaagaaaaattctcaatcttttatttgccagacactgttttagaccttggggtaacgtcagtgaaatagcttaggttttgactacttcataggaaaagatgaaatctatggactcctccaaaaagtgcttttatgcatgatatggtttggctctgtgtccccacccaaatcttgtagctcccataatttcctcatgttgtgggagggacccagtgggagataattgaatcatggggtgggtctttcccatgctgttcttgtgatcgttagtaagtctcttgagatctgatcggtttaaaaaggggagttttcctgcacaagctctcttctcttgtctgtcgccatatgagacatgccttttaccttctgccgtgattgtgaggcctccccaaccacgtggaactgtttaagtctaataaacctctttcttttgtaaattgcccagtctcgggtatgtctttatcagcagcatgaaaatagattaaaagagtaaactggtaccagtagagtggggcgctactgaaaatacctgaaaatgtggaagagactttggaactgggtaataggcagaggttggaacagtttggagggctcagaagaagacaagaaaatgtgggaaagtttggaactcggtagagacttgttgaatggtttttaccaaaatgctgatattgatatggataatgaagtccaggctggggtggtctcagatggagattaggaacttgttgggaactggagtaaaggtgactcttggtatattttagctaagagtctggtggcattttgcccctgccctagagatttgtgcaactttgaacttgagagaggtgatttagggtatctagcggaagaaatttctaagcaggaaaacattcaagagttgacttgggtgctgttaaaggcattcagttttataagagaagcagagcataaaagttcagaaaatttgcagctggacaatgtgatattaaagaaaatcttgttttccgaagagaaattcaagctggctgcagaaatttgcataagtaacaaggagccaaatgttaatccccaagacaatggggaaaatgtcttcagggcatgtcagaggtcttcacagccacccctcccatcacaggcctggaggcctaggaggaaaaagtggtttcatgggccgggcccagggtccctgtgctgtatgctgcctatagacttggtgccctgccttccagccactctagccatggctgaaaggggccagcatagagctgaggccatggcttcagagggtgcaagccccaagccttgcagcttccacgtggtgttgagcctgcgagtgcacagaaggtcaagaattgaggtttgggaaccttcacctagatttcagaggatgtatgaaaatgcctggatgtccaggcagaagtttgctgcaggggtggggctctcatagagatcatctgctagggcagtgcagaagggaaatgtggggtcagatcccctacacagagtccctactggggtactgcctagtggagctgtgagaagagggccaccatcctccagaccccagaatgatagatccactgacagcttgcactgtgcacctggaaaagccacagacactgaacaccagcccgtgagagcagcggggagcaaggctgtatcctgcaaaaaccacaggtgggtagctgcccaagaccatgggaacccacctcttttatcagtgtgacctggatatgagacttggagtcaaaggagatcattttggagctttaagatttgactgccttgttggatttcagacttgcatggggcctatcgcccctttgtcttggccaatttctcccaatcattttggagctttaagacttgactgccttgttggatttcggacttgcatggggcctatagcccctttgtcttggccaatttctcccatttggaatggctttatttacctaatgcctataccacattgtatctgggaagtaactaacttgcttttgattttacaggttcataggcagaagggacttgctttgtctcagatgagactttggactgtggacttttgagttaatgctgaaatgagctaaacttttgggggactgttgggaaggtatgattggttttgaaatgtgaggacatgagatttgggaggggccaggggtggaatgatatggtttggctctgtgttcccacccaaatctcatcttgtagctcccataatttccttgtaatgtgggggggaaccgatgggagataatggaatcatggggtgggtctttcttgtgctgttctcatgatagtgaatcagttttatgagatctgatggtttcaaaaagggaagtttccctatacaagctcttctcttgtctgccgccgtgtgagatatgcctttcaccttctgccatggttatgaggccttcctagccatgtggaactgtaactatgataaacctatttcttttgcaaattgcccagtctcgggtatgtctttatcagcagcacgaaaatggactaatacaatgcatatacatgaaaagttttatatactattttgggggatttataacccccccagaagaccatttatgcaccacctcaggttgagaagcctgctttagggccaggatccctatagaggacacatatttttagagtgtctgctgaaatagatgctaactgcatgtaaacttcaagagtggtatgcaaaagcattatgttattctcttatttattcttttcatgaagtctcttgaagcctgacttttctattttatggatgatgactattagtgtcaaacatctggtcattttctatgtatatttccagcttaagttactctctagaggtaggtcagagatgagactttgatttaaattgaaaacagattatgcatgtaattttagagatgcttacttctgtgattttcacagtgtttcatcctgttagtacagcttgtgcagacttaaggcatatgaaaaataggacaaaatgctgagatgaattgggtggaattcctctgtcatctacctccggtgtccatttacagcagatcgctccctccctttccctatttctccctcactctttctctctccaacacaggcaatagtggtgagagaaggtttttataacattggatgagggatttggactttatggaagccagaacaaatattttctcctttactaccctggggctagtatcccacatgctgtttgcaaattgcaaaaaacattccttcaagtgagtttggagtcaggtaactttttgaggaggagtgtttttgttttgctctctcctgaactcacagattttactctgtgtgcgtttcttgtcaagtacatttcctacatgcagagtaagtaaaatctgttaaaactttggttgtcattattctaatgtgtgaacagcatcttttagctcacattaaaaaaaaacaccaaaaaacctcttctaatgaaaccttgaggaagaaaattagctggagtttagaggctctgattttaagcctccatgatgggtccttttctatacctcctctgtagtggagtaaggatgtgacatgcttggggtaaaacctcagtgtccagtggaaatcaccttaccatcatggcagaaatcgctggatttggctttccaggtgacagaaatggggcacttctttgcatgttctttgcatctgccctttcatagagaattggggagatggaattggactctaaagaaatattacctttttttctcttttttctatgtaaaagaaagcttatggctacataataaggagaaaattggtcataagactttaattcatttttctactgggggatcacaggatttgtagcatggtctttggctctgtagaattattctgtcactgtattctgagtaaccctgagcattgccatttttcttcttttgttatcatggcctgtctacctcaaatgcaggtcatgatcttgtctttctgttcatctcttaactcattccccaacatccagcttcatatacctatctgtaaagcctttttaatggatctcttcactgaggtgatctcttcctcttctgaattcctatcatgaaggagcatagctagaccgaggtttgaatctcatctccgctatgtgattgttgaagtcaatttccttatctataaaagagtagtaatagcgtaaagtagctttgtggggttgttttacaaaatactgactatatataaagctcctatcaaagcatctaaaagtaacaaaaataacacaaattaaaattaatacagtcaaattaattaattcatgtgaagtgcttagcagagtacctgtcatagtagtaagctctcagtgttaggttttgtttttcatcaataagtgggagagatttgctgttactaactgtgcttgttcctgccagtacttccattactactatgttgcagttcatttgcttcttaattattcagaggcagatttaaagggaagctcatctaaccagttttagagcccctcgcttacaaaggaaccacttacaaggccctggatttcacctagcagtgtgtcctcaaattttcaaaataagatgctttagctacggtcagttaagatggttctcttcttccactcttcttccctctgtcatacttctctttatgttgggtactactaaattgccactggcatttttcccagccaagggaacttgaattgggtacatattcagtttgggttagtgggatcacttaggtggtccacagccactgttgtgggtagttgttcttgctgggcatctcagtattggaatggctgccaggaatactctgccatcttatttgactcacctaggtttgtaacacgaatttgtagggcctaccgtgaatgctagtgtaagcccctgtaatgccatggcagtgtggatgtggttgaaaaaccaggttatgagttttctcatgtcaaagggtatttaggattagtcaaactacaagaaaacttgaaatgcccccagatttaacagtggtccttaaaactctgcatgatttgcaataatgaattatgaagtagaaagaaaccattccaaactattaatattaaattttaaaattaaccatgctaaagggaagtcttaactattatttcctaggcagattacaaaatcatgggcatatgatgaggtgatcaaagatcctaaatatgtagcaaagattatagagactaaggaattaataaacatattgttatttttctaaattttgttttgtgttgccagcttttaaaatttgtaatatttttgtgatttctgttctcattcttaacaaacattctttgtacctaatttcatattcataactttatgtttgttttcctactgggggctccactatgactaccccagtcatagtcttccttgaatcatatcatttgttgttgtattgacctactaatttaaatctttaatggcaatatgcacttcctctgtgtgtatcttggctctaagtagtctgcgacttgaggacgggaagcttgtcttctgtgtagcgtaatatttggaacatcatatacatacaaatattcattgataagagaacatcacagtgtaaggaggtgagtttctattctttagttgtgggtttgggagtggggcaggtacttcactagctattttggaaggggctgacaagtgtttctgttcaaacgtattatcgccttaacagatgagaagccatggatgagtttgtatgtttctttatctttattttaaaataatttggagttagaagacctgggttctgctttgattgctgatactttgtagttttgaggttgtaataatctcctcacatatttgagccctatcgtattaatctgtagagaggtgattgtaattcccactttacagaatcattacaaggaccaagtaagattgtgtgtgtaaacagaattttaagttataaaatattgtgcaaatataaaatgttattctctgctttgctttattccttctgagttctgaagtatcatgagtcctctggttcttcaaaactataggttacaattctaatttacaataaccttctcttaaaaaagctccctttatggcttagttagatgagatagcaagttttaaaatctattttcctatattggaaaaatattttatctagaggacagacgagtatcctggattttttttttaaagaaaacaaaaatctggttttaagtttcatgagtaaagaagaaaaatttctctttgacattcttggatttaaaaagtggttcagtgatatttgtagaaaagattagacctcctatgcctaggggaaattttcatgcctgaactaggaaactttgaataataagaggttttagtggaaattccagcatatttttaagtaaaggaactgccagtacaaatcagtgagtttacatacaaaataaacagcttattaaataaatagctattaagaatgaatgagttcaggacaagaaaatgccacgtaaatagatagggctccatgttccataggctgtttccacctaagaggttttcttatttcaagttttaaaaagtgtgtgagtggttttttttgttgttgttgttgttttgttttttgatgcggggtcttgctctgtctcccaagctggagaacacggttcgctgcagccttgaactcctggggttcaagcaatccttctgtctcaactttccatgtagctgggaccacagggatgtaccaccatgcccagctaattttttaattttttgtggagatgaggtctcactttgttgcccaggctggtctcaaacccatgggctcaagcgatcctcctccctcagtctcccagagtactgggattacaggtgtgagccaccacacctggccaagattttagtattgtcttttcccaaacacgcttagtgaaatgaagcaacagaaatgtaatgtcctgagattattgtgccatgaagtattacaatgaaggagatacacacacacgcacacacacacactttttttgcatattaggaaaaagtagggaagagtatggaagaaaaggaaaacactgtaaatcaacaaataaagtatttctgtttaagaatcagagagtatatatttttcaagaaatgctgaaagaaaccatatgcttaggcattaaaacaaagcattatggacataaaatcatgacctcccacctctctcttgtggattatattcatattcatttgaaagtgttagttgaagtccttagaatctggaagaatttattattgcttgaaagttagtggcactcattggagagcaaaatcttggactctgccttgttacacacctagctatataaggtactttttaaaaacctttctcttcttacgtatacaggttgttggtgttagacttctctggaagaaagaactgtcttagaggccaaatctagtcactcagtaactgggctgatgatcaggggacccaggttttgccatggatttacactatgctctcagcaagttacttaatccctttatgttaagttttctacccataaagcaaatacctaaccctcttaattcgcatggacatataggttctagaatcttagagcttaaaggtattctgtaaaccagtgtttatcaactttggtactgttgatatttggagtggataattttttgttatggaggctgtcttgtgcattgtaggatgtttagtaacatctctggcctctaaatacaagtggcaatatcccagttatggcagccaaagatgactgcaggcatttccagatgccccatgggtggcagtatcccagttgggaaccactgctgtaagacaggattcagcaagaggtagctgatgcccagggatgttcaatgcctgctttagaatacatcactgttaagtgctgggaccaggactagaactcaactttattaatatactgccaacccatttatccagctttccccttaaattcacagtttcattccattccaaaagcagtggcatatgtttaaaatttcgacaccaaaacaaaaattgacaaattctctacatttaccaatgatgtattacccacttgcttccattttaccacccccgaagctcttatcataccttgctaaagaagcattgctttccttatccttaaatgcttacgaaatgcttgggcaacatttttttttttattttttatttttttaaattttaggtttggcttcattgtatctgtatcaatcccaaaaggtagaaaaccaagtatagaaggttatattctttaaggaaaaaacggaatacaaaatctattttacatgtacatccttttctatatacttaagttgtacaaccaattctaatgacaagatgcatttaaatttgtgttctggaataaattgctaaaatcattaacctctgaacattaaatcactagcaatagaacaatatataaataacagttttaagacacggatttgtgaatatgtcattgccacaaagacagtaaaatgtcacttaattgggcttggtctgcacattaacacacctaattacttatggtttatatatatcacatctgtgtttgtttattttttgagatggagtctcactctgtcacccctgctggagtgcagtggagcaatctcagctcactgcaacctccgcctcccaggttcaagcgattctcctgcctcagcttcccaagtagctgggactacaggcacttgccaccacgttgggcaacatttattaagggcagtcggaatggatggtttgggaggtgtcagttcaccattataagccatataggtgattgtaagttggatatgatctgtgggacattgagaactatggaattccatgctagtgaagagcactagaggatctcgaattgaatgtctgtttatcaaataaatcaacatgctgccttaggtgtatgctgaacctccttgtgtctcccattctttctttatatactttccagttcgtggtttttaataaaggcaaattctgcacacatactaagcagcacttaggatattttgtttggttgtttaattccatatctgatgtttcattatcatatcctaggttttctttttcttttttttattatactttaagttttagggtacatgtgcacagcatgcaggttagttacatatgtatacatgtgccatgttggtgtgctgcacccagtaactcgtcatttaacattagatatatctccaaatgctatccccccatccctgtaccccacaacaggccccggtgtttgatgttccccttcctgtgtccctgtgttctcattgttcaattcccacctatgagtgagaacatgtggtgtttggttttttgtccttgtgatagtttgctgagaatgatggtttccagcttcatccatgtccccacaaaggacatgaactcatcattttttatggctgcatagtattccatgatgtatatgtgccacattttcttaatccagtctatcattggtggacatttgggttggttccaagtctttgctattgtgaatagtgtcgcagtaaacatacgtgtgcatgtgtctttatagcagcatgatttataatcctttgggtatatacccagtaatgggatggctgggtcaaatggtatttctagttctagatccctgaggaatcgccacactgacttccacaatgattgaactagtttacagtcccaccaacagtgtaaaaatgttcctatttctccacatcctctccagcacctgttgtttcctgactttttaatgatcgccattctaactggtgtgagatggtatctcactgtggttttgatttgcatttgtctgatggccagtgatgatgagcattttttcatgtgtcttttggctgcataaatgtcttcttttgagaagtgtctgttcatgtcctttgcccactttttgatggggttgtttgtttttttcttttttgttggagttcattgtagattctggatattagccctttgtcagatgagtagattgcaaaaattttctcccattctgtaggttgcctgttcactgtgatggtagtttcttttgctgtgcagaagctctttagtttaattagatcccatttgtcaattttagcttttgttgccattgcttttggtgttttagacatgaagtccttgcccatgcctatgtgctgaatggtattgcctaggttttcttctagggtttttttcaatatatggaaattcacatttcgcttgggaacatgaaggagaagatatacaaaaggaaaactagatgagaacaaacaagctgagtaaaagtagttgtcagaaaataaactgaatgataggtaggaaagcttcaaactattaagtaaatgctgtgctttaaagttagggttagtagcctgaacatctggatcctggagtgctttcaagctctttgctgagaacatttctagatttcagtgttgtctggttagcagaatcttttctcggacagccatgtaacaaagttgtctatcttttgaaaactccaaactactaaagtgttggaaacctgaaatgctttgctttgaaggtaagatgattaaaaaaaaatctattgaaatatttgaactcaggtataattgacttgttatgtaataagattctgaacatgtatacatacacaatatgaaagaatttcaagtcccaaacttgagtttgcaaatgaagacagacatttagagtaactatgcaccatggttaggtttacttgctgtttttctattcctcctgttaagtacattgtaaactaccttaagctaatgtattggctggctaagattcctacagggttcattcttttcattgggcatcaatagtgtcagtggtattttccatttgaaatgtgatggaactgagagacactgtggattggcttagaactgaaccacagttaaaagtggtcatctgaggaccagcctgggcaacacagtgagacccccatctctataaaaaataaaaataagggctgggcgtggtggctcatgcctgtaatctcagcactttgggaggccgaggtgggtggatcatgaggtcaggagattgagaccatactggctaacactgtgaaaccctgtctctactaaaaattaaaaaaattagccaggtgtggtggcacgcgcctgtagtcccagctactcaggaggctgaggcaggagaatcgcttcccagaacctgggaggtggaggttgcagtgagccgagatcgtcccactgcactccaacctgggtgacagagcaagactccatctctaaataaatagatagatagatggatagatagatagatagataggcatggtaagcccagaagttagaggctacagtgagctacgattgtgtcactgcactccagcttgggtgacagagtaaaaccccgtgtcaaaaaaaaaaaaaattgttgtcatctgagttacagctttggtagtgggtgaagtggaggggcagagacaagttatcacttagaatttatagccgactaagtctggatcaaggatgtatcatgcaaataaatgtgtgcaatggatggaaaagttgcctgaggcaagggaagaagggagctactccagtgctgtgtttgggggtgtgggtttttttttttttttctttaactgtaggaatttatggatagtataaatttgggaagcttgaaaagtgtgcataaaaatatttataatcttactatcagggcagtattgcaacaattcagtatttgtaatatatctacttctagtcatttctgtacattttaaaaaataattgagttcgtactctaaatataattaagtatactactcttttcatcccctttcgcagaattctttaggggctttctgttgctcttggtgcaaagccgaaagccttgagcttcttatgactgctctgattttccctccctgcagtggcctcttgctcagtgtagttctgctcccttggctcactttcattttcccacacatgcccagagctgttgcgtgtgctgcccgttgtgtgtgatgcgctctgcagccaccttgttgcctggcggagccctccttattcatcatgttccaccttaaacgtcacttcctgagggaagcttctcctgaaccctccttattcatcatgttccaccttaaacgtcacttcctgagggaagcttctcctgaaccctccttattcatcatgttccaccttaaacgtcacttcctgagggaagcttctcctgaaccctccttattcatcatgttccaccttaaacgtcacttcctgagggaagcttctcctgagccctctttattcatcatgttccaccttacatcttattcatcattttccatcttacatgtcacttcctgagggaagcttctcctgaaccctccttattcatcatgttccaccttacatcttattcatcatgttccatcttacatgtcacttcctgagggaagcttctcctgagccctccttattcatcatgttccaccttacatgtcacttcctgagggaagcgtctcctgaaccctccttattcatcatgttccaccttacatcttattcatcatgttccatcttacatgtcacttcctgagggaagcttctcctgagccctccttattcatcatgttccaccttacatgtcacttcctgagggaagcttctcctgaaccctccttattcatcatgttccaccttacatcttattcatcatgttccatcttacatgtcactccctgagagaagcttctcctcagccctccttattcatcatgttccaccttacatgtcacttcctgagggaagcttctcctgaaccctccttattcatcatgttccaccttacatcttattcgtcatgttccatcttacatgtcacttcctgagggaagcttctcctgagccctctttattcatcatgttctatcttacatgtcacttcctgagggaagcttctcctgaaccctccttattcatcatgttccaccttacatcttattcatcatgttccgtcttacatgtcacttcctgagggaagcttctcctgaaacctccttattcgtcatgttccaccttacatcttattcatcttgttccatcttacatgtcactccctgagggaagcttctcctgagccctccttattcatgttccaccttacatcttattcatcatgttccatcttacatgtcactccctgagggaagcttctcctgaaacctccttattcgtcatgttccaccttacatcttattcatcatgttccatcttacatgtcactccctgagggaagcttctcctgagccctccttattcatcatgttccaccttacatgtcacttcctgagggaagcgtgtcctgaaccctccttattcatcatgttccaccttacatcttattcgtcatgttccatcttacatgtcacttcctgagggaagcttctcctgagccctccttattcatcatgttccaccttacatgtcacttcctgagggaagcttctcctgaaccctccttattcatcatgttccaccttacacgtcacttcctgagggaagcttctcctgaaccctccttattcatcatgttccaccttacatcttattcatcatgttccatcttacatgtcacttcctgagggaagcttctcctgaaccctccttattcatcatgttccaccttacatgtcacttcctgagggaagcttctcctgaaccctccttattcatcatgttccaccttaaatgtcacttcctgaggaaagcttctcctgaaccctccttattcatcatgttccaccttacatgtcacttcctgagggaagcttctcctgaaccctccttattcatcatgttccaccttaaacgtcacttcctgagggaagcttctcctgaaccctccttattcatcatgttccaccttacatgtcacttcctgagggaaacttctcctgaaccctccttattcatcatgttccaccttacatgtcacttcctgagggaagcttctcctgaaccctccttattcatcatgttccaccttaaacgtcacttcctgagggaagcttctcctgaaccctccttattcatcatgttccaccttacatcttattcatcatgttccatcttacatgtcacttcctgagggaagcttctcctgaaccctccttattcatcatgttccaccttaaatgtgacttcctgaggaaagcttctcctgaaccctccttattcatcatgttccaccttacatgtgacttcctgagggaaacttctcctgaaccctccttattcatcatgttccaccttacatgtcacttcctgagggaagcttctcctgagccctccttattcatcatgttccaccttacatgtcacttcctgagggaagcttctcctgaaccctccttattcatcatgttccaccttaaatgtcacttcctgagggaagcatctcctgatctctcagattcacacccccattatacactttcgtggcccctatacttttatagtatttattgcaattgcaattaattatatatgtagaattagaatgttgtttgtgtgtgttgtttatttgtgtattattagaaggcagggaccatgacagtaggaattgttcactgcatttcttggcccaaatatagtacgtgctagatgctcaataatgttcgacatttgttgaataaatgactgaatatattaataaatgaggaaataggcagcagtctgcttccttcatatgtaacacgtatgttaaaagatatgcttggtagtgaattctgaaagtctaatgtagtgaatgaaagtgtaatattgggttcttttcttcatgtgctgtgttaaatttagttaaatttcagtaatgaatcttagaaaactgtcagcattaggtctgtcaaacaaatgtgagaggcagaaaagttcgaagagagaaagtaaaccagcattgtttccccacttactgaaaataggttttgtaacagaatggtgcagtctaaatgaagaaatacacctgttaggaataccttctaaagatctgtttgcatgtactaatgcaaatatggaaaactcttttttttttattggcacatgaagtcttttgactaagatttgttctaataggcccagcgcagtggctcacgcctataatcccagcactttgggaggctgaggcaggcagatcacgaggtcaggagatcgagaccatcctggccaacatggtgaaaccccatttctactaaaaatacaaaaaattaactggttgtggtggcacatgcctataatcccaactattcaggaggctcaggcaggagaatcacttgaacctgggagtcggaggttgtagtgagccgagatcgcgccactgcactccagcctggcgacagaatgagactctgtcaaaaaaaaaaaaaagatttgttctaatattaaatacaaaatcaagcaaatcaaatagaaacaaaagagtctaggttaaagcactacggaagtactcagttacgagtgtgctgttaacttgctacatgaccacttactaaataggggctactttttcgccatcttaggaagaaactgagtataccagacatcttaaacataacaaacatcttaaatgttgtcatctaagattcagacaggtttctaaatgtttttgtccttgacttgcaaacactcagtggacacatacagccctctaacccactgtgtctcaaatgttgatgtacatgatgtcagttgccatgcattttatttatttatttgtttttttgagatggagccttactctcacccaggctagagtgcagtagtgcgatcttggcccattgcaacctccacctcctgggttcaggtgattctcatgcctcatcctcccaagtagctgggatgacaggtgcgcgccactacacctgcctgagttttgtatttttagtagagacggggtttctccatgttgcccagtctctggtctcgaactcctggcttcaagtgatcctcctgcctcggcctgggattacaggcgtgagccaccacacccagcccgtgtagaaggcatttatgtaatgaactgacatccttggagtgagctttcagtttagtataaataggtaagggtttggattctctgatcatcttcttggtctgttcacttccatccagaaggcctgggtctggattggcaccatggatctggttgagacaaacaataaggcaagggcttgtatgttctttctttcactttatcgtacttcatagccagtacatagtagtgttttattatgttatgttatttcctctattttaatttcttctcaaatccaggggccagttgtttgggcagatgtttactagggactctaatcacctgctcttcacccaaggaaaggcagtctctgaagtctcatttctattatctaaaagctagttctgcattttcccttcctgcaagcaaggaatggttttcttttgacgtttccagctatggtttgctttgaactgacttctttgttgtattggggtgtgtgctcagttaatgagtaatgaacacgattggattcttctttccttgggtagatactggccagaattattctttacctatgctgtaccagttaataaaggactcctcagtttgtgctttctcataattcaccaaatctagcaaatctagtatctttaatttggtttattattaccattaaatattagctgtatgcccacattttgctaacatgtggcactttgtagaactgttaggggactacccagagagagtgcagtggtggtgtgttttggggttgtggaagagggctggaatgtagtcactgccctccagaagtccctttgtcatatataatacagaaaagcctttttcttgtcccctccacaccccatcccccgcatcccatcaagctgcttagggtgaggggaaacaccatgagagaggaatggcaatagtgaatgtgttttgattactctttaccatcctcttccctcaatagtttgaactttccttagaaacaatttctaagagggaatttcttaagtgagtactaggaaagttggcaaattttggaaacagtgtttagtgtctgtggttgctgttctgcatttcagggcgccttgcctacagattaatcccagctggccactcttctacagcacttgctcaggaacaggttgtattgactccttcatttgagattcggtgaaattcgcaagtacctctggaatcatttgatgaacctctttggagcattagtgatgcaacttaatgtctttggcagggacatttcttctcacatcttattgatactgggtttgaggagcaggctgacttctggttgtgtagtcagctctcggtttttttctactaatggagaagggaggcattatagggaatggaaaattcaagttgcaaagcattaaaaacaatttaaaattatgtttcatttaaactaacaattgctgtatttctgaccaaataatgtttacttcaggataatgttttcttgatttatttttatattacaagttgccactttataaattctacagatcatggaaagtagtttaaaagagtgatcttcagatttttaaatttaaagtctattcttaattttcttttatatatatgtatatatatatttatatacacacactttgcactgtaagatattgagtttatgacattaaggactctggcccttcagttcttgaaaatttagtgcttataaaattgtgaggactatattctaatcattttcagtcagtgaaaaacctatatactttatgaagcacgcaggaaacatctccttttctgcttagttcccctaaaaatgtggatcagatccatctcctgggcctagtcagtattgattgagtgtatacccagggcatcgtgctaaagtgtcacccaagctctgctctccaggggaagaagagctagccattccttttactgtgcatgcatatgtatatagctcacctatatccagaaaacttagtttacaaatggactgctttttagggaaggagtggacacaaaagttcaacttcagagaggaaaactaagagcaatgccaaattaactgaaatcttctgttttgaaagaggtcttttaatttaaaaaaagctagttcttggaaaaagcacaataatcaaaaccaaatgtacctcattagaaagttcacgtgagataatttgggatttgcaaaattagttttaatcaattgtgaaggacagcaagactatttctacctgtgccaggtagaaatagtatgtatctaaagtcagaaccattagtgtcggggcaagtatagatactcattctctgtagttgggtcagttgtcttccttatatgttcgccttagctaaaatggcagagagaaatccttgttgcatcataacaaggacattgtcaaagtacactgaactcatgaattagacaaatagcagcattgtatcttctttttctgggcctgattttgaggtatactgcacttcctaagggtgatttcagagctagcttgcaggtggagctccacctgctgatacttgtgagggatagctcagtaagcactccttcagctagcatgtttcccactaacattcacactgatactccagcctagagaaagacctttgggttacaccagtctccagaaagccttcatttaaatgcaactagggagaggcgtggtggctcaccacctgtagtcccagcaccttgggaggccaaggtgggcagattgcttgagcccaggagttcaagaccagcctgggaaatatgatgaaatcccatctctgcaaaaaatacaaaaattagccatgtgtggtggtgcatgcctgtagtccttgtatgcttgggaggctgaagtgggaggattacctgagcctggggtttcgaggctgcagtgagctgtgatcatgccactgtactccagcctcagtgacagggtgagaccctatttcaaaaaataaaaataaaaataatactaccaggttgcatgggggaggaatgaggtaattgtaaaatgaaggtttcagggaaaagcctgggcaagcagctcttggcctgggaaaggcaggcccaggaacagatttcagagttgtcccaacaagttgggtgaaatctgtttctatttgcttcattttctttttctctcctactcctcactacttagaaggggatttgagggacccatttagatccttttctcactgtctcgccctctctctgatggtggtattgaggataagacagtatttgtcatctgtaattaactgtactgcatttgtaaggcaagttgtgctgtacttgatttttatgtttctttcaagatttctgccctttgcctcctgtatttttctatttatttgtttatttatttagggacagaatctcgctctgtcacccgcccaggctggagtgcaatggtgcgatcttgggtcactgcaacctccacctcttggtctcaagcaattcttctgcctcagcctcctgagtagctgggattacaggtgtgcgccaccacgcctggctaatttttgaatttttagtagagacggggtttcaccatgttggtcaggctggtctcgaactccagacctcgtcatccgcctgccttggcctcccaaagtgctgggattacaggcgtgagccaccgcgcccggcttgcttcctttatttttctaacctcatcattttctgctttgctcagtggagattttccaataatgtcacccaaaatatacttttaagtcaatgtgtgctattttttaagtcacttctgactttaatgttagacctctcctttgatgaaagttaaatctcatgacatgggagagtgacattatatctttaattaagatgttaaattcttctcaaattctgtttctgattagaaaagtactttgaggtgaatccccctttcctccttaaaaaaaaaatagtggtcagttcctatctctaggtcttcagtgaaatgatcccatttttctgatccaaacaagtttctgtggctcatctgctctgcagagccctgtgtcttctgaggaacgattgctttctgcataacatacagtgttctttgctgctttccacccacagagcctttcttgctgaggaggaggtgtgatataggaaaattatgagggcttttcaaactcgcttgcattgatggcccagatggtgaggaaaatcccttggggagctaaaaattgaatgggttatagcagatttttaaaatccctaattagactctccttctctttaagaccacttttgagttaccactgtatttatatatctgagtcctgtttcccaactgctagtgagctccttgagggcatccttgggtctgtacaccactgaaatctcagcacctagaaagcagttctctaatagtggctgataccatgtgaatgcattctctgcgtcaggtcctgtactcagcactttacgtatgctctcttactcttacaactggaggagaaaggtattataattatccccatcgtatggatgagaaaacagaaagattggtgaacatccaagccagaaacacttgataagcagtagagatagacttcaaactcagatgttctagagtttcagctcttaaccactatattatactgcttccttactagacaaacacttagttttaaagtaaatattttttgagtaaaaaagtgaatgaagtaaagttaactaaagttaatttcctgaaatcacagtgatgtttatgtcttctttcaataaaccattctcggtataagtggtcagccaggatacatgttgctgtgcctggtgctccttgtaactcaggaagatattgccccattctaaacagccagcatggggtaacagtgtaagcactgtgaacatttcttctctgttcttacccatcttcaaacagaaacaaccaggagcagtttaacagtgatacttgagttatgaacttcatacatattgcttaattgtaatggcaaattaatgtgttaacatttatagaatggtactgtcattgaagtttgaatttaaatgtgggttttaacccagttctataataattgctgtgctctgggaaacactgaatcttttcaaggaggacagctatttaactataagtagagtcatttgaaatgcagaagaccagaatatttattcaaagagtggtagcaaagaagtgagatgagaactgaggtggagtgttctttccatcctagtggagagaacacagagctgtgagtcagggtatctggaatctaagcatgtctccaggcttaagtttctattgtgagtttagctaaggcattcctgttgataatactattgctctaataccaaaaagtgtccactagaaaatagagtaacctttgtgcctttgtaatgatagtgttcttttggtataatactctactaccacaagtattgccttttatcatcttaaaaacaaatctgatcatatttctccccttatttattctttttcctccagtttttatcgagtgctagctatgtgccaggaatttataagtcctttatgtgtgataactcatttataagctcatgcctgtaatcctagtattttggggggctgaggtgagaggattgcctgaggtcaggagtttgagactagcttgggcaagatagcaagaccgcatttttacaaaaaatttaaaaattaggtgtggggtacacatctgtattcccaagagtctgaggtgggagaattgcttgagcacaggagtttgaggctacagggagttgtgatcatgccactgcaatccagcctgggtgacaaagtgagaccctgtctgtaaaaattatagtaacctatttaattatctcagccaccttacgaagtaggcactaatttagacatttcatagatgagaaaactgaggcacagtaacatacccaacgtagcatggtaagggatggagttcatataaaacccagacagttcagcagtattcgctgtcctgcagcctccgctgctgataacccaggcaaacagggtctggagtggacctccagcaaactccaacagacttgcagctgagggtcctgactgttagaaggaaaactaacaaacagaaaggacatccacaccaaaaccccatctgtatgtcaccatcatcgaggaccaaaggtagataaaaccacaaagatggggaaaaaacagagcagaaaagctgaaaattctaaaaatcagagcgcttctccccctccaaaggaccgcagctcctcaccagcaacggaacaaagctggacacagaatgactttgatgagttgagagaagaaggcttcagagaatcagacttctccgagctaaaggaggaagttcgaacccatcgcaaagaagctaaaaaccttgaaaaaagattagacaaatggctaactagagtaaccagtgtagagaagtccttaaatgacctgatggagctgaaaaccatggcatgagaactacgtgacgaatgcacaagctttagtagctgattcaatcaactggaagaaagggtatcagtgattgaagatcaaatgaatgaaatgaagcgagaagagaagtttagagaaaaaagtaaaaagaaacaaacacaacctccaagaaatatgggactatgtgaaaagaccaaatctatgtctgattggtgtacctgaaagtgatggggagaatggaaccaagttggaaaacactctgcaggatattatccaggagaacttccccaacctagcaaggcaggccaacattcaaattcaggaaatacagacaatgccacaaagatactcctcgagaagagcaactccaagacacataattgccagattcaccaaagttgaaatgaaggaaaaaatgttaagggcagccagagagaaaggtcaggttatccacaaagtgaagcccatcagactaacagtggatttctcggcagaaactccgcaaaccagaagagagtgggggccaatattcaacattcttaaagaaaagaattttcaacccagaatttcatatccagccaaactaagcttcataagtgaaggagaaataaaatcctttagagacaagcaaatgctgagagattttgtcaccaccaggcctgccctacaagagctcctgaaggaagcactaaacatggaaaggaacaaccagtaccagccactgcaaaaacatgccaaattgtaaagaccatcgatgctaggaagaaactgcatcaactaatgagtaaaataaccagctaacatcataatgacaggatcaaattcacacataacaatattaaccttaaatgtaaatgggctaaatgctccaattaaaagacacagtctggcaaattggataaagagtcaagacccatcagtgtgctgtattcaggagacccatatcatgtgcggagacacacataggcttaaaataaagggatggagaaagatctaccaagcaagtggaaaacaaaaaaaaggcaggggttgcaatcctagtctctgataaaacagactttaaaccaacaaagatgaaaagagacaaggccattacataatggtaaagggatcaattcaacaagaatagctaactatcctaaatatatatgcactcaatacaggagcacccagattcataaagcaagtccttagggacctacaaagagacttagactcccacacaataataatgggagactttaacaccccactgtcaacattagacagatcaacgagacaaagttaacaaggatatccaggaattgaactcagctctgcaccaagcggacataatagacatctacagaactctccaccccaaatcaacagaatatacattcttctcagcatcacatcgcacttattccaaaattgaccacatacttggaagtaaagcactcctcagcaaatgtaaaataacagaaattataacaaacttgtctcagaccacagtgcaatcaaactagaactcaggattaagaaactcactcaaaaccacttgactacatggaaactgaacaacctgctcctgaatgactactgggtacataacaaaatgaaggcagaaataaagatgttatttgaaaccaatgagaacaaagacacaacataccagaatctctgggacacatttaaagtagtgtgtagagggaaatttatagcactaaatgcccacaagagaaagcaggaaagatctaaaattgacgccctaacatcacaattaaaagaactagagaagcaagagaaaacaaattcaaaagctagcagaaggcaagaaataactaagatcagagcagaatggaaggaaatagagatacaaaaaacccttcaaaaaaatcaatgaatccaggagctgggtttttgaaaagatcaacaaaattgatagaccgctagcaagactaataagaaaagagagaagaatcaaatagatgcaataaaaaatgataaaggagatatcgccaccgatcctacagaaatacaaactaccatcagagaatactataaacacctctatgcaaataaactagaaaatctagaagaaatggataaattcctggacacatacaccctcccaagactaaactaggaagaagttgaatccctgaatagaccaataacaggctctgaaattgaggcaataattaatagcctaccaaccaaaaaaaagcccagggccagatggattcacagccgaattctaccagaggtacaagcaggagctggtaccattccttctgaaactattccaatcaatagaaaaagagggaatcctccctaactcattttatgaggccaggatcatcgtgataccaaagcctggcagagacacaaaaaaagagaattttagaccaatatccctgatcaacatcgatgcaaaaatcctcaataaaatactggcaaaccaaatccagcagcacatcaaaaagcttatccaccataatcaagtgggcttcatccctgggatgtaaggctggttcaacatacgcaaatcaataaacatcatccggcatataaacagaaccaaagacaaaaaccacatgattatctcaatagatgcagaaaaggcctttgacaaaattcaacagcccttcatgctaaaaactctcaataaattaggtattgatgggacgtatctcaaaataataagagttatttatgacaaacccacagccaatatcataccgaatgggcaaaatctggaagcattccctttgaaaactggcacaagatggatgccctctctcaccactcctattcaacatagtgttggaagttctggccagggcaatcaggcaggagaaagaaataaagggtattcaattaggaaaagaggaagtcaaattgtccctgtttgtagatgacatgattgtatatttagaaaaccccatcatctcagcccaaaatctccttaagctaataagcaacttcagcaaaatctcaggatacaaaatcaatgtccagacatcacaagcattcttatataccaataatagacaaacagccaaatcatgagtgaactcccattcgcaattgcttcaaagagaataaaatacctaggaatccaacttacaagggatgtgaaggacctcttcaaggagaactagaaaccactgctcaacgaaataaaagaggacacaaacaaatggaagaacattccatgctcatgggtaggaagaatcaatatcgtgaaaatggccataccgccgaaggtaatttatagattcaatgccatccccatcaagctaccaatgactttcttcacagaattggaaaaaactactttaaagttcctatggaaccaaaaaagagcccacattgccaagtcaataataagccaaaagaacaaagctggaggcatcatgctacctgacttcaaactatactacaaggctacagtaaccaaaacagcatggtactggtaccaaaacagatatagatcaatggaacagaacagagccctcagaaataataccacacatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaatttgacagatgggatctaattaaagagcttctgcacagcaaaagaaactaccatcagagtgaacaggcaacctacagaatgggagaaaatttttgcaatcaactcatctgacaaagggctaatatctagaatctacaaagaactcaaatttacaagaaaaaaacctcatcaacaaatgggcaaagaatatgaacagacacttctcaaaagaaaacatttatgcagccaaaagacacatgaagaaatgctcatcatcactggccatcagataaatgcacatcaaaaccacaatgagataccatctcacaccagttagaattgcgatcattaaaaagtcaggaaacaacaggtgctggagaggatgtggagaaacaggaacacttttacactgttggtgggactgtaaactagttcaaccgttgtggaagacagtgtggcgattcctcagggatctagaactagaaataccttttgacccagccattccattactgggtatatacccaaaggattataaatcatactgctataaagacacatgcacacgtatgtgtattgtggcactattcacaatagcaaagacctggaaccaacccaaatgtccatcaatgatagactggattaagaaaatgtggcacatatacaccatggaatactatgcagccataaaaaatgatgagttcatgtcctttgtcgggatatggatgaagctggaaaccatcattctcagcaaactatcgcaaggacaaaaaaccaaacaccgcatgttgtcactcataggtgggaattgaacaatgagaacacttggacacaggaaggggaacatcacacaccaggacctgttgtggggttgggagaggggggagggatagcattaggagatatacctaatgtaaatgacgagttaatgggtgcagcacaccaacatggcacatgtatacatgtgtaacaaacctgcacgttgtacagatgtaccctagaacataaagtataaaaaatatatataaatagtcaaaaaaaagtgttttgaagtgaatgaaaataaaaatgtgacatcagaattaagactaggccactaaagcagtaactagggtgaaatctacagcatgaaagacctatattcgaaaagaagaaaggtctgaaatcagtgagttcatctactttatgaaattagaaaaagagcctgggcaacatagcaagtccccatctctacaaaaaatttaaaaatgagccaggcatggtggtagatgcctgtagtcccagctacttgggacatcggggcaggagaattgcttggtcccaggaaattgaggctacagtgagctaatattacgccacggcactctggctaagcaacagagaaagaccttgtctctaaaataaataaataaacagaaaaataggaaaaaaaatcagaaaaagaacacatattcaaagtaagcagaataaagaagataataaaggtaaaagcagaaatcatgagacttcagaaaacaaaaacaacagaaaaaaaccagtaagtccaaaagctgtttctttgaaaatatcagtaaaattaagaaacctctactagactaattgggaacaatagagaaaagaaacaagttaacaatgccaggaataagataggtgactataaacacattaaaagaatgataagaaaatattatgaacaactttatgcttaaacatttcacaacttggatcaaataaatttcttgaaagacacaactaccaaagctcactcaagaagaaataagtggcctgaatagcctaacatctactttttaaaaataatttatagttaaaaaaaaaactgcccacaaagaaaactccaggcccagatcactggtgaattctaccaaacatttaagaaaaaaaagacaccaattctaacgaaactcttccaacaaagtgaaaagaaagaattatttcccaaagtattctatgaggccagaattaccctgatatcaaaaccagaggcattacaagaaatctacaggccaatttccctcgtgaacatagatgcaaaaatttcaaacaaaatcttagcaagtcaatcataaaaaagaccaagttctggctgtttgtgtgtataggaagaaaacaaaaacaaaaaccaaccgaggtttatcccaggaatgcaaggttggtttaacatatgaaaatcagttaatgtaattcattataataacgcaatatcaccatattacattctcaacagatgcagaaaaagcacttgacaaaattcaacatccatttatgataaaaaaaacttttggaataggaaggaacttcctgagacagacaacagcaaaacaacagaggtaaatcaataaaccaaaagctggttcaattaagccaaaaattaggaatagagggagtttcccaatctgataaacaatatccatgaaaaagttataggtaatattatattattggtagaaaccagacaaaaatacctgctctcaccagctcttttaactttaatacagagtctcattctatctcccgggctggagtacagtggcacaatctcagctcactgcaacctccacctcccaggttcaagcaattctcgtgccttagcctcccgtgtagctgggactacaggcacgagccaccacaccacccccggctaatttttgtatttttagaagagaaggagttttaccacgttggccaggctggtctcaaactcctggcctcatgtgatccacccacctcaacctcccaaagtgctgggattacaggcgtgagccaccgtgcccggcctgctctcaccacttctattcaacactgtattggaggttctagcagtgcaaccagggatgaaaaaaagaacttaaaaaaaattaggaagaagtaaagctgtcttcatatctttatttgcagaggacattaacatttatgtcagggatcagcaaactacaatccaaaggccaaatataactgttgcctggttttttgttatttgcttttgcaaataaaattttattggaacacagccacatccatccatttacttatcaactatggctgctgtaaacccaaaagatctgagacaggtctcaatcaattgagaactttattttgccaaggttaaggacatgcccggaagaataaaacatggaatcacataaatggtcagtggtctgtgccttttttcaaaaatgattttgagggctgcaatatttaaagggaaaaagtgggctggaggggaaagagggagaatgtggtaatccacatgttgcaagagaaaaggagcaggtagggaaatagtcaattatgtattcatattgtgcccagtaaataaatactttacataagataaggtgaacatggagtagctacctggggagatactgaaccttttctctatagctgtctgcttagaaacaaatggaaaggcagcttcttgtaggacacagctttcagcttagttttttccttttggcagagtgaagtggggtctgagtttttattttcccttcacattgctttcactctaaaatggcagagttgagtaactgtagcagagatcttatgaatggaaaataaatacaagatgcttaacctaatttgcatcatttaatttgcaccttaatgcaaattaaaaccacagtaagataccactgtgcatctatcagaatgacaaaaactaaaaagattgactatacctagtgttggtgagggtatcaaaaacaagatttcccatccattgcaggtgggaatgtaaaatggtaagaccaatttggaaaagtgtgattaaaaatgaaaagatagacctattatttgattcagttattatactcccacatacttatgtaagagaatgaaatcatatgtttatacaaagatttgtacacaaatatttatttgtagcatctaaaaactggaaataacccaaatgcccatcaatagtaaataaacatctggtggtatttccataaatggaatatgactattcagcaataaaaactaataaattattgatgcatgctgccacataaatgaatctcaaaataattatgctgagtgaaaaaggccagacaagaagagtacatatggtatgattccatttatttaaaattctaggaaatccaaactagtgacaaaatcgctaagtggttgcctggggacagggcagatggggtgaataaggaaggaagggcagaagggaaggattacaggagcattaggaaacttttgagggtggtgggtaggtcggctagaaacctgggagttgctggatatgttcgctattgtggttgtggtggtggtggtttcaaagctttacgtatatgctaaattttatcgaattatatggtataatttaaatatgtgcactttatatgtcaattataccttgattgtttttttaaaagtccaaaaccaaaaaattgggctctgatgtgtggccatgtgaatgagtgatctggtgaaaaaggatacactagctctgtaccaaatccctgactcccaaaactggacatagatatggaggtattctctctctccctctgtgagaagcttagggtataagaatatatggctcatatgaatccttgaattaattctttgttctcactctacctttcctatgtctacactacatgcctgtaccatacccaacacacatccatcttttttttttttttttttttttttttttgagatggagtctcactctgtcgcccaggctcgagtgcagtggcgcgatctcggctcactgcaagcttcgcctcctgggttcacgccattctcctgcctcagcctcccaagtagctgggactacaggcccgccaccacgccctgctaattttttttgttttttagtagagacagggtttcaccatgttagccagcatggtctcaatctcctgacctcgtgttccgcccacctcggcctcccaccattcatcttttaactatggaaaaataccagtgaaaatcaaggcattcattttgtgccattatgcacaatcataagggaaaagaaaagagtcagtaaaatcctagtgttaaagaggaagaaactctacttctcctcataccattaattcgatgttagggaaggatcattgcatggtatgacaagaatcagagtttctcagcattcagtttttggccctgtttttgaaattctgtagaatgagaccctacaatgtaccaaggaataaggaagaaaatgggaaagcaggaaaatggttaaaatcacaaggtaaaagaaagctgaagcttagaaaaaaagtttgctttcattccatataaacaataaaaagggaatctccattttcttttagataatgcctctcaattaacaaaaatttcattttcagcttctgtagatccataaattaataagatacctacacatcaaatgtccctcagttataatggaagcccagtgtgctcacaggatccaaacacctcagcgatctgaagtccagcctctccacctaccacaacctccataatcacactaattacatttttaaaatcaaggaagacagtggatctctaaacgtgaaaaaagaaataccttctactatgtgaaaactgcccatctcatatggcaacacttttattacggtaaagcaatttatttatttattgagacagagcctcgctctgttgcccagtatggagtgtggttgcatggccttggctcactgcaacctctgcctcccgggttcaaggaattctcctgcctcagcctcccaagtagctggaattacagggatgcaccaccacgcccagctcattttttgtgtttttagtagagacggggtttaaccatgttgaccaggctggtcttgaactcctgacctcaggtgatccacctgtctcagcctcccaaagtgctgggattacaggcgtgagacaccgcacccagccagtcaatcaatttaaaatgggctgtatacttggcatcagagatggaagtgcaggtttcaagtcactctatctaaatgaaactactatgtgtgtgtgttcattatataaattatatatgctgacacagatatacttaattatgtacgatgacacacacacatattttgctaacatttcctgcagtatatactatgtgtccaccaccaagttccttaccaacactgaacttttattaacatattcctcccaacaatcctatgaggtaggtactgcaattaccccaattatagacaaggaaactcactcacacagaggtcacatggctactaattggtaccggtggaggagatcaactcaagtagcaactccagagtacatgctcttactcgttttgccttgcccaaacttaagatagctgccttcatgtcgtgtaagaggatatgacctccaatatgaatggagaggggtagagcatgaaatagagcatgaaaatcttgtctcatttgaggtctgaagccacagaccaaagagaaagttatatatgctgtcttctgtgtgatgggctagggcctggagtgggctccaagtaatacccagcaaggtcatcaacagagcactccagtccagtgcactctgggagagggatcacttgaacccaagggctagcatctcggtcacttgaatcttcagtacctagcatggtaactggcatatattaagggatcataaatgttttactcaatgaatttcaacaaatgaatcttttacagagtagtaattgacaatgtgggttctgggactggactgtctggttttttttttttttaatactttaagggtacatgtgcacaacgtgcaggtttgttacatatgtatacatgtgctgtgttggtgtgctgcacccattaactcgtcatttacattaggtatatctcctaatgctaaccctccccgcttcccctaccccacgacaggccctggtgtgtgatgttccccttcctgtgtccaagtgttctcattgttcaattcccacctctgagtgagaacacgcggtgtttggttttttgtccttgtgatagtttgctgagaatgatggtttccagcttcatccatatcccaacaaaggacatgaactcatcatcttttatggctgcatagtattccatggtgtatatgtgccacattttcttaatccagtctatcattaatggacatttgggttggttccaagtctttgctattgtgaatagtgccgcaataaacatccgtgtgcatgtgtctttatagcagcatgatttataatcctttgggtatatacccagtaatgggatggctgggtcaaaaggtatttctagttctagatccctgaggaatcgccacactgtcttccacaacggttgaactagtttacagtcccaccaacagtgtaaaagtgttcctgtttctccacatcctctccagcacctgttgtttcctgactttttaatgatcgcaattctaactggtgtgagatggtatctcattgtggttttgatgtgcatttgtctgatggccagtgatgatgagcatttcttcatgtgtcttttggctgcataaatgtcttcttttcagaagtgtctgttcatatcctttgcccacttgttgatgggtttgtttgtttttttcttgtaaatttgtttgagttcattgtagattctggatattagccctttgtcagatgagtaggttgcaaaaattttctcccattctgtaggttgcctgttcactgtgatggtagtttcttttgctgtgcagaagctctttagttttaattagatcccatttgtcaattttggcttttgttgctattgcttttgatgttttagacatgaagtccttgcccatgcctatgtcctgaatggttttcttctagggtttttatggttttaggtctaacatttaagtctttaatccatcttgaattaatttttgtataaggtgtgaggaacggatccagtttcagctttctacatatggctagccagttttcccagcaccatttattaaatagggaatcctttccccatttcttgtttttgtcaggtttgtcaaagatcagatggttgtagatgtgtggtattatttctgagggctctgttgtgttccattggtctctatctctcttttggtaccaggaccaagctaaaacactttttaatttcccttttgattcttctttgacttacagattattgagaaatgtgttagtttccaaacattaggatttttcagatgcctttctgtactgatctctattttaatttcactgtggtcagaaaacaaactttgtatgacttgaatcttttaaaacgtattgtgatttgttttatggctcggaatatggtctaccttggtaaatgtcccatttgcacttgtcaaaaatatgtattctgctgtctttgggttaggtgttctataaatgtgaagtaggtcaagttagtcgatagaatttttaaaaatcagcattcttactgattttctgtccacttgttctgctattgagagtagtgttgaaatctcgaacaaagaatcctatggatttgtttatttctccttgcagttcttttcagtttttgcataatatattttgaagctctgttactaggtacatacatgtttagaatttttatgttcttttgatgaattgacctctttatcgatttttaaatttattgttatgaaatgacttcctttatcattatgaactaaccttttttatccctggtaatattctttgctctgaaatatactttgatactaatatagccactccacttttcttttggctagtgttaacttagtatatcttttttcatccttttattttgaagctttgtatctttatatttaaagttgccttgcttttttaggagaaaatctaatctaacaatatatgccatttaattgggatgtttagactatttacattgcgtttactgatatagttaggtttaagtcttttctcttgcatttgttttcctttgtttcatctgttctttgttcttttgttctttttatgccttcttttctattgggtaactttgtttggtcttttttgttggtttattagctataacttatgaccttgatatatttaaagagtagtggttaggtgttttgcagaaagtcttcaatttgagtttatctgatgttttctcatgattagacttggtttatagattgggggagggggtcaggtgctgtgcggctaatgcctgtaatcccagcacttttggagaatgaggtgggaagattacttgagcccaggagtttgagaccagcctgggtaacatgtgagatcctgtctcttaaaaaaaaaaattagcaaggcatagtggcacacacctgtagtcccagctactcagaaagccaaggtgggaagatggtttgagtccaggagtttgaggctgcagtaagccatgattgcgccactacactcaagcctgggtgacagaatgagaccatgtctcaaaataaataaataaaaaattggaggaggggatagataccataaaagtgcagtgcccttctcatcatatcaaagggtatataatatcatcatgacatgttgctggtattgctaccctgatcactaggtttaggtggtgtctacaaggtttctccactgtaaagttagtatgtttctttttccctttctattttttaggagttcagcccacactcaaggagatggaaattaagcttcacttcctggagggaggagaatcagataatttgtggatgtatgctaaaattaccataataattaataaatatttcggtggataagatgttatgaggctattcaagtattctgataaagttttttcatgaatattggcagtcattagtggatgttccctatagcagttattactatggtgttctaatgattatttcctatttcccttattctttctacatttgttcattgtaattctcctgtaaagaaaatttggcctctgtctctcatttatttgcttattcatcatttatgcatattagtgtggatttatgggtattgtattctttgtattataatccaatagtatcataattttttttcttaaaatcttccagctttggccactggaagctctttcaggtggctgggattttttgtcgttgtttgttttttagcactttcttgctctctgacactacagggtgctccaggcttatcttgtattttccctgtcctagaatcagccatttttcagggagccctgattctttttactagagaatggtatatgggaaactagacctgggtactagaaatgcttttggttatcaggtgtcactgcttctaggctctcggtgaacagggctaggagatacatgtatttatatccacgtatacacacatatctatactatttctctatttgtatctatgttaaaataaacattagtttatagtggtatgtctgactcaaattcagcactacagggttaattctagcattttccccttgcatattcattctttgatgtgagaaacttggctgtcattacctacaacgtatttatagttatttgtttaaccaagacaaggatatctgctcacaccatttctactcaacaccatattggaggttctagccaatacaaccaggcatgaaaaagaaacttaaaaaaaaaacaatccacggccaggcacagtggctcatgcctgtaatcccagcactttgggaggctgaggtgggtggatcatctgaggtcaggagtttgagaccagcctggctgagatggtgaaaccctgtctctactaaaagtacaaaaaataaaataaaataaaataaccggggatggtggtgggcacctgtaatcccagctactcaggaggctgaggcagaagaattgcttgaacccgggaggcggaggttgcactgagctgagatcacaccattgcactccagcctgggcgacaagagcaaaaaactccatctcaaaaaaagaaaaacaatccaaattggcggggaagaagtaaagctgtcttgatgtcttcccttattagagagaaatatttggtagtttgcagtctgttctacctcaggagagactgcagtaaaactgatgtgaacatctcagaattcaactgttttgtaaataccaccaccccttccactttccttcagcatcccagttaccactggaatattttatagcatatttatttttcctttaacatgttaaacctaaagcccaggttttgcagcttgaatatgtttcctcttgttgatatgacagtgggatatgacagtggagtgaaacaaagcaaacgaataactggtccctgtcttccatgcaatggtctttgataggtgagattcccttatattttcaagttcggttcctgaagtagctcatccattcagattctgaagaagggtgatcactcctgcactgtcttcaagataacagtgaaggctagttccatgtacctccgaagggtactgtgagccctaaagaggctatactggatgggggttaatgcagaatgtctgcagttggaatgcaggtgtaactttgaattatttttttgtagcatatgagagcacacattcctctcttggaattctgataccagaatctgtaatcacatgcaaatagtgtttatgggactgggctcacacagaaagtagcttcatgccaaggtcttatgctcagggcaaatattagggataatgtatttccaaatgagttattttactgaacaagaatatgccttgacacatgttctgtgtttagtcatacacatttgtcatgcctcagtacctctaagatgggtctcatggcaacaggcaggaggattttatgtgttcatctgtgctttagagccaagaatattttataattggtctgactggtctgcagttagaaaaagtaacagtgccaggctcatgcaaagatggtgaccctccctccacccatcatttttatatttccattatttcagtgtagaactgagcccatggtgagtcaagccaagtgctgtacagttccatctcctttgcacaggttctccctgagttactgaaaacactgggaagtcattgcaccactacaatggaagtggtgctgtccttcaggctattctcacttcctcctctctgtcctctctttgtctctggcctccccctgcctgtctcccaccaaccccaaccttgtctgctctgctgccttcaccctgcctttactcttcctcctctctccctgccaccactccttctttgatattttatccacgtttttacttggtggtttgatggtgaaagtgtatataagacccagccattccctttctcttttgtctttcctcatagcttcgattaacatggcaataatttcctccccatgataatcctggactttccacttatgctttaaaagcctttcaattggagatgagagcggggttggttaacggtctttccaggttagccgtttcttcgaacacttctatttaaggtggctgctaggtggagttttactctggtgttatctgactggattaatcagatttgtgctcaagaaatcttttttttttttttttgatacagagtcttgcttttgttgctcaggctggaatgcagtggcatgatctcaactcactgcagcctttacctcctgggttcaagcaagcacatcggctaatttttgtatttttttttttagtagagacagagttccgccatgttggccaggctggtctcaaactcctgatctcaagtgatctgccctcctcagtctcccaaagtgctgggatcacaggcatgagtcagcacgactggcaagaagtctttggtggtttgggtttggaaatgatagaatcaaatagaaagaaaagattgtacactcaaagaaatagcacctgctttgaggtcttcctgctggcttaaccctggggtgttacatggtactgctctgactcagcttttaggatcgccactggaagagcttttcatataatgtctatacagtgaaatgacttaagatttttcttttaagaagtgccattgccagagtattagtgtttaggattctccagagaaacagaactattaggagatagagagatagagatgtattataaggaattgactcacacgattaagaaagctggtgagttcagaatctgcagtatgggctagcaggctggagacccaggagagtcgacgatgccagtgaagtctgcagggcagtctgctggaggagtttcctcttggagaggaggccagtctttgtgttttatttaaatgatcaggtgaggcccgccctcattatggagggcagtctgctttactgaaagttcacaaatttaaatgttaatctcatcttaaaaaccctccaagttgacacataaaattaaccctcacagctaggtttatttggaattccatgatacttggttgggtctttttgtactttcattttcaatggtctgttttgtatataaccatttagttaagccaggtcacaaaatataaccaggacttcagctggctgtgctcttgtcagaacccatatttgatcgatttactatatactttgctgtgtgtatgggtgagtgggtctgtaaaatgctgatatgtgttctttatccacccccacctcccaccccccattttctcttaaattccttaaaaaattggtgaaggaactaagacattgctgcaaagatgctattttatgggatatattcttctctagggtagactctgcgaagcagctgtacagcagcggtctgctgtgaagggtaaacatgtagcctttctccactagaaagcctgcgctgccgttgtatgtttaggcttgagcctcagcggctagtgcagcctcgcagtaatgcatgctgacgtgagtcctggtcaaggaaaaatgtcttttgagcaagagacaaactggacagaatgccagcaagctaaatataactccttagagagccagacatgcataaactagttcttagtgagcaacacatcagattcagagtggaaacattttctaaaagaacttcttttccttcttggcttactgtaatgagtataaacccaaattaatttaatttttcgtggaaagctaagacaaccattgatttttctctcagcatctctgcagttaaatgttagtagccattgttaatgttggaagcctcccgtctcccagtgccccagcattctgttcatgagtcaacaagtctgctctgctattccgatgagtttcactaccacaaggaaagaggacggggagtttgcacattcaaaccttgacgaatctgggagttcagtttttcatggaccctcactctgcttcaggatgctcacgccattatgtgaaaactcttagcaaaatccatcaaaatgagccaggctctatggaatcaggaaatttgtgggctgagactaacattacctcaatatctgttatggcttaaatgtattgttttaataatattttatgttagttctttttgcctgaagctgtagaagcattttatagccagtaactcttcagaatagtacaggaaagcaggcgtcatcctcatgctcaacaatagagctgtgtttctgtgcaccaaccgcagatgctgggtctggcccccacagaaggagtgcctcagtagggcatcccaaatggggctgtgcatagcgtcactccagaggctggggacagtgcagatccagacctttcccagcctgttgagttagaactgggggactgtgctccagggcgtgaggaggtgggttgggaaatggtattttaaacaagcgaagtgattgtcatataacttgtctggcatcagatccgcagactctggcagagtttccggaaggtctctcaaaactgaaataagaaactgcagttgttgtccacagctgctaaaattgttccaaattaggaaagggaaggggaaacagaacacagtagttccagagaagaatctgaggagccgtgtgagctaggaaggccattgtgagcagaagcgagtcagtatttcctcatttcctctcctgccttatcattcccatctgccagctccctcctttttttttttgagcatgtaaaacatgttttgttgttctttaaaagggttcagggtttggttttaaatcaggctgcacacctttcaaatcattctgacatctctctatgtcaaactggcttcagctagcaatacttcattaaatccaaaagaaaaagattcctttaattttaaggaaaaaaatccagttttgagaacaattaacattagtctttaatttaaaagaaaatgagggctaatgtttcatgttgctttatacatccttctcctcaatacagaaccaggaatgtaattttcctaacttgggcaggcactgatactgatggacactgcgtgcatgtgtgcgcacacacacacacacacacacacacacacaccctcctcccaaacaaaattcagagtgtgtcaaagggaaaaggtttgtcatggtattgatcaaaacacttggagtcaacactgtctaccttagcttagcacgtgtgctgttttgatcttgagtctatattaatggaatctgttgttgtgttttgaaatggagaattttggatataccattatttttttacttttaagtcccagaaacaatttcagaaagcattattttgttttgttttctgggatgggagaagagagaatctacagatttgtatttagttaaaaatcaaaactccagcaataggaaataggcagttcacatagccggccaacatttgaggtatcatcagtgtgagacaaggtcccggtctgttcctactggcctagctgacgctaacaaaatgggaggcttatggctctgcacagcaaattccagcaagataagatgactttaagcctgtattcagagccttagaagcagggcactactgagaatgtaatatttagaggtaaaaatagtgcaagagcccctgatggtacccctctacctgctttgtccatgcagcctgatcgtaactgccttccacaaaggatcagaaaaacacctcttctggatcagtccactaaacccagccaagaatctgcagaaatgctgctacaccgcttcaccagcaacacagtccctgcgctactcactgcgttgcccaacgttgcttttctaccctgttatggcctgtggacacatactcactaggcatcatcgctggttttaaaccagggatattttttaatctcaaaagaacctagtaataacaaggcaatcaatggttaaactgaactttacatatagggggcagtttggaaaacaccacaagcatttctcaagtcgaaaatatgtgaattcgctgctatttctttgaccgtttctgaacattcacagtacaagtcctaaaataaaaattttaagctaccagcattctctgatactagacagaaaatcagagtaacgctacagcccacaattgtacagggtgtagaaagtaggcccactgcctggacatctttgttgatggcctggagtcctcccttttagaagacaagtttctgggatatccacttagtttcactggttagggaagagaagaattcaactctcagctaacttctttgagaagagactcctcttaaaatgccatttccccactaatttatcaaaataaaacaaaaggctcttggctactttgtctagtattagatagggttttgaggaaaagaagctaacatgaacaccctttcatcagtaaagactaaaaaccacctggatcatataatatatctatatgtcactgcttttatttatttagttatttgtttgtttatttatttaaaagtgcccaggtgggcttaaggctgccagactgcacgtacatctacggcaacaagggcttctattccatctacaacttgcatcaggggaaaaagggacatgtaggagaggaaggaaaaaaggagaaaaatacaccaccacccccccccccccaaaaaagggaaaaagatcccaccacagggagatctatgtgccaagcataatgaagagtgtgctccccagacagatggttctgcacaggctaatgttctgctggttttccttagagacctattttgaaaaagtttaaaaagacagatttcaaaataattcaatcctggcagaaattcaaactccaaaactaggagcaaaatcatccttcactgaattaattccttttctctttctcttttcttaaacattttattcattttatagagagatttcttttttgtttgcttttgttccaatcatgaggagagtggttgaggagtagtgaatccatcactactttgatgacacaggtaagattccagattcacatttccaggtaccaagggttccctctaaatgccacaatcaagtgagccttcatttacatttctttctactgaacacagcagtgcccgttggtatctctgaagcgtaatcacatcttaggtcagtatttctccaagtaaagcagctgtttggaattgaaggccccccttcttttttgtgttataaactgaactgcatcttcgtacttcattccatattcaatcaaagcaagtgcaaccagcacaggtgcccttcccaatcccgcaacacaaggcactgcaacacagccacctggctcttcacagaatttggtttataacaggtttaaccaatcatctactatctgattagggggtggagctccatcatcaaatggccaatctagaaggtggattccttctttttcaactggagctttatcatacgtagcatcacaaactcgaaccaaagtcatcactccatacttcttaagttcctctgggaactcgttgagagtagcactggtagggttgtgagttacaagaaaacgcatgttctcacaggaaatctccacaggggctggacggttcattatggcaaatgaaaaatgtgagtgtgcgtgtgagtgtgatgggaaaagtgaaagaaatcaataaatcaaaatgtttcacagcagaaaacattaaaaagaccactaaaatgcctattatcaatcagtgttttctctattcaacttgtttattccttatgaagcttctgtcttcaagataagcaaagtatttagaatccacttgaatccaaattcaacttgggcctcaatttctgcagatggataccttcggactccaaaaaaatccaactacataagcagcctttactacatttaggcactagtgaggcaagttaaaagtgtaggtcgctttccacttgtttccttgatgcctaattttactggagtcattaaaagaaatatgcttgcaattaaaaaaaaaagccagctatttctgaggccggtcggtgtgtccaggagtgttcaaggcagtgttaattatggcacatagaacctctaagcttgtcagcgaaaacgctgtgctgagcccggcagaagtctgccctcacactcagaatcgccgtaaatgtgcaacgtatattccaacgaaaaacgctggcgagcggggaccgggcattgaagtccggcggtggcaggagcgaggaggcgcccctctcctcagttacctctgcggcagcggcgacgacaccccccagcctcagcgcgcgacacccgcccggtggcggcggcgcgtctccacgagtctgtcttgctgctgctcctgcagccgccgctgccctgtggtgtcgcctcccgaggtgcacggccgccgccactgctgctccagccgctcccggacggacaacggctacagcccggccgatcgtgccgccgccaccgccgctgcacgggcagccaaaagcagctcccgccccctcttctctctctcaacttagttccacatcttccctggaaggaagagatggctgtgttgaagatgacggtgccagctgcacatcatgtcagaggctttttttaggtcgcttcccttgcagactcatccaagatagggttttactcaaacaatgggatctccttttaggcttcaaggtctgattcatgttttccttttcgtacagatcctcttcccactttatttgttgctttcttttttagttctggatagattttaatattgtatttcttcttataagattatacaataaagcaagaagtagggagtaagaggcaaaactcccagcttctggtttttactttgtacttgtagccattgacctcgctagcatccgatcccctgtctgggacatgagtgtagtcatctttccatcgatggatgctgggaagctgaatcggtgttgagaacgtgctgtgagacgcagcacagaatgtgagccccgacaatactcaggagaatgtacagctcgttcaagtcccagcagcactgtgtgctcatcctgtagctccttcctgctttgctaattatcaaaatgttggtaggagaaagcacagtgtctgctttgttttttctctacattagacatcagtcctacaagctggttgacaggcctcttcagaaaaagcaccccgatgggttcattttcctcttcagcagaatagtcaactgatctacaggaagcagcgtaccttcacacttgctctatgtcaaaatcatgctctttgtgaaactaaaggtctcactttcctctgtccttctctctctgcacactgctgattggctggctcctcatatgtgaaaattcgtgttctgtatagctggtaggttttcctgcgacatcccttccctgtcccacccttgtcttcccaggaaaagcatagattttccttgtggacaactgtccataaaggtagaatgctagtaatacttgagcctagaaattacttaaccagatgacagtaaaacttagaaattgatcccaaggtcctctggctctctaccctgcatttgctttgctgaggctctctaaacaaatgaggaaaaggctgttgttcagaggtggtgactcatatgcagatggatggccacagtgcgctccatccctgccatctctctttgtcatcctctgtcttgcccatgctgcagtgccttgcagatttgtttatatgcatgactttgtcatctgttgctgagagctgaggaaaacctcctgactggtaagtgcctgtgctgtttatcttagggcaacccacatttctacatgctttaaagcaggcttcagaactgggttactttttatacagaagtgcatgttgcctgagcctctttattagtgtggttcaaacatgagcacacagatatgggagggattttgctgaggactgtgagttggagatgattcaggaagtctatgacagagctaggatagcaaagtcagtttcctggtcaggtcttcctgtgtagaaaactgtgctagataccactgtgcatggcaaggggcatgaatctggaagtaaaactgtcttctgtctaaactctgaatcctaattttgtctccactctaaatcccactgattattagctgtttaatacctagttctggccttaaggataataataacttctccttctctgtcattgtgacagataaactggcactgatgcattgtaggatagctttgcctttgggccatcttagtgtcacttagcatttgagaaataagtggctagattatagagaaggaattatcaaactattatctcttgccacatttctggtcaagcatgcacacaataaaaacaaaacaccaaagcgtgtagttaatctcttgcatgaagtcataggaagaagaagaattgtaggcatcagaatgtaatagaaagagtgttagacatggagtttaagaatacagcttgaagtgctggctccatcacttggctgtggactataggcaagccacttggccacatcatcggttgtaaattggaaatgataccacttgctctgactgtcttgaagagtgaccctaaggaattaatctgaatcattttcacttccttccctacttctggaactatgatgtctgatggccctggtttcaagaataagaactaatgccattgtagtgagtcattttaaaacttgatgccttttggccgggcgtggtggctcacacctgtaatcccagcactttgggaggccaaggcaggtggatcatatgaggtaaggagtttgagaccagcctggccaacatggtgaaaccccgtttctattaaaaatacaaaaaattagccggacgtggtggcacatgtctgtagtcccagctactctggaggctcaggcaggaggatcacttgagccccggaggtggaggttgcaatgagctgagattatgccactgcattgcagtctgagcgacagagtgagactcgatttcaaaacaaaataaaacttgatgcctttgaaaataaatacagaattagtttaatatatttctaacaagtaggcacaacagagaatggagtgacaaccgctgctcctagaatcacattaagaaaggcatagaagagaggaaacagaagagagtaagtgaggctggtcagtattcaggggacctctccatcatcacctgtgcactctctgggctcttcttactcctctctgcactggatgtccagacagacatgcctttcttgttgggaaccaagtgcctctaagaaagcacatattgacccccactatgaatcaaacagtggtttttttgtttataaaagtgaaatcagtctttggggtgttgcttacagtttaaaaaaaaaaggaaaagaaagaaaaaagaaaggttttcctcttgggctttttagccttggcctgaaactgagctgatatattgttattatcacttgagaacacaacagcctgaggtccagtcgtctccttaatgtagctggggatgccattccatgtggttttagaaatcctttgttatttctgctcacctgcagagacagccctcctgggagtggaccccagagtctgtatcatcagaactcacctctctctgagctgggattaaatgtcattgaacaaaatacttaacagcctttgtcaactgtgaattcaagcatattttggtactcaaaaatttagaatttctgtatttggtataaagtcagatgatatggtttggcggtgtgttccacccaaatctcatctcaaattgtaatctccatgtgtcaaggagggggccctggtggacgtgattggattatggagttggcttccccccatgctgttctcatgattgtgagttctcatgagatctgatggtttaaaagtgtgtggcagttccccccttattcgctcactcgtgtgcatgtgtgctctgtctctctcctcctttcccctgctgctttgtgaagaaggtgcctgcttcccctatgccttccaccatgattgtaagtttcctgaggcctcagccatgtggaactgtgagtcaattaaaccttttttcttaataaatcacccagtctctggtagttctttatagtgtgaaaatggactaatatattggaaaatactatttttacattttttgtatctttctcttgctctgtattcatttccattcccctctgtattagtttactaggagttgcctaacaaaataccataaagaggtggcttgaacagcaaaaatgtattttcacatagtactgcaggctgggaagtccaaaatcaaggtgctggcagggttggtttctcctgagacctctccttggccagtaggtgactgccttcttgctgtgtcctcatattatctttcccctgtgcaggcacatccctggtatctcttcaagttctttttttttttttttttgacagagtctcgctctgttgcccaggttggagtgcagtggcgtgatctcggctcactgcaagctccacccaggttcacgccattctcctgcctcagcctcccaagtagatgggactataggcacccgccaccatgcctggctaattttttgtatttttagtagagatggggtttcacagtgttagccaggatggtctcaatctcctgaccttgttatctgcccacctcggcctctgaaagtgctgggattacaggcgtgagctactgtgcccagcctcttttcaagttcttataaggacactagtcatattggattaagtccacacccttatgaccttctttaacattaattactgtctcaaatttaaagcctttaaatttgaaacttgctattctctggacctctggaaagtcattggtccctagatagcaagtagaataatgataataaatggtccctcttctaaaatgtttaacttacttatcttcagttattggtgaaagaagggtaagtttttaaataatattttacatttgagaaaaattggagtatgcaaaatcatattaaaagtcactaagaggccaggcgtgatggcttacgcctgtaagcctaacactttgggaggccgaggtgggcagattgcttgagctcaggagcgcgagaccagcctgggcaacacggtgaaaccccatctctactaaaatacaaaaaattagccgggcgtggtggcaggcgcctacagtcccagctactcgggaggctgaggcaggagaatcgcttaaacatgggaggcggaagttgcagtgagccgagatcgcgccactgcactccagccttggttacagagtgagattctgtctccaaaaaaaaaagtcagtaagagtattaaaaacggccccagatagttcatagctttgtcatgtaacagagttttgaagatggaattataagcacatcgagtagttacctctgtcctggattaagctacctagttctggattgaaaacacatttgctagttctacctgaagcaattaaatcctgggaaaacataagcccacaatgccagtttaccgacttacagtgagaatgagagctccgttatcaaagaaacattgaaagagcaaagacactaactcagtctatgtttggattggtgtagatttctctcatgccatttgctatattgtattgaaactatctgtgtctttttcccctacttaaaataagtaacttttccagaaacttcttgggttcttaggtattatggttgggaatcagatacaaagatgaataagaattactaaaaaaaaaatagtgacaaggctaacttacagtgatctcagcaaaatggtggactgggaagttccaagctcctgttcaccagcagaaaaattaaaaaatcacccagtagctatttgaaccgacgttgtagaagctctgaaatcagtcaaacgaagattatagcaaccaagcaaatatctaaccaaaaagagccatctttaaaccagtaggaaagatttgtggtatttttacacacccttgccctaccctctccctggcatagtagctgatttggtcttgaagaggcaacagctattccgcagctttcctctcaaaccggagggaacagagcagacattatttgcaaattaatgtgtatgtctattccagcctttctgggggatacctgaaggcctaatgcaaggtgcttgtctctgtcttgtataatcagggaagcaggcagtaaaaccagtgggcactgctattaaaagctacagagtgactataaacctacagacgcctgaagagattctggctggacatgtacaataggccctgtaaggcccagaggagaaactgggtgagattcttaggaaattacgactctcaaaagcagccacatgtatgaaggaaaatagaaagctgtgatcatgtcaggcaagacacatgatcagaaaagccctgacaagatgctaagattcatcccaggctgatctctagattcagaataagcctagctaagagatgaaggagtacccctgcacagagccagtctccaaagactcagacggctataatatgctcttttttgggggggcgggggggtggttgttgtagtgtttgtttatttcagcttttggcacttaagacagtcttgattatactcttataatagctgaacacaaggttaaggaacctcagtgaccaaacttgaaaaggaatagtcttctgagtctcaaatggactactacagccttaaacagtaatttttttaaaaaacacagcaaatcttgggggaggggggacaatctgatttccagagttaaccgtattataataatcaaatgccagattttcaacaacagcatcaacaacaacaacaaaaaataacagagcatacaaagaaacaggaaaacatggctcatttaaaggaactaaagggattgacagaaactgtcccagaggcagcacagatattggacttattagccaaagactatttgtttaaaatatgcacaaacacctaaggggagaacatggacaaagaactaaaggcaatcaggcaaacagtccctgaagaaaaggacactatcaataaagacatagaaattacagaaatgaaacaaattttggaactgaaaatacaataactgaaatgaaaaatttactagagggtttcaacagcagattgatgcagatagaagaaagaactagcaaagtagaagttaggacgattaattatcaagtttgaggagcaaaaagaaaaaggaaggaagaaaagtgaacagagtctaagcgactcatgggactaataagtggaccatcatatgcattgtgggagttttagaagggggagaaatactgggcagaaagattattttgagaaataatgaagaataaactccccaaatttgatgaagggcatagacccacaaatccaaaaatctcactagactctaagtagaatcaaccaaagagactcacactgagacacatgatcaaacttgacaaagagaaattcttaaaagcacccagagagaggtgactcagcagatacaattaatcttcaagaagactataagctgaatttttaccagaaaccttggaggccagaaggaagtggggtgatatatttaaagtgctgcaagaaaacaattgtaaaacacaaattctatatccagcaaaaccatccttcaactatgaagcagaagttaagacattgccagataagtgaaagttgagggagttaattaccaccagacctctataggaaatatgaaagggagacccgcaggttgaaatgaaagaatacttagacaataattcgaaggtgtatgaagatattaagatctccgataaagctaatttcacgagttaatatttataattttggtttataattgtgatttttgaagaaattataacacaaattcaggtcagttatgtcctgattatatcccagtaggttagactctggtaagacaatttctcttttgggcaggccttgttaaggacagaatgcttcagaggtatttcaaaatggctaacatttcccctccctatgccaggagtatggggggatttttctcccatcttcactgagagaaccagggaggacccctggagataaaactcacgagaatgtctgggggggcctgctaagactgggccccatagagtttttaactctcagacttgttggcactgagcctccaatgattcatcatttatagtttaggttttcctactctggtactggtggttcctgcagaggcttcttctcctgagtttctgctctgcaggttgggattctttatctgcctgtctgtctctccaatctggagacagtgttttgacctgtgacctcacttctctgacaaatctaagaagagttgattttcaggttgttcagctttttacttgttgtcaagatggatgagggtttccaagctgtttgcatgctagactgagaaccagaagttctgcatgttggttttgtatcctgcagccttggtgaactcatttatttattctaatatttttggtgtgtggaatatgtagggttttctacatctaagatcatgccagctacaaacagagataattttcctacttcctttccaacttcgattccttttttgtccttttcttgacaaactgctcttgctagaaattccaatatcatgttgaatagaagtggtgaaagtgggcatcgttgtcttgttcctgattgtaggggaaaaacttttgagtctttcaccactgaatatgctgtcagctataggtttttcatatatgacctttatcatctatagaaagttctttctattcctagtttactgagtgtttttatcttgaaaggattgttgcattagttcagatgctttttctgcattagttgggatgatcatgtcatcccaactttattaatatgttgtaatactgtaattgatttttatgtgtttcaggaagaaatcccacttgttaggtacttaactccagccgcctctagtcatctttccacccaaggggagtggggactgagacacagtggtgaaggtcacagcccaagggtatagtcttactgaaagactgagacctaatcataggtctatagaatccttcccccctacacacacaccttaccaccacaacactaaagccttgtttactacagtttattttcctgggtaatcatgtctggctttcagcaaaaagtacaaggcatactaaaaagcaaaaacagtttgaggaaatggagcaagcatcagaactctgatatggaagagatgttggaattatcagactgggcatttaaaacaactctgattaatatgctaagggttctaatgggaaaagtagataacataagtagataacatgcaagaacagatggacagtgcaagcagagagatggaaatttttagaaagaatcaaaacgaaacactagagataaaaaaaactagcagaaacgaaaaatgtttttgatggactcaacctctgagcttgaggatatgccaacagaaacatccaaaactgaaggcacagagagaaagatgacctaaaaaatggaacagaatatacaagaagtgggcaactacagaagattaacatacttgtaaatgataataccagaaacagaagatgagaacaaaaatatttgaagcaattatgactgagaatttccccaaattaatgccagacactaaaccacagatccatgaagctcagaaaacaccaaacaggataaatgccaaaaaaaaaaaaaaaaaaaaaaaacatctaggcatatcataatcacactgcagaaaatcaaagataaataaaacataagaagacagaggggaaaagtaccttagctataaaggaggaagaataagaattacatcgtacagtatttggattgtatagtaattctgtgtttaacttttcaaggaactgccaagcttttcatggtggctgcaccattttacattcccatcagcagtgtacagggtttgggattctccacaccctcaccaactcttattatttcccccctttaaaagaaatcataaccatcctaatggatgtgaagtggtatctcattgtggtttagatttaatttccttaaaggctagtgatgttgagcaacttttcatggtatatcttctttggaggcatgtctatttgaactctttgcccattttaaaatttgttcaattgtgtttttttggtcggtgagttgtaggagttctttatatattgtggatgttaatcccttatcatatatatatgctttgtacatattttctcccattctgtatgttgtcttttcactttcttggtagtgtcctttgatgtttaaattttttttgatgaagtccagtttacctattttgttcttttgttgtctgtgctgttggtgttgtatcaaatcattgcctaacccagtgtcatgaagatgtttctctatgcgttcttccaaaattttatagttttagctcttaaatttaatagttttagctcttaaatttaggtgttttatatgttttaagctaatttctgtatttgacttaatataagggtctaacttcatcattgtgcatgtggatatccagttttcccagcactgttgttggaaaggttgtcctttctccattaaatgatgttggcatccttgtggaaaatcacttgaccatatatgcaaggatttatttctgggctttctgttctatacctttgatctgtatgtctgtctttatgctgtggggggaccccacactgttttgatcatctagctttgtaataagttttgcaatcagacgttgaaatgtaataaagatgaataaatacggtattttttaatcctaaaatgttagctccatgagagcacagatttttatctatccttttttttttttcttttttttgagatggagtctcactctgtcgcccaagctggagtgcagtggcctgatctcagctcactgtaacccccacctcctgggttcaagtgattctcctgtgtcagcctactgagtagctgggattacaggtgtgatgcccggctaatagatttttatctatcttattcatgtattagccctaatatctagacaggtatctagtatataataagagataaataaaagctgttgaatggccaggcgcggtggcccacccctgtaattctagcactttggggggccgaggcgggtagaacacctgagatcaggagttcgagaccagtctggccaacgtggtgaaaccccatctctactaaaaatgcaaaaaattagccaggtgtggtggcaggcacctgtaatcccagctacttgggaggctgagacaggagaattgcttgaacctgggaggcggaggttacattgagctgagatcacaccattgcactccagcctgggtgacaagagtgaaactgtctcaaaaaacaaaacaaaaactgctgaatgaatggaatctcccagagagcttaagagtatgatggacaggccaaaataggaaattgaataggaataacagcatttgacaaattagcagttttcctttttccgccttccaaaaaaccctttcctcactcttaaataatgtaacttcagtatgagtattcctgtagcactggattcagtgtgtgcacaattaaacttcagcagccaccgctgcaagtgggctcccagaacccatctcctaagtacttctgtccgaatcttatccccaggcattgggcaggattctggatgagttacttacgatgtcttcacgtgttagatttgtgccttccaatcctcacactaccattcttttatacagttactactacattttaaagtggcaccttggtctgttggggatgggcaagaaaggagctctagagtattagtaaatttaaggattatttggaaatagaagaattgtgaggaaggactctcagcttgggaccttatctgatgtagtgcccagccattgcagatagtcatttaagctagaactttacatgacttgtagtggccctctgctctggagtcttcctgggatatactgccttctaggattggcataaaaagctacctgtatttaaatctcatgtgtagttcatgaaaaataaaatacaaagctgcttgtgaaacttacctaggatagttgaacaagagagtggtcaggccaaggcttcattaagaagtataaaaaggccgggcgcagtggctcacgcctgtaatcccagcactttgggaggccgaggcggacggatcacaaggtcaggagatcgagaccatcctggctaacacggtgaaaccccatctctactaaaaatacaaaaaattagccaggcgtggtggtgggcgcctgtagtcccagctacttgggaggctgaggcaggagaatggtgtgaacccaagaggcggagcttgcagtgagccgaggttgcgccactgcactccagcctggctgacagagcgagactctgtctcaaaaaaaaaaaaaaagaagaagaagtataaagcattcatttctttgccataatgcagagggataaaagaagtgacgattgccattatttagcttctttgaagttgtaagaaacaaattggtttagtttaccttccaagtttattataaagatacatatctcagttggccttcacgaaaattaaacaccatttaccttttatgtcctctagttcacctgttgttaccaactctagtatttccaccattttgaccaatcagcctgtatctccttataatgtacttctatttctctagactataagctctcccattttcttatttctcttggcttcatacttcttaagagaaaagatgtgattgggttgtccagtcatcatccaggtgagcagtgctctcatgactcacctctcaggtccttgatggtctttgggccagagctgatctctggtcatagtcccttagagccagtggtggtgcctcgtcgaagtcatggtgctcatactgagagaaatgtttatggccaatagtcccttagagccagtggtggtgtctcgtctaagtcgtggtgctcatactgagagaaatgtttatggccagtagtcccttagagccagtggtggcgtctcgtcaaagtcgtggtgctcatactgagagaaatgtttatggccagtagtcccttagagccagtggtggcgtctcgtcaaagtcgtggtgctcatactgagagaaatgtttatggccagtagtcccttagagccagtggtggcgtctcgtcaaagtcgtggtgctcatactgagagaaatgtttatggccaatagtcccttagagccagtggtggcgtctcgtcgaagtcgtggtgctcatactgagagaaatgtttatggccaatagtcccttagagctagtggtggcgtctcgtcaaagtcgtggtgctcatactgagagaaatgtttatggccaatagtcccttagagccagtggtggtgtctcgtctaagtcatggtgctcctactgagagaaatgtttatggccagtagtcccttagagccagtggtggcgtctcgtcgaagtcgtggtgctcatactgagagaaatgtttatggccaatagtcccttagagccagtggtggcgtctcgtcgaagtcgtggtgctcatactggaagaaatgtttatggccaatagtcccttagagccagtggtggcgtctggtcgaagtcgtggtgctcatgctgagagaaatgtttatggccactagtcccttagagccagtggtggtgtctcgtcgaagtcgtggtgctcatactggaagaaatgtttatggccaatagtcccttagagccagtggtggtgtctcgtcgaagtcgtggtgctcatgctgagagaaatgtttgtggccactttccttagaaggagcccgtgtggccttggtagagactcggagcctcacatatcattctttactagtgcatcactgggcgctttcattttgaaggagaagtagaaggggctgcacatgcatggtatgtatttctggctcccagagggagtagccatggttatccaaacaaaataacattatcttcacttgtcctttgttctataactttttgtggaagtgttttaggaaccaatagcaattcaggtatattacacttctgttttccatccctttttattgaattattgtttagggcttttgctagaattagtgaaatctgactatttagaaagaaaagatccatgtagctgggccattaaagaagataaaggaaaagaatgggctgtgtgaggctgcccaatatgcaaggagttaaagcagcttggagcagagttgctctgtgattttctttagcggttatcataagccaggacccagagaccttcatcaaggtgttctgtatgaaggccttctttggggatggcatgttttattagaggcatggcagctaaagaataatattttgtaggtagtccatgtacctacttgatcttctctccaagattagttgagaaattttgagaccatggtaaacaggtttctgatgtttgcccaaacccataaggaatcagatgctagttttgaaagggattgccatgcaattagttatcttgctttcatcaatgatataaactcagcttcgtgaaaattaccgtgttatattattatttttctcatttcaacaaagaccggtgaaaacttcttcgtggactggaaccaccgggttgctcatacagcgaggtggactcctagctggttgataaccatacccagagagtgttgatgccgtcccgaagggaagagttccagcccaagagtctggcccatatcacgtgccactgagggtgcctgtgcaggattggaagcctggggaagaggggaagatggagggagaaagggcagaaggcccgggcaggtctgggaggagaggtgtcgaagggtcaataggaaatgcttagacaaaggctttaaagctctgagggctttgttctgggactaaaaaggagaaggaattcttagaactcttctctttcccttggctccttccagtgaaggtcagatttgagagagaaagcagttaacttggcttacctaagagactttattgtggaatatttttccatcctctgtggttagtaaccatagcctacgcagacgggaaaacctgacctcagtgcaaggtttctctgccgtttgagatacattgtctctgattttacttttctttctccttcaggctgcctgataggggctgtaaatctcaaatccagcaatcgaaccccagtggtacaggaatttgaaagtaagtacaaacgaaatgcctaggataatgggcaccatctactggacatttgatgtcttgcagccaactcaggacacatctgtctctgtaagtgtgccagggagatgttccgggtggactgctctgcggtgcacaggcctggaagcatggcatcagcaggccggcagtgagccctgtgcagttttccatcagctgtcatcgcactcctgcctggctttgtgatcacacaacaaataaatttcttttttctttttgagatggagtctcgctcctgttgcccaggctggagtgtagtggcgcaatcttggctcactgcagcctctgcctcctgagtagctgggattacaggcacccgccaccacacccagctgatttttgtacggggttttgccatgtttggcctgactggtctcaaactcctgacctcaggtgatccaccctccttggcctcccaaagtgctaagattacaggtgtgagccaccgcgcctggccaagaaatttcttatatacaagcagggtgtttaagggaggggtacactatgtagtaaaatccttgctaattatctttattgtttttctggcaaaaaatcctttctcaaagtctcttggagtgtggagttggctacgtttttaatctgcatgaaaggcctcttgaattagagcttgcagggtctgggtgcagctgaacgtagaagcactccacattcaccgagagctctttttcttctttgcgtgttaggtgtggaactgtcttgcatcattacggattcgcagacaagtgaccccaggatcgagtggaagaaaattcaagatgaacaaaccacatatgtgttttttgacaacaaaattcagggtatgatcctgtagtcctcttgcctgctgacctttcctctgtccatagacctgggtatacactcttggccagaaacttacctcagactggtaacctgcatctgtagctaggaccgtttttttttttttaaagatttataattatggaaaatttcaaatatatgcaaaagtaatgcaaatggtatatcaagcctccctgtccctgtcccccagcatcaacaagtgcagttcattagctaggatcttaatctgctcacagccccatttctttggggaatcaaagtgaacattttcctaggccatcttctcatgatcctgatgtgagtgatgtaggtgagtgaatgagaaggaccatatgtttcagcaagggcacagcacaaatggactgagccacccactgtgtttctggcttggtgctggggttgccgatggggagaaaacacggtgtaccctgaagtgacatcctcccgggtgggaggatggtggtcagggaaggctccccaaagtggcctctctgggtgcggtgtgaagggtggctggttagcaggcaagatggtatggagggaggtggtgatcaggagagaatgctgtgtatgaagacgcagaagcaacagacggactggctgatgggaaagactggaagttccccactgttgccggtacatggacagggagagagggaggagaggggggagaggggctggagaggttgcctggccaggcagactgcactgaatgccaggcgagcatgggcggtatctgagggcccgctgtgaggctctcaggggaggtgccgtggctgcatctatgtttcagaagactgaagtggctgctgtagagaagagattggaggcggcacaactcagagcagaggcccaagtcagaggccttctgcagagtccgggagagggctggtggggggccccaagctggggtgcaggcagggagagagactcgaggggaggcctgctggggcttggctgtgccaaggggcacagagggaggcaggcaggtggctggagaggaggatggcatcctttttctgacaggagggcgggagctgcaggaggtacacatgcaggctcgtgcatgagtcggagcctgtggagttctcagagaagttgagagttgagagggatttgtggaagcagctccaacacagtcttgctttgggttctcagtgtcgccgggagcctgagtctcctcaaaagagttttgcttcccactcacgtgaagtccctcctttgcctcttatttttggagtgatggaaatgttcttctcagaacacagatctgttttctttggctactcaggctgaccctgctaaaccctgagcatgtagttagagcatcagaggaaccaggtgagaaactctttaaagaactttccttttctggggattaaacattttgctcttagccacagggatggggaggccgagggagacggtttcccgcacagaatgccggggttcggggaggatgcagctgtacttggcctctttcctcgcctcagtgcagggctgcaccagaggcaccctggtggggtttatttactcttttctcacatggtaaaggttcgaatcctccactaatgggtgggtgtataacaaagcttcccattcgaaaatgttgttgccaacgtctgtgctccatcggaagcatcttttagtgtgctgtttttagtgtattatggcaagcccttcatgtccttgtcagcagttgtcaggtttagcgatgagtagttgctactcttttgtgtcatgttttcctaactccttcccctatttgttgttttccaggttcttcctgcttctttgaaagtgttattatgtcttatgtttaaaatgtttttttatggagctgtaattcgtaccgcatccttttaaagtgtgcagttcaggggtttttaatatactcacagttgtgcaaccatcaccactatcaaattccagaacattttcatcatcccacagagaaagcccgtacccagcagtagtcagtcctcctcccgcatccctggcagctctgattccactttctgtctctgtggatttgcctgttctggacactggatagaaactgtggtcttccatggctgacgtctttcactcagcatcctgttttcaaggttcatctgtgttgtagcctgtgtccgtacttcatttcttttcacggctgaataatgttccattgtagatataccacattattttacccattctattgatggacatttgggttgtttccactttttggctattatcagtaatgctgctatcagtatttgtttacaggtttttgtgtgaacctaagttttcatttctctgggataaatgaccaagagtacaactgctgagtcttacagtagttgcatgtttagttgtttaaaaaaccgacagagtgtttttcaaagctgctttacgattttacactcctaccagcagtgtattttcccacatccttaccaacacttgttattgtctgacttgttaagttctagccatcttagtgggttggaagcggcgtcttgtggatttgatttgcatttcctggtgactaatgatgttgagggtcttatttgtgtattttctttggagaaatgtctgttcaaattttatgtccatttaaaaatatttttttttctagaaacaggatctcactgtgttgcacaggctggacatgaattcccaggctcaaataatcctcccacctcagccttctgagtagctgagactatatgtgtgcaccactgcacccacccttatgtccagtttttaaattaggttgtctatttcttactgaagtgtgaattctttattctggatgctaggttggatgtacgatttgcaggtatttctcccattgtgtggattgttttcacctgcctttgtcctttgaattttgatgaagtccggtgtaactgtttttagtgtgtgcttgtgcttttggtgtcatatctaagaaaccattgcccaatccaaggtcatgagggatttatgcttatgcatttttctaagagttttatagttttaactcctatgttaggtctttgttgtatatggagtgagagagaggttcaacttcatgtgtttgcaagtggatatcaagttatctcagcatcatttatgaaacattggttgtttttctagtggtgtttttttctattcatgggcggtccttcctggaaatgaggaggaggaggtgaagttcctggttttaatgacggagacacatggtaatgagtgtgtcttgcacaccaggaactatttttggtgtttaggttacagataggaataggtcatggttcctgtcctcaagagagttcacttctgtactcgggaatagaaataaatattgatctgcaggcttccttgctgtggcatctagtgctagccccagaaaccaccctcttcaagtggcaaagatttctttaaagaagttttttagtgcctcgtgtcttttctgtaggagacttggcgggtcgtgcagaaatactggggaagacatccctgaagatctggaatgtgacacggagagactcagccctttatcgctgtgaggtcgttgctcgaaatgaccgcaaggaaattgatgagattgtgatcgagttaactgtgcaaggtaggagctcatgcgaaggtgagacattgccaccataggatgcaagagatcagttagtgtcttggtttctttccttctagaactgtatccctgagggcttcacatggcttagggaggggagaactgttgagagctgagactgcctgagttggggtagaaggtgagaagggaagtgaagttcctgtcacttccttccaccagctagaggaggcgctttaacatatgggagggcaggatgcagcggtggcttgtcagtctgcagttgtgatcctgggaacagcagtggcgtgggaacccctcgactggctgtcttgtctttggagctgatttcttctgggctttaataagaatagagccctgtcactgagatcttaaacaccacccctttttccccacagtgaagccagtgacccctgtctgtagagtgccgaaggctgtaccagtaggcaagatggcaacactgcactgccaggagagtgagggccacccccggcctcactacagctggtatcgcaatgatgtaccactgcccacggattccagagccaatcccagatttcgcaattcttctttccacttaaactctgaaacaggcactttggtaagatctcttctaagaggtgaggatggagatgtctttgttggggcaagagatgcttattgtgaaaagaagattaggagagatactgaaacttcttgataagacaggagtcaaaaatctagaatgttagggattctacaggaaaaatgacccttcttccttttataaacaagtacattcttagggggtaaaataaggaagagaaagaaaccatagattgagaccgaagagggatattaagcaaatgttactagggccctgatcggataatcaactgtaaaagtcattagacaatcggggaaattggattactaggtggtatttgatgatctattaagcaactgttcattgctttaggcatgatgaaggtattgtggttacgattttttacagtcttgtagagatactgaagtatttatggataaaaggtgtttggaatttgtttcaaaataacccagtggtggtggtgggaggtgggggaggagaggaaacagattggtcatgcactagaggacaaagtgacctggccagcaaaccacaccaggcttttactgcatgtggttctctcctgggaggtaccttctgatctgtggaccatccagttccacgtagtcatcagacagattttaacagggtcctctgtgttcattttgccaaaatgttgccccaggagcagtcatcattgaagagcccttttaccagaataaaagcaaggttccacctcccatttcggatgttgccaggctttggtgtctccagtcccaaggggattggttgttggggagctgtcaggcaggtatcagggagtgggtcagggaggaacatgcacagtgctggggaagctgaaagcaagcgagcaggtgtcgacctagttctggacccagctggctgtgctctcagaaatcggccccatgatgggtccgattatttacttgtcattccctgaaacaggtgttcactgctgttcacaaggacgactctgggcagtactactgcattgcttccaatgacgcaggctcagccaggtgtgaggagcaggagatggaagtctgtgagtttcttttttgaagaggtttcatcgcaagactgggaagtgaatagaacattttaatttaatattataccatcagcttagagaactcttccgccatgggttagctttcttctggagctgcctaggtccaccagaacccactgcacagtgaagggaaggctgagaaaaccgagtccagataagcaggtcctcaaaacaaaaccttctgggatctgctggtgttgggaacgtggccagccttgcaactttcactgcaagtttagtaaactccattctttggtaattgatagaattatcaaaatgtaaggtggtgtcaggtctccagaaatttatccagttataaccctcttgtagaaaactgacagttttagcccgagtaattttacctgcagacaaagcttagcccctagagtaatgttatctcagggctctggttcccctaatggaggggcgttgagaggagggtgggggcagagaggatgtgtccaaatcacttggggagcttttttttttcttaaaaaacaaaaaacaaaaaacaccacagggtcttgctttgttgcccaggctggagtgcagtgagtgcagtcacaggtcactgcatcctcaaacccagccttcaagccattctcccacctcagtctcctgagtagctggaacaacaggcacacaccaccatgctcagctaattttattttttgtagatacggggtctcactgtgttgcccaggctggtctcaaactcctggcctcaagcaatcctcctgcctcggcctcccccaggtgctgggattaacaggcatgagccactgtgcccagccaggagcattttttgaatccttccctcctccctatttggagctctcctcagagcagcattttccaaaactgcctggtgatacccatttgggaccactgtttcacatacagattcgagcccacctcagacatatgctagaaatgtctgtgtgtgagacaagcgttccgaaggattcttctcatgtgtcacgtttgagaaactctgctctagggttgttttctcctgcagttttgccccagacctactttagcctattgactttttagtgatgaaacttgggaattgacattttaacatcaaaattgcatgccaggcgtggtggctcacactataatcctagcactctgggaggctgaggcgggtggatcacctgaggtcaggagttcaagaccagcctggccaacatgccaaaactctgtgtctactaaaaatacaaaaattagcctggtgtggtggcaggcgcctgtagtcccagtaacttgggaggctgaggcagaaggatcccttgaacccgggaggcggagcttgcagtgagccgagattgcaccacagaactccagcctgggtgacggtgacggagcaagactctgtctcaaaaaaaaaaaaaaaaaaacgattgcaagtttactttttgtttttgagatggagtctcgctctgtcacccaggctggagtgcagtggcacaatctcggctcactgcaagctccgcctcccgggttcacacctttctcctgcctcagcctcctgagtagctgggactacaggcacctgccaacacgctcagccaattttttgtgtttctagtagagacggggtttcaccaccttagccaggatggtctcgaatctctgacctcgtgatctgcccacctcggcctcccaaagtgctgggattacaggcgtgagccaccgcgcccggcctgcaagttgatttttaagtgtacattcatctttgagaaccaatacactaggataaaggagatttttttaaaacttccaagttacttggctcttgttgataaattccctgcatagttttccatgtgtcgcttgcttgaaggaacggctgccagagccccatatgaaagtgacccagtgcctttgcccagtgtatagacatgagaaaagggttccagggggtttcctctcagagggcttatagatcggaggtcaggcagccggcagagacaaagctctagttcttacctaggattctttacttgtttgttttttgagacagattctttaaggcttgaagctacctttcttccccgcagcaatctgcaacaaagggaggccctggaaattagggattcttttcttcttgggatcctggctcctaatcttgtcctcataaccatttcctccataagtaatctcaggcattcagccagaggatttttaagcctacagtgccaagcccactttaatacacttttcagtgcgactgcatttcaactgtagaagtctcagtacttttcacgtgtgaagttaggagttatggtgtcctatatgttctaggctagaaggattgtaagtgttctctcttctagctggggtaggcctgagggggcagggggcaagtgggtttggggtgaaggaaggaggcacagcagggccagggcctttttaaataacagatagtgtgtatcatggcttccaccaaacctccttttcttcagatgacctgaacattggcggaattattgggggggttctggttgtccttgctgtactggccctgatcacgttgggcatctgctgtgcatacagacgtggctacttcatcaacaataaacaggatggagaaaggtgagcctgccttatgtgaaaaaagggaagttcaagctggcaataatataacaaccctgttgctaaactgctctcttctcctcatagttacaagaacccagggaaaccagatggagttaactacatccgcactgacgaggaggtaatcatttagtaaacctggaaacctaggtgtacccagcagggaaaacaacattcccccttggaaaccacacgggtctcctgggaagatttctgagtgattgtgcagctcctgagctcctcagccccttcacagtaacacacacacacacacacacacacacacacacacacacactaatgggatttgtgctttgcaagcgctagtgatggtactttttaagaatgattattccatctgtatttagcccatgttagacttactccgtgtttttccctgcttgccaccaggccccttgatggctctaactgtgtgttggctttgcagggcgacttcagacacaagtcatcgtttgtgatctgagacccgcggtgtggctgagagcgcacagagcgcacgtgcacatacctctgctagaaactcctgtcaaggcagcgagagctgatgcactcggacagagctagacactcattcagaagcttttcgttttggccaaagttgaccactactcttcttactctaacaagccacatgaatagaagaattttcctcaagatggacccggtaaatataaccacaaggaagcgaaactgggtgcgttcactgagttgggttcctaatctgtttctggcctgattcccgcatgagtattagggtgatcttaaagagtttgctcacgtaaacgcccgtgctgggccctgtgaagccagcatgttcaccactggtcgttcagcagccacgacagcaccatgtgagatggcgaggtggctggacagcaccagcagcgcatcccggcgggaacccagaaaaggcttcttacacagcagccttacttcatcggcccacagacaccaccgcagtttcttcttaaaggctctgctgatcggtgttgcagtgtccattgtggagaagctttttggatcagcattttgtaaaaacaaccaaaatcaggaaggtaaattggttgctggaagagggatcttgcctgaggaaccctgcttgtccaacagggtgtcaggatttaaggaaaaccttcgtcttaggctaagtctgaaatggtactgaaatatgcttttctatgggtcttgtttattttataaaattttacatctaaatttttgctaaggatgtattttgattattgaaaagaaaatttctatttaaactgtaaatatattgtcatacaatgttaaataacctatttttttaaaaaagttcaacttaaggtagaagttccaagctactagtgttaaattggaaaatatcaataattaagagtattttacccaaggaatcctctcatggaagtttactgtgatgttccttttctcacacaagttttagcctttttcacaagggaactcatactgtctacacatcagaccatagttgcttaggaaacctttaaaaattccagttaagcaatgttgaaatcagtttgcatctcttcaaaagaaacctctcaggttagctttgaactgcctcttcctgagatgactaggacagtctgtacccagaggccacccagaagccctcagatgtacatacacagatgccagtcagctcctggggttgcgccaggcgcccccgctctagctcactgttgcctcgctgtctgccaggaggccctgccatccttgggccctggcagtggctgtgtcccagtgagctttactcacgtggcccttgcttcatccagcacagctctcaggtgggcactgcagggacactggtgtcttccatgtagcgtcccagctttgggctcctgtaacagacctctttttggttatggatggctcacaaaatagggcccccaatgctattttttttttttaagtttgtttaattatttgttaagattgtctaaggccaaaggcaattgcgaaatcaagtctgtcaagtacaataacatttttaaaagaaaatggatcccactgttcctctttgccacagagaaagcacccagacgccacaggctctgtcgcatttcaaaacaaaccatgatggagtggcggccagtccagccttttaaagaacgtcaggtggagcagccaggtgaaaggcctggcggggaggaaagtgaaacgcctgaatcaaaagcagttttctaattttgactttaaatttttcatccgccggagacactgctcccatttgtggggggacattagcaacatcactcagaagcctgtgttcttcaagagcaggtgttctcagcctcacatgccctgccgtgctggactcaggactgaagtgctgtaaagcaaggagctgctgagaaggagcactccactgtgtgcctggagaatggctctcactactcaccttgtctttcagcttccagtgtcttgggttttttatactttgacagcttttttttaattgcatacatgagactgtgttgactttttttagttatgtgaaacactttgccgcaggccgcctggcagaggcaggaaatgctccagcagtggctcagtgctccctggtgtctgctgcatggcatcctggatgcttagcatgcaagttccctccatcattgccaccttggtagagagggatggctccccaccctcagcgttggggattcacgctccagcctccttcttggttgtcatagtgatagggtagccttattgccccctcttcttataccctaaaaccttctacactagtgccatgggaaccaggtctgaaaaagtagagagaagtgaaagtagagtctgggaagtagctgcctataactgagactagacggaaaaggaatactcgtgtattttaagatatgaatgtgactcaagactcgaggccgatacgaggctgtgattctgcctttggatggatgttgctgtacacagatgctacagacttgtactaacacaccgtaatttggcatttgtttaacctcatttataaaagcttcaaaaaaacccaaaca

SEQ ID NO: 37798 - DNA, 8687 bp, Homo sapiens; identical to SEQ ID NO: 36921

SEQ ID NO: 37799 - DNA, 61991 bp, Homo sapiens
cagaaagtaacactgaggcccatgtagaaaacatcaccttctatcagaatcaagaggacttttcaacagtgtcctccaaagagggcgtgatggttcagacctctgggaagagccatgctgcttcggatgctccagaaaacctcactctactcgctgaaacagcagatgctagaggaaggagcggctcttcaagtagaacaaacttcaccattttgcctgttgggtactcactggagatagcaacagctctgacttcccagagtggcaacttaggtgagcttgtgctgatgatgcgcatttcacgcatgtgtgtccagtcctggaaaacaaagtttctgccattccccacaaccccattctgagccattgtgcccttccaaggttcctaggctggggtgggtcagacctgtgacttaggcctcatatgtattatgcttgccaatacagaccagacaagggtgcagatttgctggtcctgtggtatctgtgatccatggccagtggaatccaaccttcattctttttccagggagcctgccacacccgagggtctcagaggcagtaggttttgtgggatgcatagctgcgacaggcttgggtttggtttgtgttgatgtggcccaaacggttgttcttgccctggtgtgcacagcttggtggtttgctatttttagcaaagaatgtcaagaaggtgctggggctcaatgggtaaaattgcacggaggaagagaagactaagaaaactagcattaattagggacctactacataccaccatgtctgttctctcaatccttctagcaagcctatgagatcatgttattctccttttaggcatttggaaactgaagctcagagaagttagttgtcccaatatgtgtaggtcaaacagttaacaggtttcagaactgggattagagcttatgtgtatgtatctgagcaaggtggtgggggtgctgaggtgtggaatgcctggacaacgagagtgaggtgcagaggagagaaagacaggtgtggcctctctgtagggtggtaaggccagcaggctcccttggggagggcatcagttgcccacaaaggagaggaggaacaggtaggaccattgcgtgaacggggttagggacaatcacggaggacttttgaaacctggcagtttagatttggtgtggtaacaagagtcagtgaaggtttctgagcaagtaagtgacataactaaagtgaatttgaggaggattcgcctggcaggcaggttacaggatgtctagcatgggggtaggaggatggagggaacctggagtcaaagggaccacccaggcagacagagaaattcagacaccaggtgctgcgatgtggcctagtggccacagggatgaagaggagacttcaccaaggaaaagtgataggacctgttgatggcctgaaagtaaaggatgaagccgtcagagatgactccatggtttcaggtcctagtggcaggagatctggttgggagggactcgattctgtaaagatgcatatgaaagtcttttgtattcataaatgattcctacagagcttagaaactctgcacatgacattccctggtcctcttggtcacccagatattaggaattttgtttatattgcattcaggtacattctgggaccaatctggtggaatgtggatgctgggtcctgatgatcagaccctgatctctgattccatattgtctgatacttacctccagtgagctccttttctgagaattttaccacaatacacagaatctttgtgagatctaatacacagaccttggtctgtggtctctttcaggagtttatttttcatagactgaattattctcctaatttcttcttatgtctgtatattttgtagatgtcagaactgagccccctaaaagcatattaagacattttgaagtctgctggtggaattctaattgtttttgtctgttttcagcctcagaaagtcttcacctgccatccagcagttcagagttcgatgaaagaattgccgcttttcaaacaaagagtggaacagcctcggagatgggaacagagagggcgatggggctgtcagaagaatggactgtgcacagccaagaggccaccacttcggcttggagcccgtcctttcttcctgctttggagatgggagagctgaccacgccttctaggaagagaaattcctcaggaccagatctctcctggctgcatttctacaggacagcagcttcctctcctctcttagacctttcctcatgtgagtgccacatacccagcttaacactcggaagtcactcaaagtagacataaatcaatgtgcatagccagctagttacatactcataatagtgggtaaggggaaaagacatcaagccaaaatgccattcctctaatgccaggtacttggagtggaagtaggtacaacctacccagtttatctcagtattgagcctcatgtttaacatagtttttctttttttgtcgcccaggctggagtacagtgacgcgatctcagctcactgcaacctctgcctcccaggttcaagcgattctcctgcctcagtctcctgagtagctgggattacaggcgcccatcaccatgcccggctaatttttgtatttttagtagagacggggtttcagcatgttggccaggctggtcttgaactcctgacctcaggcgatccactcaccttggcctcccaaagtgctgggattacaggcatgagccaccacacccagccattggtgtctattctcaaacaagagaccttaccttggggtgcatgaaatggtgagcattgtaccatttgattaggagtgagatttttatttcttcattattgcaaaaatgtttccttcgatggtaaagaaaacatgagtgtacatttttctaggcatcattttgaaaaaaaaagcagatataatgcaggagtttgcaaggcgtgatattagtaactacagctgtggagtgctctcctctctctctgctgttccaattactattcatcacttaagtctcagctcagggattcctgagcctttcttcaaccatctggtcctctgtgctgtacacctcatcatagcaggtcatctaatgcctctctgcccagagagactgtaatcctcttgaggacaccggctgtgtctgttacttcctttaggttccccctcgcccaagaacaaggtgcagccgataagacatagggattagcatgtgcccagataccctcacagggcacatcatgccatgggccaaagagagtattggaaactctgaccatcttttttcttctccgaggttttattcagtgtttgtgtgtgctgcttgtgttttcatcctcgtaccatagggagcaggacagagagggttggaaatgttcttggaaaatagaggttaggttgtctccaaaattgccattgcaaaatttttacaggtcagaggtttttagaagtaacttgcgagactaggagtttgggtttgtgtcatcaaagcaaaaactaaacccaggagtcccttctggagtgcctgtttaaagcagccaattcttcttccacataccctgtatacagtttcctgctgactggatttggatataattcatgattcatgtttttagaagattgctttttaagattattcataaacattgcttggattggataaaagctgcaattcttccagcctcaaagttctgtggttcagtgatttacaactttactaaacggtagaaaggaagtattttttaggaagctatgctttgattctggtcaggatcatttaatatttataatttaaattcaacctactttggtggtatatttgaaaaatcagcctatgtttccaactttactggacttgactctatgactctatattcacctatatatttttttcacgtatatttttcaacactaaaaaattaattgtccctgaaattctttaccatccatccttttaaaagcttatacttttaactgctggtgagtttcatcgtatctttcatatctcttgagtcttttactgaacacttctcttcctttttagtgaactgtgtgttcagttcgaggtagagtcccaccacccttttagatattagagatggctctgggtgctgttaaatggggttctcaccaggcatccaagtatgtctgaatccatcctgccaacctcccctcctccccgtggggatgcagagggtacatgtacaaagacctgaagttacatgggaaacaaacttctgctttgtttttaaagctgggctggcatctggtaacccactaaccagagtcttccccttgaatctaaatgttgagacattactgtccctttctgactacacgatacaggagctctaggcactcaggcaagagtgctgagagagagccagcaggacctgccagggagacctggagtcggctcagcctggctggccagctctggaaaaacaaaagcaaaggaggtgaacacttggccactccacccactaggaaatatgaccctgtgaaaagcctggcgcttacaccagtccgatgagtgatgcgcctcactaggtgaacacaaggaagatagctaggagcctggcatggagaggaggtggctccttatttggaacatgaaggaatttgaccagatgatctgaaagattctagtttcagcatctatgattccacgtgtattcagcctttgtattctgtgcctcgtttcactcttcactcagctacacagaaacatgcatgcaacataacctcttccgaggctgggatagtcaggagttacctgcttccaaaaccaaattgtatgccttacagtgttaaagcaagtataggcctaggcaatggaatcagatttttaaaaagagatcagaaaccattggaaattgtttttcttgctgctttacatcttttgctgctttatgtccttctatgtgttccatattttttaataatgaccattgtactatttgatcatcggagggaaaagcaaacaaagcaacgaacagggaaaaaagctcccttttgaaggtggaaagagatatgtgtatgttgaattgtgtgagagtggctacaattgagcactaaatttagtactgagcttcctggaaaccagggcacaaagggaaaccgggtggggcatgcaattgttttcagataaagtaagcatacaatttcatccataggcataagtgtttgggggcagtacattttaagaggactgtttatataagaaatgttgagaatcataatggaaaatgccttcaattgctgttttgtggaaattgagctaatgttctttaaaaggtgatattttatatagattctcaataggagctgaggatataataatgtatctcaacttatgaaagtatttctgtgggtggctaagctactgtggtccaggtaaattgctttgtggtgatttcactttgtaaagaaagagagcataaataactcagaagattgcagatgtgacgtatctttctcaaatagctgcttcagctgtactttcggcaagttctggatagcagtcaggtcaaggttgagcgttccgatgtgttcctgaggttccagtgttttgtgctgtgattgaagagagacccatgtacttttagcagacgagtaggcattcttgcaacctcccattataaagatcaggaatttggcttgtttctgctcccagatggatggtctttccgtcgttgaatggctgctttcggggtagaaatgagcaagaagggcaattattaaataaccaagaatccagcctgttgattagaaatgtggtacatttcccccagatttatttaacaggtgctcatttagtaatataagtggtgtttgtagattagtttgaccaaacattttctctttttacgaagagtcaccaactctgccaaagtattcacacacatttcatagctttcccgtgaggattaaatgagatttgtatacaatgtacttcgcccaatgccttgcaagtcataattggtcagtaaatggtagtttttgataatgatgataatgatgagataatgagataaagaagcaatgttctgcagagctctcagagtcagggaaaaacagagcagttttcctttcatgactttcagcatttgtgacttttgtaattatatttctgtggccattgatttgctaaatccactagagatggacaggcctgggtttttcaggctgaattcagtatcaccactggagtttttttggtttgtttgttttgttttgtttttgtttgtttttttgtttgtttgagaccaagtctctctctctggctcaggctggagtacagtggcacaatctcagctcactgcaacctccacctcccaggttcaagcaattctcctgcctcaacctcccgagtagctgagattacaggcacccaccaccacagccggctaatttttgtatttttagtagagatggtgtttcaccatgttggccaggctggtgtcaaactcctaacctcaggtgacccacccgcctcaacctcccaaagtgctgggattacaggcatgagccactgcacccggccgaccactggattttgatgggaatgttgaatggatgaaattaatgcagtatcctgggaataaaagtgttttgaaagaacctctagcaagctaatgaggctgtaatttggtggatataaatgatgactctaatgaagttagggctgagaagtcacatggttgagtgaggatttggggcatatctataatgctttcttttctttttatttatttatttctttttttttttaatactgaagtgtgttttgtttgttttgtttagtttggtttatgtttttaagtagaggtgggttttggtggtctgggactctatttttgtgtccaggtctttctgtttcttgtttccattactagttttatagattgcctgcatcttcattttgtctccattaaggtggggtgaccagagctgccggctgtgttctggatatagctggttttatggttttgcacaagaatgagaggaacctttttgtttcccatgcatgctctctctctctctctctctctctctctcgctgtagtgatacttaaaatttatttgtggttttgctcacaactgcacataggactggtcttcaaggaaatgtttgtaatgacaacttcctttttcccttttctaggccataattaacagctcaaagccttttattatataagtgtagagtactttttattatttttagcctaaaaagaagaaaaacactctctttttgtgactttagtcttacccaccatgtttctttccattccctaagctttcctgcagtttattcccgtttggaatgaagattttaatagacctttctggaggtcagttctcagggcatcctttggaaagttatttgtggaaaggagacacccgtacttatgtggagcagactacaccttttgaccaatagcgtctgattcactccttgaggctcttgacagtttccccatggcagccatccatctattagagcaaatgctcctggagtccttgatctctgaggggcccattggagtagtatgcagatttgagagctggtctctaaagcttaatggggcaaagtatgataatgaagcctgtttgcttttgggtggaattaaatttgtggggtaataataagtatttcctgctggttagaaattctgttacttaataaatgcagtttggttaatagtctttcaaaacatagggcttatggtggccatgaggtagggaaaaataaagaacccttgatggtgacaagcctaggaattactgctctaggccatgagtgtcccagctgtgttctgcaaaaccctcggcctcctcaacagtgacctggggtggggcaccttgcagcagcttcacttttattcattttatattatgagattttaatcaataatagcatttgaacaaaaaggttacattgctaaaacaaagcagaacaaaataacaaaaaccttatcacagtggccagtcctgtttaagctgtaatgtagaattcagcagacattttcatctttctctttaaaaaacaaataatgcaaacaacgtataagcttctcattgtgcctggtgagggatctcggtgttctccaccttcctctgtgaggattagacctagtaaggggagagtgcaggcatgtgtcctggtagcatgcgtgtgtatagatatgtttgtatctatattaggtccatggtatttagatgtatccaccaaaatgtaagaaacgtcatttgtatctcgaatatagtccggattttcttaaactcctgagtaattttgaagcatatctttttccattgtagcttctgaaagtacagagaagcttaacaactccactggcctccagagctcctcagtcagtcaaacaaagacaatgcatgttgccaccgtgttcactgatggtggcccgagaacgctgcgatctttgacggtcagtctgggacctgtgagcaagacagaaggcttccccaaggactccagaattgccacgacttcatcctcagtccttctttcaccctctgcagtggaatcgagaagaaacagtagagtaactgggaatccaggggatgaggaattcattgaaccatccacagaaaatgaatttggacttacgtctttgcgttggcaaaatgattccccaagtaagtattccatctttacttgatctattagggacatttgtaaatcattgaattttcttaggggacctcttcaagaccatttgtaatctccagagaaaagtgtgctttttaatggcactattgcattttgatggtcactcttatgagaacattgtgaagttagtcagacaggtgtcattcctcctgctttcttatagatgagaaaactacggctctgagtgtttaagtaatgggtgcctggccatttagctcactcagtagagttgagaccttagcctcagggttcttggttccatcttcttttcactctacaggatggtcttcaagctgagagccggcctactctttatgttttattttgttttgaagacaatgtctggctctgtcacccaggctagagtgcattggcatgattacggctcactgcagcctcaacctctccaggctcaggtgatctctcaccttagcctccagagtagctgggactacaggtgcatgccactccatccagctaatttttctattttttgtagagatggggtcttgcaatgttgcccaggctggtcttgagctctggccctaagcaatcctcctgccttgccctcccaaagtgctgggattacaggcatgagccactgcacacagcctggcccactcttcaaactagcttcagttattttgtgtacagatcatctttctgcataaatgtgcagatataaatattattcccaaattcgtggtttggcttaatccttataattgatttttgtttttgctatactttggtatttagaataacctttattcatatgagaactgttttaggaaagtgctctgactgtgctatatttatttgcattgtatttgttgtacataaccacacactcactctctcgaacactttttatgggaaagagaatgaaacactcaagcctataggttactttgctacttgcacatgctatttcaaaggtcccctgttcaacaagttatatttttttgtattactctcttgctgccacccaagagttttgaaataattatttagaatatgatagtgcataatacatttaataaacactataccaggttccttggcaaagaatctttccctagagaggtctcacttcttagttgccaagggatctctttcatacctatgtaatggcctttttttcctatattaccttacagcctttggagaacatcagcttgccagcagctctgaggtgcaaaatggaagtcccatgtctcagactgagactgtgtctaggtcagtcgcacccatgagaggtggagagatcactgcacactggctcttgaccaacagcacaacatctgcagatgtgacaggaagctctgcttcatatcctgaaggtgtgaatgcttcagtgttgacccagttctcagactctactgtacagtctggaggaagtcacacagcattgggagataggagttattcagagtcttcatctacatcttcctcggaaagcttgaattcatcagcaccacgtggagaacgttcgagtgagtttttccatttcatgcaactgtgccccatagaggagagagggactcatgatgcttatgaaatctgtggcgtattaaaaccacgcatgagggcctagcgtggtggctcacgcctgtaatcccagcactttgggaggccgaggtgggtggatcatctgaggtgaggggttcaagacctgactgacctacatggtgaaaccctgtctctactaacaatacaaaaaattagccgggtgtgatggcaggcacctgtaatcccagctacttgggaggctgaggcaggagaatcgtttgaacccaggaggtggaggttgcagttagctgagatcgcaccactgcactccagcctgggcgacaaaagcgaaagtgtctcaaaaaaaaaaaaaaaaaaaaagcatgcatgaatgaaataactcctcaggcccctccaccttccttccttatttcccaggcccttcttctagctggttgatacagatacacctatatatcccccagttttttctggtacatctctgagaagctgttcttgccacttcctcttcccacacacagctcagggacttctctgtccacatcctctcattccctgtagccaacccataactccatacctgcctcagtcacagagcttctggaaggtgaaaatatcaccttctcgttagtagttgtcggggcattcatccaaataaattctctgttttttaaaaaccagctttattgaggtatatttcatattccatagtatttgcccatttaaagcacacaattcagtgatttttagtgtagtcacaaagctgtgcagcatcaccactgtctaattccagagcatttccatcaccccacaaagaaactccaaactcatcagcagtcaactcccattctcccctcctcccagcccctggcaatcactcctgtgctttctgtctctgtagatttgtccattttagacatttcctataaatgaaatcatacaatatgtggtcctttgtgtctttcccttagtgtcatgttttcaaggttcatccacgttgtatcacaacttcgttccttttcgtggcttaataatatgccgtagcagggatataccacactttgtttatcaattgtcatcaattgatggatgtttgggttgttcccaccttttggctattatgaataatgctgtggtgaacattcaggtacaagtgtatatgtggtcgtaaattttcaatttatttttttttttttgagatggagtctctctctgttgcccaggctagagtgcagtggcaccatcccggctcactgcaatctccgacttccgggttcacgccattctcctgcctcagcctcccgagtagctgggactacaggtgcccaccaccacgcctggctaatttttttttttttttatattttcagtagagacagggtttcaccatgttagccaggatggtcccgatctcctgacctcatgatccgcctgcttcagcctcccaaagtgctgggattgcaggcatgagccaccatgcctggccataaattttcaattatttaggaatggccaggttatgtggctgtggctgctctatttttaaccttctgaggaactgccgaactcttttccaaagtggctgcatcattttatattcccaccagctgtgtacaagtgttctgatgttgctacatcttcaccaacacttgtaattatccatcttttctgattatagccatctgagtgggggtggaggcatctcattgtggttttgacttgtattttccagttgactaataatgctgagcatcttttcatgtgcttattggccacttgtatatcttctttgaatatgtctagtccaatcttttgactattaaaattgggttatttgactttttattattaaattgtaagagttctttatggccggctgtggtggcttacgcctgtaatcccagcactttgggaggtcaaggcgggtgaatcacttgaggtcaggagttcaagaccagcccggccaacatggcaaaaccctgtctctactaaaaatacaaaaattagccagacatagtggcacgtgcctgtaatctcagctacttgggaggctgaggcaggagaatcacttgaacctgtgaggtggaggttgcagtgaactgagatcatgccactgcactctagcctgggtgacaaacagaccctgtctcaaaaaaaaaaaaaaagttctttgcatattttggatacagtcctttatcaaatatataatttgcagacatttctcctattctgtgggttgtcttttctctttcttgatggaatcatttgtagcacaaaagtttttaaatttgaagaagtccaatttgtcaatttgagaaaatttttcttttgatgtttctttttaataatgcttagggataattttttaaaacaattctcacagtctgttatcaatgtaaagtatattctgactaaagcaaaaatgtattagctgatcatttaagctttgaataggtttaaattcttacttctccatcactagttatagcttcatttcccccatataagaatcctaattgatgaggaagattagcatttattagtactcacgtgatgtggaaaagcatatgcttatcatgaaagaataccacacacacaagcgggggatatttatgctcttttatgtttgtgcctggaaaacacattatctatgtcctaagcaaaaggaatcatttttcaccctcactactgtgggggtcaggacttctaccttctcaaaccaggatcttgagtttcatagcctttctcttttacatctcttcagtacccgcttctctgcaattaatgctcagttggttcatgaggaacatatgatttcagtgtgatcagatcttggagttcatttataaagagctagatagaaagtagccacattcctgaaaccatctcactgtgggttaacacaatactttatctttttccctcagagtcacccaaagctggcggggttctgcactccggccttttagagttcttggcccgctcccttttctgcattcagagtctccatttcatgtctgactctctctctactttgttaagcctgtaaccctgatgtggtcattggcctaaatttcatttaacagagagtttaggatctccccatccaagacctttttctctttgcccagagaaatcgtacttagatcctgctcttgcgcctctcctggttggctctccacaggtcttgagcccttcagactggcttgagtcgcatctctgtctggcttctggctttctcagtgatgctcgtggcccgtgctcattcctgtctctgtcaattcaaacctatcccaaaatgaatttagccaacactcagctttacactgttttccatcaaagcatggccatggcgtactgacagccagtctgggctgggaatgtgaataagaaccagaaaagagcctgttttttgttttttgggtttttttttctttttgtacagccagattaggaaggatttaggccaaggagaattggacctcattttcatcatttctgaagagaagggtttatctgataatctaacaatctaaaattagttctaagaccctttaggtttgtagcataaacacatacccaaaagagaatgaaacagacatttattcatgtgtcgtctgccctcttccatccccatcaatagaataaaacacatgcattttaaaaaataaaagaagacaaaaaaacaagcccacctttcaccccccacctcaggctgtttctttgccattgtactaatgccgtgtaatgactggccttgtggccattcatgtattcctggtccttccgggaggaagagccttccaaggaggactatggcctcccttctgggccttgtgcaaatgtctgaagccccagtaggattattagtctttcaccaactgtttacctcctcaccaccactaccaatttctctgacataaactctatttattatgtatcactgagcagaaatctagtatcgatcctatttgctaaagtaatataccctcctataaatccagggtgcctgaacagttgtgctgatccacagttcctcttgaggtttcaatcactgagccatgtttgcaagggcaacagacatctcagataaagaccctaaaagtacaggggagcgtcttggctcccacagcccaggaagtgaggcttggggcacgatcctgtcgctccagccctgcatttttcagccatcctctttcactctacttttagccttggaagacagccgagagccaggccaagcactaggtgacagttccgccaatgcagaggacaggacttctggggtgccctctctcggcacccacaccttggctactgtcactggaaacggggaacgcacactgcggtctgtcaccctcaccaacaccagcatgagcacgacttctggggaagcaggcagccctgcagcggccatgcaccaagaaacagagggtgcctctctgcacgtaaacgtgacggacgacatgggcctggtctcacggtcactggccgcctccagtgcactcggaggtggggtgtcttccacagtctcttttaacacatcccttcagctcatctattaatttactcaccgtcctgggatgattcagttagctgtcaagccagaaagtgccttacaagctctttatggagagaactttctagattctcccacctcaggaaggtgaatacccctccccagttcccacccccagccctccacacacactcacctaaggaatttgggatagtgtttgctgggagacttaaaataagagaccaaccacttgtggctaaggtcaatctcctgggaaagaaatatctcattctatagaatggaaagttgggaagattttccttttttcatttaggcataacagttattctatttggggtcttaagagcttttcagataccagtttgcttttatcgaaaaaggcatgtggaggaaatttgcaactcctctccatttttagacccttagtccccacttctcttttgttaccatttccactgccgctaccactgcttctctcaggaggtcagtctgctcagaggagacactgaccactcctgcctgcccacaatgtctttattcagagtgctcacccttgaaaaccacctctccaaagcaagtgtttcacccacttgaattcattgagtttcatgacactgaaagtctgtttgatagtgcatatttcagagttttgttgttcttttatttgacctaactttggcttttccgtttacagtcgctgggattagctacggtcaagtgcgtggcacagctattgaacaaaggacttccagcgaccacacagaccacacctacctgtcatctactttcaccaaaggagaacgggcgttactgtccattacagataacagttcatcctcagacattgtggagagctcaacttcttatattaaaatctcaaactcttcacattcagagtattcctccttttttcatgctcagactgagagaagtaacatctcatcctatgacggggaatatgctcagccttctactgagtcgccagttctgcatacatccaaccttccgtcctacacacccaccattaatatgccgaacacttcggttgttctggacactgatgctgagtttgttagtgactcctcctcctcctcttcctcctcctcctcttcttcttcttcagggcctcctttgcctctgccctctgtgtcacaatcccaccatttattttcatcaattttaccatcaaccagggcctctgtgcatctactaaagtctacctctgatgcatccacaccatggtcttcctcaccatcacctttaccagtatccttaacgacatctacatctgccccactttctgtctcacaaacaaccttgccacagtcatcttctacccctgtcctgcccagggcaagggagactcctgtgacttcatttcagacatcaacaatgacatcattcatgacaatgctccatagtagtcaaactgcagaccttaagagccagagcaccccacaccaagagaaagtcattacagaatcaaagtcaccaagcctggtgtctctgcccacagagtccaccaaagctgtaacaacaaactctcctttgcctccatccttaacagagtcctccacagagcaaacccttccagccacaagcaccaacttagcacaaatgtctccaactttcacaactaccattctgaagacctctcagcctcttatgaccactcctggcaccctgtcaagcacagcatctctggtcactggccctatagccgtacagactacagctggaaaacagctctcgctgacccatcctgaaatactagttcctcaaatctcaacagaaggtggcatcagcacagaaaggaaccgagtgattgtggatgctaccactggattgatccctttgaccagtgtacccacatcagcaaaagaaatgaccacaaagcttggcgttacagcagagtacagcccagcttcacgttccctcggaacatctccttctccccaaaccacagttgtttccacggctgaagacttggctcccaaatctgccacctttgctgttcagagcagcacacagtcaccaacaacagtgtcctcttcagcctcaggtaaaacacagtcacacaagcacatgttaactgcaaggcccagtccagcactgagagctacatggggctcggggttcatgtgaatttgtagaaatggctggcatttgaaatagcttctgttttgcgacctaaaatgcttcctattgaaacacttaaagtgtaaaagaaggtcatgggtgggcctaattttctcacccctgtgttgtataatgcttcctgaataaagaggaaaggatgcattggccatgtgtcacattagtagatggtacaattgcagcttttagtgccctgtagttgtaagagcttttcaagcatgccgttaactcctcagaggtcagaggagggcagtgatgcaggattgtagggtggagaaactcaagtaaagaagcttaggaggcctggctgacacagggatcaactgggtatctgcgtctggatcagatcccagagtctctgagtcaggggctccccagtcaccagggagcttcttggcgtcactgggcttctcttgatccagggaagcccaagctcctttgtctccgaaagagtgtgtggctagttgataaatgggagtggggagacatgtaaatgaaaagatggtgaactaaccttttcccacagtgaccgcacggccagagctcctttacatcacacttagggttgtttttgtagccacgttgaagttgctggtaccaggaaagtaaagccagccaaatgatcctttgtcatttaaggaacggtagaaggaagtaggatgatgcagcttttcatgtcatgttcaaagttacacttctggcttgtccagacatgggaaaggaaaactgctgttggaggagtgaaatggaaactggcgtcttagggaagaaggaaagaagagatgatgctttgtagtggctggagcagaaagctcagggagcagcacagttccaacctgtcagccacaatcaacctgggctggaggctcataagcaaaccacccccatgccaagccccacagtgcccctttgtatcagtgatctgagcacctctgggaaatgaaaggtggctgtttctccagggaagtttgggagccttgcttcaaggcctatagccttcagtttcagaggccacatatattccagtgccagatgaaatctaattcacaagtctcccttaaagccattagccattctgatgataactgtaggcaagtattaggggcagattcactggctgttactatattttttgtgccagtgttcatgggttagtgtttggctatataagtgctgtgcttctatgggtgattttagataacacttgacatggcaatacaggataggaacaccatctttaggtttagctcatttgttttcagggttactattttttttttttgagtgaagacttgacttttaccttctttttttcattccaccactgatttcctttttgcagacaatgcagttatgttgtaggcttcggcttctctaagtatgtcagaaacctgtatgaagcatattacatagctgctcaactctgatcattttctaaatatggcacaatatgtggaggctgagttacatttggagattttggagtaaaggatactatgattttgataaagaaagcccaagagaaagggcagggcacgtgtgcacagacacacagacacacgtatacagagtaaatcttctagcgggggaatgagttgatcagagatccttttcccccctaaagtgtgctttcaattggcattgattcaagtagaattttcttaagtgtcacaaaggcaatataatcatcaatcctgaatggagtgacctgtaagcagcatttgattacaatcagttcttgcattcagggatcccattgtctgacacttagatctggacacaagctagtaccaggacccagtcccaatgcacctctgggaaacccattttacttttgtaatgtggcctttcagggcaagtaaacagaaataagcaagaatcaaatattagctgggagaattaaatatttacctaaagctgcctttacatttcctgtgtggttaactgctttactcctggaatgtgtttgtagtcaacagctgtgctgtgaacccttgtcttcacaatggcgaatgcgtcgcagacaacaccagccgtggctaccactgcaggtgcccgccttcctggcaaggggatgattgcagtgtgggtaagagaaaaagtaacgcccagtggtctgcaccacagtaccacgttgggctacccaataaactcctttttcctccaaaatgtggacaaatacactgttttagttaataccctgcttacttgagagtcagcatgtttgtaggttgtgatctgcaggagaatgtcaggaactgtagtgtggcactgccagacttcctgatctgtgtctgttcccaacactcctgccacactgtaccctattcctgcccctggactttactgtgctgatgcctcaggctggaatccccccactgccaccctaatctattgattaaagtccttccagttgtagtccagatgttatgtgaaacagtctttaattctcccctccattaaaatttgctgtttcccccgtatatgcaaatcttgtcttgtatttacagttagttgtttatgtggccacctccaccctcaatagatggcaagccccttgagggcaagagtgttctcatacttatcctttggggtctcaccacacctagcaccatttggcccttagtaagtacttactacactgggttatggttttgctgtttgctacagatgcaagatgttcttcttttttctcctctacagatgtgaatgagtgcctgtcgaacccctgcccatccacagccatgtgcaacaatactcagggatcctttatctgcaaatgcccggttgggtaccagttggaaaaagggatatgcaatttgggtaagagacttagtctatttcggactttattccgtaccacaatatattttacaaggtaacatttgttatttttcttgctaaccaaaatcagtatttgtccaaggtataaacttaaggaatatagaaaaaagtggaagctattgtccattattctaatacttggagatagaacaccctactttgcattatgtttttgatgtgcagtatatttttacatagttgaaatcataggatatctgtataaactttatatcttaaacattttcctgtgttgttaaaaacattgtacaaacatcttaatgacggcatattatgccatcatttgtgtataatattatttgcttaaccactccaccctggagctaggaaaaaaaaagtcaaaaggattattctgaccacataataaaaaaaaaaaaaacaatttagatggagaaaagagagagtaaaactctgattgtcctaccacattcacacattctttcagtttttaaaaatgaccttcatgctcttgctcataggcagatacattttgagaaagctgctgtcctaactgtatcacacaatttgtcatattttgttcactaatttgatagattcatgatgaagctgtttgattttgaaaataatctccattttacaagttaaaaagcaagcaaacaaaccaaacgaaaaccaaggccttcacaaggtgctaagtggccaagcttacgtaacgggttggtgggaagcctggttcccagcccacagctctttctattacatgataatgtgttaactttaggagctttcttgcttgcagggtgtgacccttgttagaatgtcaagtttaatacataacttgttgaagaagttagaaatgaaagatacagagttttttgtttttgtgttttttgttttttgttttttttgagacggagtctcactctgttgcccaggctgtggtgcagtggcaccatctcagctctctgcgacctccaccttccaggttcaagcgattttcatgcctcagcctccaaatagctgggattacaggcatgcaccaccatgcccagctgatttttgtatttttagtatagaaggggctttgccatgttggccatgctctcgaactcctgacctcaagtgatctgcctgccttggcctcccaacgtgctgggattacaggtgtgagctactgtgcctggccagatacagagtttctaagctaagtaaggaaactggcagataaaataactcatctttcagtcatcttaaattgcccagtgtgacacttaacacacaaaaagtgctcagtgtttttgagagagcaaatgtctgtatcctttgaaagtgctattacctgtgggctgaagagaatttttaagaagtaccctaccaaaataatggtagaattttgaaaattgtttaaaatacaaagatcaagtcaaaacattgtttcaaaaagaaggatctagaaatagagacatcagtcaaaatcaagaatttctctcattctggcctggtgtagtggcttatgcctgtaatcccaacactttggcaggctgaggcgggctgatcacttgagatcaggaattcaagaccagcctggtccacatggtcaaaccctgactctactaaaattacacaaattagccaggcatggtggcacacacctgtggtcctagctatttgggaggccaaggcatgagaattgcttgaacccggcagctggaggttgtggtgagtcgagattgtatcactacattccagcctgggctgcacagtgagactctgtctcaaaaaaaaaaaaaagaatttcttttattctaataatttacttgcattttagtaaactatttagccacgcactaagatattgccaggagttttcagtttaagaatagagaagctggaaatgattttatttttaaggattgtggggaaagtgtatttgcccaggactcaaatgatttgcttctagctccagggccaccacctatagcacatggcttctgagccctatatttcctcatctgtaaaatcagattaccatctgtcctgcttcccactcaagattattgtgaagatcaagtaaagtaatatatttgagcaagctttgaaaatggtaaagagctgtccagatgggaggtaccatttaactttagtcttcaaactcttggaccagaattgaaagcattgaaaacaataaactgtgctgaatacaaagtaataattatggctctttcccaaaaaaatcatttagataacatagggaaatcaacatttaaattggaagtaaaacttctacttaaagccaggtgctgtaactgcaggcgtaaaggtgtaagtgtctttaaaaaaaaacaacaaaaaactctgcctggagtgagtgcagggtttggaatgaaactgatatatctttatattcacaccaaaagcagatgccacgtttactgtcctgactcagaatagatctacgtacctgacatttgcgatgtgaatttcttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgcgatgtgaatttctatacagagagtctgggtatcagcctagacacgtgagatgagaaagtgaagaagcaggaccattgttctggaagcctgcgtgcagagggttccacaggtagcacagctcaggaggagagcagcactatcgccttcacaatcatctttcccttttcaagtcatttagcttcattgttcataaacatcagaggaacatgcaaattagagcatgctgaaatgctttcatttggccaagaatgttttcagagagctccctgctgctcagaaagagtcctaagcagctggcttcactgaactgtagaacaagcaaaaagatgttaagtaaggattaagcgctttagacagtaagtgtaagatgttaaatgttttccctggctcatttgtgggtctttttctcaattcggcatgcaggctttcggggaaagagcagcttcatggacttctgtgtcttgagttatttgttttccatccggagggaaagataagcatttaatataaaggaagataagagccagcaataaaacacaccatactaaattttggttgcctgcccatttgtaagtcccgttcccctcaggctcaatcagcacaaattgatgttaactggaattttattttatgagtgaaatgggccttgaaaatgaggctgctttttttcatttccgaacccaacagtgtcttgaatatgggctgttttcattatgtggcttataatcatggagtcggcagccccatggagtatagccccacgacacatgcttggcacctttctttctctcaagtcccttgggtgtccttaggatatcagattcctcagggcacagaggttataggggaaaggagagctttgaagatggacacgcatacgctccaatgccagtggtggcccttgggagcctgggtgagctttcttaggaagttgcctgacctctggaagccccctttatcaatgataaaatgggaatttcctctgaccaagaggaatggggtttggatgggtgtggctctaaggacaagaggaaactgaagcacccccttgaagtggtgggcatgactcagttggagacctcagaggacgagagctttcctctgtcgaaagcctgatgaggcctgaggagcatttttagtgtctaacacatctccctccctcctcctaggatgacattgtttagacctgttcatctttcttctttgtagcagctttcttgggcatctattgtgcgggaggccatcctagggacattgctaaggctcctcctcttagcagccttgcacatacaaaaaaggctctttggagtttctctctctctcaaaagtttgctcaatctaagccttcagcacagtccagtagatgctcactttgctagagaaaaatctagaagagggagagggagtcttcacccataaggagaaagaaatgcagagattgtcctgtgaggtggagtaaagccggacaccccagagatgtgcaaacacacagccttgcataggttcttctgttgtgtaatctaacaagttacattttcattttcagttagaaccttcgtgacagagtttaaattaaagagaacttttcttaatacaactgtggaaaaacattcagacctacaagaagttgaaaatgagatcaccaaaacggtaagtgtcctgaatggcatctttctactcgtcttttgtttcctagaacagattttattccaagaggggactgcctagcggtcagctgtgtctcctgggctcttcacttttgttatatttggaagggaaacttcttggttaaagaaaaagcctttcagaaatggaagtgaggtatttgtgcccagtagaagagtttcttcaaatgtgtcctcatgcacagtctttatctgcacctttgtgtttcttttccatgtgcaaactcatagttacagacatgctgatgacaggcatcagcaggagctgttggtgaggaggaaagacccagaaaaatcttacggtcccatctgctgttaacaggctgtgtgactttcctcttgtattttggaacttagggaaatgatactctttttcctcaaaggaatgccaaaggtgcagcagttaatcctgatgtcctagggtttgagaactcactgtatagatgaccgaggggtctttgattctgcttctttccctctttgcccgctttttatcagaatttttttttttttaaagaaaaatgccatcctgggcagcatggcaagaccctgtctctacaaaaaagacaaaagttagctagggttggtggcgtgcacgtgtggtcccagctactcaggaggctgaggtgggaagattacatgagccccagaggttgaggctgtggtgagccgtgatcgaacaactgcactccagcctgggtgacagagtgagaccctgtctcaaaaacaaaagaaaccccccaaaacagaaacaactaaaaaggaaaatggagaggaagaaagaagacaggaaaatgaagctcatataataaactttgcttctcaactgctatctgagtcagagatttgactcatctatacagtgagttcttaaactctaggttcagaaaattgaaatttgccattaaaaaactttagagatgaattgatttccaatctcaatgttacttgttctttgtggataagagttagtatattagctaggaattatacatttctacaggactttggactttatctgtgtaaaatacggatctagttctatttctctatctcctgagcattcacttcatgatagggacgatgtcagatggcgcactcctgtaacaggcattgccagcacatctgcagatagaaccccgggaggtctggaagtgaatgacattgcctgagtccacgcagagcaggtgcaaagttggggaacagtccactaaaccaccatcactactgataccaatttcaagttcaggcatccccaagatcgccctcagtttcaataattcactagaggagtcacagagcttactaaaagcgattatattaacagctacggtttattacagtgaaagtcaacagcttaaaatcagccaaggaaagagatgcacggggcagagagtccgggagagttccaaaggcagagcttccagctgtcgtcccgctgaggagtcatgcacagtgttaactcctcctggcaacagtgtgtccagtatgcagggagtactgccaaccacggaagctctccagagccttgactggggctttgtcatgtggctgacctcaatctccagcccctctagaggttgagctgataccatgttacccaaccccaccataaatcacattgttggactctctggcatggcccagcacccccaggtaaacaaagaagtttttattagacagcacattccaagggcttagagatggcctcccaggatccaagagcaaaggcctgacttccctggggccaaggttaaattctttactacacagcagaattttatgtctactaatcctatacttgtcccttcgccacagctgcctgttggtcgtgctgcaggtggatatctcctgctaagataatacagggatttagaaccctttgcagaagtgcagtcctttgcattacgtggcgctcagtgacttatttgacttgctattttttgcccagtatcaatgtataatttactggtgatgtaacatacctgtccccaagaaagagtgaagattaatccatcattggctgaggaagccactcaaatgttctttcccgaggtgttctgtttaccaaacctggaaaaacaggttaataataaaacaacaataataaatcattgctattaggctatacactgatgtcatagaaagggtttgataatgtcccatgtttgcctccatcttctgcagagtggcatgtatctgatacatgggccttgaacacaggtggatctgcactgggcccagtactgagaccctccactccgggaaaggagtctcgatagctcctattgtgcagggtagcagggaagcaggcctgatatttcatgctgtagagggattttctgccgtctccaagggcacaaggcaaacatagggagagtagctcttaatttgctctcaacaaaggggctcttgacccacataatgtaatttctcacggagagcctttttgaagaagacctgtctttgagttaggtcaactcattgtagattatgaggcgtctatgtagggcctgtcagacctagagtagctgaaaggagcctttccagtgcagctcgttcactatgcagagtccaaataaacagttgcctctgagttgtttgaaaccctgggccttaaaagagagctgcttctttgaagatgttttgcatccaagggtgctattctgaacatcatttcctgccaagattttccccactgatttactctctgcctctttctctttgtactcatggaacaacagaaaggcatttaagaggggaacaaaaaaaggacaccacttctgtgcaaagccgcgtgctgataacttgatggctggaaaatgcctgttttatcctgaaaataggaaactggttctaggtccaaggcttttgtctaactcactgttaacgacaggcttgttcttcctttcagttaaatatgtgtttttcagcgttacctagttacatccgatctacagttcacgcctctaggtaagtaacagaattatatttgcttgtgaactagtctgtacaaaggggaggctgttctaacatgggtgatagcaacaaaaccgggctgttttcacccagccatggggcaatccagggccaaggtcactgaccttcatgctctcccatcccgtcactggtgaatggcgatgacattcatttccaaaagccttgggacccacgtgtcatttcagggctgttaaaaacccacaaactttgcctatagggagtccaacgcggtggtgatctcactgcaaacaaccttttccctggcctccaatgtgacgctatttgacctggctgataggatgcagaaatgtgtcaactcctgcaagtcctctgctgaggtctgccagctcttgggatctcagaggcggatctttagaggtaagagggcagccctctgggaggatcctacccatatagttaggcacagacctaagatggaaatgcaaggcatccagggctcaggcccaggaaaggccctcacagagcctatttttggcatgggtgttaagtcaaagacctttgtgcacatgcatcttcttttatgtgtgcatgcatgtacaaacatgcacacacacacccagagtcctgtacacaagccttgaagacacctggtccttggcatgcagctccttctgtttattttatccagtgttgatgtgggagggggaggggcataggagctgatgtgacaaagcagaaatcactctttttccactgaaaagttcctgctctctttggggaaacagaatgtacatgcttgtcaatgacccaaaaaaaccttcatctggccagaggcagtggctcacacctgtaatcccagtactatgggaggctgaggtacccttaagcccaggagttcgaggctgcaatgagctatgattgcaccactgcaccccagcctgggccacagagtgagaccctgcctcaaaaaacagaataaacaaccaccaccaaaaccttcatcatgatacattattaggttaaaaaaaaaaaaagcatgtgcagtattacccatcctttgtgtttgtttgtttgcacattataaatgcacagaaacaaaaccagaagaatggaggccagaatgcccacagtggcgccataaacaattattttccttttctcattcttgctttgtctgttttgtcaaaagcttctatagtgcctctggtgtgaggcaaatgaagaaagggattggagacaagttcaaaagggaagttttggtcttagaggagaagtttcacctccaggacaggaaaactcaactggaatctaaagtacttctttgcaaagggggcttgtccctgttgccacgtgctacatgatcaaagttagctcattttactacacaagtagggctggcaaaggatggagaatctagtctaaaccacccatctggcatccagacgctggacatgagtagaagatatcaggttgtaacagtctgctggtagatccatgacattgacattcccagtgggcctgggttccataacttccagtcaagagagctttctggagtgggcctgtatattacagagcttgggagccagattgttagcccttcattctgggataagagctggagcttggcccatttaaggctagttattaatctgagaaaaaaaaaaaaagctaaactttctgaagttgaagttactattgatgggggagtgaggtagaaaggtcatgccccattatatcatgctcgaaactttgagactctatggttttacttttttgtttctcttgacaaggattcaagggtaccaagttgtcctccccagtgaggtaggaaagtcacctttcagttcactaaatatttatggaatacattctatgtgatcaacattgcaccaggttactttttgtttcccataaatgcattcaaatcaagtgccttgcaaatcaagtgccagccatttggatttgaaagagcctgctcatggcagccctacccaccctctgactcccattcttccgactgcttgtatatggtttatgggaaagtacctctcacccttgctgccttgctgaagttcctatttacttctcctttcagagcccgtgagaacaaagacagctatgcatattagctgaaaaaaacaggcttgtttccctgtttttcctcccaggtcttctccaggttttgccaagaccagcctggtctcatgctaacctttctgagtactagagaggtggccttgacagcttctgacatctgggtgtttccagcataagggcagtgctgggctactctggacactgccattggaaaggagggttttctgtcttcacttcataaaatatccacttccttgcctttcaaagaactgcagctcttgtcatctccagaggtttagtctttggaaatcccccatggaatgtctcagctttagatttacttagagtctcattgtctgttttggcggatgttatgcccaggaaagaccatgggaattgtgaatgtagcaaaatcacattgccaggctttatatgaaaatgggattctacgtggtcctattggatgaatttatggtagaatattctttgagaatttgtagggtagcaactcctccactgcagaggcagggcctgtgtcccatgcttttgcatggatctgcttctgtgcagggcacagttgctccagcagagtgatttgccagcaggctggattaatgggcagggtggaaggaaaacgtgacattggcttccagaaaatatctaatcaggccaggcaactctggctggctgctggacaaggcaagtgtcagcctggacaggtttctgccctggaggaatttctttatattaaggcttgaggactggcaaagccttcaaagagttgagatgagggattgtggaagttcattacctccctggtgccagctttgcagtgtttgcctggtgagattttccatttttaatttttctcccttaaatacaaactttttacaataaacaaaggaaattctgtcacacacacaaatgtggttctgattgagcacgctagcttccactgataaaggcaggaaattcagctttgagaactagagttgtgtcctaagcttacctcgtgtgaccaggctgtctaccggtcctgagttctcaggactcacaaaagggggcagatttcaggaaccccatgtggggtggcagctcatgtcaccaaaacctgcctgggcaggggcagttttgcagcattaaaaggggtacctggcttctgaataggttggcttcctcctttgggtgggaaatgggagaccatgcctggaaaattggcagccattcctccctgcacaatagatacatggcccttccccttgcatctttcttcccattctgaacttgagcttgccccccaataacaacagcaaatatctagcttgccttgccctgcacatgggtgtaaataaggtactatccactatccagttggtttcctatttttgttctgttctctgtgtaccccatatacacaggaggcctatgcaccctcattgtgtctgctgtacacaacttcacagagggccatatgccccacaggaaatgctttctgataataatgaaatgattctttgtcatccatgagatgaataaggccctaaagtaaacaaggtagcaagcctgaaagatgggctccttctctgcctgcctctgtttctctctgcctggtcagtgacaggcggccatgtgtaccaaccagtccctgtgccaggcactgaagacccagagatgaagaagcctcaagaacccatcagtggagtgggggaaactgcctgataagcagaattacactacagcccggggcaagcagattgtctttcagatctctcctcatcaccagtctcttgtaggcagcacgctgtcaggacagcaagccaccttgccacagggagtggttctaggtccctttttaggccatgcagacacacagagctgagatgtacttccacttgaaacaggtctggcctgcactcctgttcttagtccaagtctcggcttcctaagaactcagccgtattttctggttgtgctgatccttcctccgcagtcctttggaagacacggggccattaagggctgtatttgcagtgagcaccagaggagtgaacagggcctgtttattccaatttcgtttctcagtgggtccgtggcacgctgtgagggtgttttcaacggggaacactggtgcacagcctgcggctgatcagagaaggagtggcagaaggcagtacagatggactcctgagaggagtgttgctctgtggagacttttcggaaaactgttctcagcctcttgaaatagagagttcatgcagacacatgagctttgaagtggaggagattttaaggtttgaagtggagaaggttttgttttgtttcactgtcttgtttttccattccagcgggcagcttgtgcaagcggaagagtcccgaatgtgacaaagacacctccatctgcactgacctggacggcgttgccctgtgccagtgcaagtcgggatactttcagttcaacaagatggaccactcctgccgaggtagccacagcttcgcctggggttctgtgcccagtcctgggactctgcctggtgctctgtttctctttcttgctctctctctgtctttgcttaggcgtgaccattctaaactgagggtaactggttcttgttattttgctcgtggcaggattgaatacattatctccttggaataatagcattatctttgactggtgcatgctggtctggccaattaaattcaaaggaagacagaatggaatgcctgtggtagcagtgccttttctttttttttccatttaaaggaagttagaaaaattattgttttaattcccaaagctttatctgttgtctgctaatcttttaaagtggaagtacaagcgtggggtcaggcttatatctttcagaggcagctgaggccagagtcagagcccgactctgcctcactgatcatgtatcaccttgggcaagtcactttgtttctctgagcctcggtttcctctcctgagaaatgggtatggtgatcctctattggatatttattctaagagttaaggaaggcagtggatatagaggccctttgtaagctgtcagcatctgctcttgtatttggtccaggttgttgttgaattaatgagttctggttttaaaggtctcatgaagtgcttgagagcagaaatctaattctactaacctttaaggtgaggcttaaattcatttagtttcagggaaaaactgctcaaagaatgtagtccaagaatactgctttaaaataaaattaattcaggtccaagagcaccacgcaccctgacttataaaaggctgctgcaacttgcaatcaccagaaaaactaacgatataaaggccatcatggatggccagttttcctactcagtcaacaccttgctggtgacagatgtcaatggatgttactggaatctgaataaaaatcacatactggggcgaggcgacatgccacttttctccatcaggacttcccatgagaggacttgttcatcacagataaaaatatatttcagggcagcactcttatcctgagcttcagaccctctgactttgttaggtttggatacaaagttcttctcaagtgcgcatcatcagctctccaggtgggacctgtgatgggttttgaaggggagggccaactctctgtgttgggcctaggtcctgatgtgtgactaggacacagcatgtctcagtgccgtgccagactgccacattgctacaaagagatgatgcttcctcatgccatcttatctgctttaatgcaaagtgttccttgcacctcttagaaatggggagttgagccgggcgtggtgactcacgcctataatttcagcactttgggaggccgaggcgggcagatcacctgagatcgggagttggagaccagcctgaccaacacagagaaaccccgtctctactaaaaatacaaaattagctgggtgtgatgacgcatgcctgtaatcccagctactcgggaagctgaggcaggagaatcgcttgaacccggggagtggaggttgcagtgagccgaaatcacaccattgcaccactgcagcctgggcaacatctgtctcaaaaaaaaaaaagaaaacaaatgaggagttgagcccatcttcacatgggaaggggactgggctaacatccatgtgtgttggggcgctgtgctgctgacaggggatgacacaaggtgggcagaggtatgggcatggtgctgtggtgttccctgtgaacagtgtctcaacaatggccctatcacctttgcttctggctggcctgcgccacttcctctgtttccaagtcagcaattttgtaattgtttcagttacaggctagcattaacaatagctgtgaaagatttaccgagtgtgctgacacaggcaccagcaaccttatgttgaccaagtgaggacccaagaagcagcataaggaaaccttgattcacttttgggcttgttgctgagaccccgtgaagccctttctcagcagtatttgcaccatcaggcctctgaggagtggattccgggcttcttgggccacagccctttaggctgggttctgatgggttagcagtgacatcttctggccatcagtgctggagcactgacacctcaaatcaaggctcaatataaatagaggatagaggagtgtgtgttttctaaatcactgcagttcaagctatacattagcaagtctctatgttctctgcagcgtgtgcgtgcacacacacacatgcacacacaacgtgcttggtgtctcacagaaaatgtctttgccagactttcaaagctacacataaaatcaaagtagatatccctctcataggtttcttagcttccttccatcatgcaggcatcatgattaattcttttttttttttctttttagagacaaagccttgctctgtcactcaggctggagtgcagtggcgcaatcaagtctcactgcagccttgacctcctgggctcaagtgatcctcccacctcagcctcccaagtagctgggactacaggtccttgccactatgtccagctaatttttgtattctttgtagagatgggcttttgccatgttgccgagtctggtctcaaacacctaggctcaagcaatccacccacttcggcctcccaaagtgctaggattacaggcatgagccaccacacctggcaatgaattctcacaacctgtttgcatgtctctttctttaatccgactgccattcccttgagtgctagaaccatgtcctgagcagtgcagggttcagcaaatgtctgttgaatgaacgagtggatgataaggcagcaaataagatgggaaaagattgacatggctagatataatttcctgcaagggaacaaaagagtttttaagatgccactgtcagctgggcacagtggctcacgcctataatcccagcactttgggaggctgaggcgggaggatcatgaggtcaggagttcgaggccagcctggccaatatggtgaaaccctgtctgtactaaaaatacaaaaattagctgggcgtggtggtgcatgcctgtagtcccagctactcaggaggctgaggcagaagaatcgcttgaacccaggaggcggaggttgcagtgagctgagatcccgccactgcactccagcctgggtgacagagcaagactccgtctccaaaaaaaaaaaaaaagatgccaccatctacttatttctatttttaagtccagaagacttgaattcacttgtgtcttatggcaataggggaagcccagtttgggaatatatactagctgttgccaaattcatttcatcttcagtgctctgtggtcagaatacctctggggcaggggtccccaaccctaccagtttgtggtctgttaggaaccgggctgcacagcaggaggtgcagttaggaactgggctgcacagctgagttccgcctcctgtcacatcagcggcagcattagattctcataggagtgtggaccctgttgtgaactgcacatgtgagggatctaggttacgtggtccttaggagaatctaatgcctgatgatctgaggtggaacagcttcattccgagaccatcttcccaagaccacccccttgctggtccatggaaaaaatgtcttccatgaaaccagtcactggtgccaaaaacgtggggactgctgctctagggtgagtgagatgagaagctgggtcctaaggagcacaggagcacctcactgacaaggtttccccagaacagcgccacggcacagtagcactcaaccactgatgcgtaacggaatgagcccatttgaaatagagaaatatcatgacatcagggagccaggtcacttctgatacaaaatgaaaacagcccaacccatcagctcgcgggcaggacaacagatggaccttacatctgcctggatgacagccatggagtggagcacttccacccagcagatgaagtctaatgttgggtggggagattggatgtaaaaacatttccaggaagaagtgttcaaaatagaaaaggctggtgtgacatcagcctgcctcagtgccgagatgggtggggaggagtcactgaagaagcaagcaatttccggtggctgccccgcagcgttagccatccatggatcatccagggtagcttcccccactcccacgtcctgctgcagtatgaagcagaggcatacacaggaggagggccaccagacatgggagaggcaggagcactcagctgcctccttagagaaggccccacctgagtgaggccagcagagaactcaggtatcaaagattgggagatggggcctcgttactccttccctaaacaggatgcaattatgctctacctgtggcataaagtgaaagcacctagtgaaaactgatttgataatataagatttaaaaatatgtaaaaggtaaatcaggttaaaggggaaattaacggactgttttgttgaggccagaaggaaagtgaatatgcagaatgagacacagcagggtcctgcacgcttgctaaaagaaggcccctcacttaagtgctgaggttcccggacactgaggcaaaaagggaaacatgactttgaaaagagtcagggtccctaaaataaagagcagctgttcaggagcatccctgtgttttaaaacaatggggccaagagcaatttctctggggcatcctcgtcaagaggttactgagtggtattgtagcaaagcagtccatgacatccccaaataaataccacagggactttcccatggctgccgcttataacaaaaagcccttaatacaagagaatgtagctcaggaaaagtgatactgtggggtcaaaacagtgctgtccaggtgcacagctctctaatatctgctgtgagacacattacagatgatttagaacagtgtttttgaaactgtattccacaacactctagtgatatgttaatagaaagtctgtaacaataaagcacatgccagaggcattcagctgctaacattaagaaagtaggaggaagaagattcaacacatcgtcatgaggaaagttatcacacacaaggacgctggacccagcccacagggcatcactcgccagccccctgcccctcctcacccccagccatgcatgctactggcccccataacccaccattagcacgtctgccatcccatcaagtattgcagctctacactctgtaccttttcttattcgggatcttttatgcaatgtatctcgtacattaaccctgtatcacatttttatcattccttgcagcagagaatttgtctgtgaggccatttttcattgctttcattcaagcatgcattatagctcatggtgttctgtcatcttattgttgtgttgaaaatgttctgtgatcacataaattcaggaactgctgatccagggaaatggccaggctgcaactgcttcagtgaagtagcgttccatgagctgcaccacccgagggttcaaagttctgttcttgggcaaggtgccgattagcacacatctagatatgtccgaaatcccctacacagactctagggtgagcattctgttacgaaaacctgggtacacaccaggactgtgccccagaagatgtcacctacagctcccccccttctcatggaagggtgtcagcagggccattatcaggttaaaggtttgatttacattaaagaaggggagccatatgtctttgtgatggaaggagtttccccaggggacattcttcatctatagagaacttctaaatgaattgcattggtcatataataattacaactacatgcctgacatggtggttcacgcctttaatcctagtactttgggaggccgaggagggcggatcatctgaggtcaggagtttgagcagcctggccaacatggtgaaacctcatctctactaaaaatacaaaaattagccaggctttgtggcgggcccctgtaatcccagctacttgggaggctgaggccggagaatcgtttgaacctgggaggtcgaggttgcagtgagccaagatagtgccactgcactctagcctgggcaacaaagctactcatctcaaaaagtaataataattacaactacaaaaccctgatttagtggttactatgtaccagacctgtactaagccattggattgccttatttcacttaatcacctccaataaaatactttttatagctgggagattgagagccacaaagaggttaagaaaagttttttgataaggttaagatttgaggctaggcatggcgaatcatgcctgtaatcccagcactttgggaggcagaggcgggcagatcactttgaactcaggagttcgagacaagcctgagcaacagggtgaaaccccatctctactaaaaatataaaaatttgctgggcatggtggcacatgcctgtaatcccagctacttgggaggctgaggctggagaatcacttgaacccaggaggtggaggttgcagtgagccaagatggcaccactgcactccagcctgggtgacagagcgagactctatctcagaaaaaaaaaaaaaaagagttgtgccggcaacagtatttaagtgaggatcattccaaagcagtttgcagccttctggtactagaataatcttgtggactttagggtggctggcgtttaattaactgggagtttgggagaggtaaatagacacactcatgcattttccttttgtctttcagcatgtgaagatggatataggcttgaaaatgaaacctgcatgaggtaggctccatgttgatttagtctaattttgttacaaatcttatttagataaattgcctcacttatttcttttgagattggaaactaattcttgcccttttttctttcttggcttgcagttgcccatttggccttggtggtctcaactgtggaaaccgtaagtgtacaaaagtggaccattatgcgtgggcaggggcctggccctgttgttagtgcacaggtgtcagtctcctcccacttccctcagttcacacctgctgtcttcttaggttctatgccaatggcatgggggaaacaaagagaaaggccagacgtggtggctcacgcctgtaatcccagcactttggaagatggaggcaggaggatcacttgaggccaggagttagagaccattctggccaacatggtgaaagcccgtctctagtaaaaatacaaaaattagctgggtgtgatggcacatgcctgtaatcctagctacttgggaagctgaggtgagagaatcgcttgaacctgggaggcggaggttgcagtgagccaagatcacgccactgcacttcagcctgggttacagagcgacacttcgttttaaaaaaaaaaaaaaacccaaaaaacaacaacaaaaaaaacaaagagaaagacttgactggtactgttcaggggctcaaggtctgggctgggcagggagagaaacactcactcctaaatacccctgctgtgtgctgagtgttactgtgataaccagacatggggtgtgggacggggaggcagggactgtgcccacagaagaatgagaggacactcgacagtacttcttggagggagtggaattagaggaacagtaggaaagatttagactggcgggtatggggggaggacatcccaggcagagggagcaacttagacaaaggtcttcaggcagccatgggcccttggtgttctggggacagtgtgtaagtggatgtggctggaagataggaagatcggaaggcagaaagtagaggatttggattggcaaagtatatgaggtctgaactgttggggttgggatcaccaggctgaggagtgtagactctaatcaataactgtcaggcagctggcaaaagtcttagagcaggaaagcagtttgatcaaggaaagcaatttgggctgcattgagaacagactggacagaggagaatgtgggtgcagcttagatatttccagcatagtcccaccaggcatgctagagacacacttaggagtcctctctgctccaggtggaagtagagggtggaacgccaagcagccaagagtgttggtggggactgtgagcggggcgtgttttgcacctaatccagttcttggagaaaaccagttgtgattcatttaagattgcttgcactgacattttcttatattcatacattagaaattgaaattatctgcaaaattaaatttggggatatagcatatcataggatgtaatagaaatactaacaatgaagattttagtttaggacagctttggctctcatcctacagacaaatgtgccagtggactattttataagtttactagaaggaaagtagacatgattttatttaatgtgtgtaaaaaagcccccagtttctattccccagtggtataccttacatctgatttcttcagtggtgttttctttgttcgtaaaggttttctattagcaagtttcattattgactttctttgagcataactaaaaaataaaaataatgaaataaaaatcaaacacattcaatgctgaatataaaactgacataaaactctcttggtgcacccagcatggtgctactctcaggtcagagtctagagacttggaattacatatccatttaggattactgatgactttggtcatctgatttatcttgactgcagactagcaagaggttacagaagatagcctcagagaaagactagggaggcaattctaaaagcaattatatttatagtcatatgagtagagagggagggactcacagaattgatatttgtttttctgtgtttttgagatggagtcttgttctgtcgccaggctggagttcagtggcacgatctcggctcactgcaacctccgcctcctgggttcaagcgattttcttgcctcagtctcccaagtagctgggacaacaggtgtgcaccaccacacctagctaatttttgtatttttagtagagacggggttttaccatgttggccaggatggtcccgatctcttgaccttgtaatccgcccacctcggcctcccaaagtgctgggattccaggcgtgagccaccgtgcccggccgatgtttgttttttaagtagcaacctgcagccctgagtggtgtagtaaacaaccctgtactctttagaagtcccagaggacactgtggggccatagaaccatgtgagcacggcccttcactccaatggaccccagtcatcacgctctaaatggtgtttggtgcactcagtttaataaggcaaggaagttatcatattttaggcttttttatttaataaattaaagaatagtcaaaattctttttaggtgtcaatgctgaacagggtaggcttgagtattttggagatttggcttatgtaaaacagtctggatggcagtacatgtcctttctaaagatcagtatttaggcaagccagtttctcagctgggctcagggtctttatgcttttgtgtttaggaggatatctatgccttaaaggggctgcctggtctacagagtggtgtgtgttcactttttcgtgtgaatctcatttctcacttgaaaccagaacagagtcacagagagctcgtaaactgatcagagaatggagtagcctgtgcacaaaaatagataagaaaatctataacgtttcaatgtggaaaaaggaggctgaataatcagacagaaatttaagatatttgagtcttgtttcccaaatgctggaatactagaactacatggtatatatatatatatatatatatgtgtgtgtgtgtgtgtgtgtgtgtgtgtacacatatatagtctttcagaagagatgcttcaaggctaagagtagaggttacatcacaagcctgcggacctgatcctaagatattgttagaaacagagaggcttggccgggcgctgtggctcacgcctgtaatctcagcactttgggaggccgaggcgggcggatcacgaggtcaggagattgagaccgtcctggctaacacggtgaaaccctgtctctactaaaaatacaaaaaattagctgggcatggtggcgagcgcctgtagttccagctactcaggaggctgaggcagaatggcgtgaacctgggggggcggagcttgcagtgagccgggatagcgccattgcactctggcccgggcgacacagcgagactccgtctcaaaaaaaaaaaaaaaaagaaaaaaagaaacagagaggcttagcagcaggaggctcaaagtgcagcagacctgtatcacgtgtgcaagaaactcatctgaatgcaatcccacctgatggcagagaaagagagagccagtgagacaggtgagaggtgtggaggtgtggccaccctgttcacgtgtgcccctcgggtgagccagggagcaggaggtaagagatatgacctgctcagtcctcttggggcctctcatccctgacaggcctctcatagaatgagctagtactttaaacctgctttggtcagacagctccctagtttttattttttatttttagagatgaggtctctctctattgcccaggctggagtgcagtggcctgatcatggctcactgtagcctcaacctctcaggctcaagcaatcctcccacgttggtctcccaaagtgttaggattacaggcatgagctaccacacctgacccctaaataagttttattagaaaatgcttcatgtttctcagcgaatggaagagtgatccatctagggaacatgagtctataaagggctgcaggaaaggggtgtgagctgcagggcattattctaagtggcactggtaatttttttctcagagattattaagtactatacatgtttggggatgctgtttccctatgtcattgactattctgtaagttcttatgttaggaaaaagtcaagtcctctccattatttttgtggggttctggaagtagccaagatttctctctgattcctcagacttccttttccttcccatttgtccaagtcactgtcactgtgtccagcagagggcagaggcctgtctggatggtttgctcctggccaccttttagaaccggccgcctatctttagtttggtaacttttgttattctgtgatggcatgtaaatatcactttatcattttgatatctctattagtttcagtgttgcaagacagttaatattatagtggctgataataagtagcacttgccacctgcctctttctctgaggtctgggccaagacctgggtgttggttaaggagttgggaattcatccctctctatggtgatagcatattgggagtctgtgactcatcactcaacgttttgtgccaaatagcagggctctgactgcccaccgctattactcccattattgccacccaagacagcaggggccttcctggggctgtgactcaggctggatttttcgtaggcaagaaatgcttcttctctatgcaggctttttagggcacatgctctacccaagcccaatgaggctggggaggctggctttttccagccaagcacacatcatccaactccagtagattttggcattaggcataacctatgtcccacccctcaaaagtttctgtgcactttctacttgtgcccagatttcagtccttgctccttacagagaaactggaaagggcaaggcacagtggctcacgcctgtaatcccagcactttgggaggccgaggcaggagagtcacttgaggtcaggagttcgagaccagactggccaacctggtgaaacctcatctctactaaaaatacgaaaattagctgggcatggtggcacatgcctgtaatcccagctacgcgggaggctgaggcaggataatcgcttgaacctgggaggcagaggctacagtaagccgagatcgcactattgcactccagcctgggcgacagagcaagactgtctcaaaaaataaacgaataaatatctggaaagggcaggacaaacctttctctcaaatcttcaccccctgctggagcagggcccccactcctgggcagcgcaggcctgcacctttcttatcacagctctccttttaattttttaaacacgtaaaatatctctctgtttatatcccagattccaccaatttcaacagcaaatatcccatttgccagatggccccagaattcttttaggaatgtgtcatcagatgtgtctctcactccccttgcctccacccttttcttagggcgtgcacatttcctctgttgctggaagtttacgttggttcctcctcacagtttcataattgctaaacaactttgggttgtttagccttttttctatttttaaaataaattccttttttaaaaaataacaatatagcacatgcccattaatttcccctattttaacccaaattaattagaaaataaatagaagttaagggaagaggagagtaaacagtctcaccacccattaaacactatgttcaccatgtttccttactactaagtgtggggcataggccagcaggatccatgtcaccttggagcttattggaaatgagcaacttcgggctccccactccagacccactgaatccgaatctgaattctcaccaggcccataaatttagttaatatgcagatttatatgcatattaaagttagagaaacactggtattatatatttttccagagatatatatgtgtatgtctttttaacagaaattggatctcactgaacatactgttctgtaacctgcttttaaacctagtaaactgtggaatgttttcacttacgtaattttataatgttacgtttgatagtcctgtgaaattctgctctatggacctactgtaacttccttaaccattcccctcttactgcctttcaaaagtctctttttaaaatattcctgtcatctaagccattcttctgttttttgtttgtttttgttttgttttttggttgtttttttgttttttggttttttttgagacggagtttcactcttgttgcccaggctggagtgcagtagtgcgatcttggctcactgcaacctctgcctcccgggttcaagggattctcctacctcagcctcctgagtagctggaattacaggccccaccaccacacctgggtaactttttgtatttttagtagaggcaggttttcatcatgttggccaggctggtatcgaactcctgaactcaggtgatccacctgcctcagcctcccaaagcgctgggattacaggcatgagccaccgtgcctggccccatttttctgttttatggttattgtcattttgtgatcatagagctcacataattctcctagattacttttttctggccacagacatttttttccatccctctttcatatttgccacgtctcttttgtaggtcatcctttcattcaaagggtctgcacctcttcagaggagacccctgcctcacagcctcccagtgtagccagcagggagtgagagtctgccttccccactgacagccctcttcccgtgaagccagacattccgcttaaatatctttctacactgtcttcccagcccaacccacggtctgatggcaggtgtagaaggtgtctttcagttgtgttcacccagttgttgccttgggttataaaagacttagaccaatggaaatgctgtgtgttggtggaagtcactcagaacaaacatctgggaagacagcactaaactgcttaggaggaaggagggagaatctattaatattacccagaaggcagctggaagtctcattcagctaaaagcagtcattttactcggtcttgactggcctcccttcacttcaaacggggtaaggcagggattggggagagggaactgttgttctgtacccaacccttctgctagcgaggactatttggtgaggtggaagggatagagttgtgtaaaacatcaggagaaagtgacaatcatgtggggcactgtcacagtggagagtggtgggcaccgggtatgttcacaccctggttgtagacttgcaaaaggtgaatttcagaaggtgcgggagaaaataagaatgctgtgaacagagatggaggaggaatggaaagattttaaaggcaaaatttgtctgagtgcggtggctcacacctgtaatcccagcactttaggaggccgaggcgggaggattgcttgagcccagaaatttgagaccaacctgggcaacatagcgagacctcatctctaaaaaaaaaaaaaaaatcagccaggcatggtggcatgcacttagtgtcccagctgcttgggaaactgaggtgagaggatcacttgagctggggggtgaggttacagtgagatgtaatcatgccactacactgcagcctgggtgacagagcaagaccctgtctcaaaaaaaagattaaaaaataaaaggcaaaattctaaccataaatcacaagtgagctcagtgaggaaaaatatggagagaactgaatgcattgtaagataaaaactaatgtggctacctagaaaattctgtaatgtgttcaagaatcttaaaggaaggttggctaaggttctcctggagtaagtgagcccagctagcctaagcgacaaagagagtttattggaagaatcctggcatcaggagtggaaggaaccaaggaagtggaggaaggaagctcagcagctgggggtagcgaggagcttcctgtgagagcacatgttgccatgactgcatcctcatggctcatctccactctttgccatgtatctgtatgcaggctctccttcccagacaacatgatgggaaatagggtcaccaaacagctcttggttgggggtggggaggtctctagctcagcaattgtgaaagtgatggccctcttttcccaaattcctgggaagtaactaattgatccactttggatggtgggtttgttccaggaccagccagctgtgtccaggggatggtgttacatgtccgagtgtgcccacccccggctgcagatggaagggggtgcacagttttcagaaggggggtggctaagcagatagtccagtagatcccatccaaataagcatataaacataaacaaatatggctctggggaaaggctaaggcccagaatgtgctgttggtttgatgaaagatgctaactgtgatgacagcaatgtcaagctgtgaagaataagggaaacatggagccattgcttgagaaagactgaaatgtcaacaaatgccaagaagaaagtaggactaagaattccaagctcttcattccagaaatctttttgcactaaaaaggataggacaagcctaagatgacattcactgcctctgtctcacctaaatattcagagcacctctaaagctaggaaacacttcagttggcacttattcaaatccatgcacttctacgtcatcataaatctaaaatcagtacttaaccccaaaagatcagttgtagaatgattttaagaagatctctgggggatattacaaggttacagtgacatggctgccaaagaacttcaaatgtactctttaaaaaatatgtatatgactgggcgtagtggctcacgcctgtaatcccagcactttgggaggccgaggcaggcggatcatgaggtcaggagtttgagaccagcctggccaacatggtgaaactccatctctctaaaaatacaaaaattagctgagcatggtggttcattcctataatcccagctactcagctggctgaggaaggagaatcgcttgaacccgggaggcagaggttgcagtgagccaagatcgtgccactgcactccagcctgggcgactccgtctcaaaaagaaaaaaaaaaaatatgtatgtgtatatatacacaatgtcaagatttcagggaggggtgtgtgtgtgtgtgtgcatatgtaaatatgtaaataaaatttgggaaatacagaaaagcacaaagaagaaagcaaattatccaccattacccgaggcagtgctaacttgtgcaaacattttggtgagttcctcccaggctctttctctctgcttgagtgctgggtggtctcctggctttcagcccagtgctctttcctctcctgtgtaatctaaaccagtgctacccacggtctggtccattggctggcagcagcaccatcccgtagaagcctctagaagtgaggttctgagcccctgcccagtatgactgaaccaaatttcttggagcagggaccaggaatctgggttttaacaaggcttgtgggtgactgagacgcagacgggagtttgagaagccctcgtctatgccagtgctacacaacttgtggtctgccgtgtgaactgttactggaccatggcaagataacacagaagttgagagtgagcacttagaaatgtttatattaacttgacataactgtgacatccaagcatgggagccttggaaaagagttttattatatttcacaaatatatcagtccacagtcgagttgactgtgactttaaaaaaaaaaactttaaaaaaaaaaaaaaggaaaaagtgaaatttatgatagttggtgcctgtggggacagatgaggggaggagcacatgcgactttattttctttatttaaaaagaatatccaggttgggcgcagtggctcacacctgtaatcccagcactttgggaggccagggtgagaggaccacttggggccaggagttcaagaccagcctggacaacatagtgataccctgtccctacaaaaaccaaaacttagttgcgcccgtggtcccagctgcttggcaggctgaggcagaaggattgcttgagcccaggagttgaaggctgtagtgaactgtgattttgccactgcactccagtgtgggcaacatagtgagacctgtctcaaaaaaaaaaaaggatatccagaagcacaaacaagcaagcaaaaactggtcctcaggccaggcgctgtggctcacacctgtaatcccagcaccgtgggaggccgaggtgagcggatcactggaggccaagagtttgagaccagcctggccaacatagcgaaaccccgtctctactaaaaatgccaaaaaattagctgggcatggtggcgcgtgcctgtaatcacagctactcaggaggttgaggcatgagaatcgcttgaacctgggaggaagaggttgcagtgagccgagatcacaccattgcactccagcctgggcaatggagccagagtctgtaaaaataaaaaaaaaataaaaaaactggtccttgaccacagatagtttgagaagcactggtgtacaccatctgtgtctctttttagacaaaactgcttgtttccaacaggaacctgctacagctgcagccacttgaaagggtcacttctaaaatggatgcttacttgttttgttggaagtgagaaaatttaacttggtgtggcaggataagcaggagccagactctggtctttaggaaaaaagggagccacagagggttttttaaagcagggaaatggcaagatcagatttgctttctataatagtgagtggacaagactgggcacaggtggatgcgttgggaagcagctgcagttgtccagacaagggatgatggtagctcagagccatgttgggggagatgaagaaaagtggataaattcaagaggtttgttttctgtcttcacttttgttaaaaaagaaactttcaaatacatgtgttgggaggtaaggaagagaatgtgtttattctgtggcttggctttgtttcctgtgtatcttaatactgatggcttttgtatcctaatactgatggttttacgtaatagccaggtttctgtgctatttatttaaataaaaggataggaaaattgttgcatggcttgtatttgctcatagtctacctgttgcctgtcttcattctcaaccagcacctagtgctctagaagcttggtgaggaggggaggaaggtgtcagccctgtacctcatccttgtttacatccttgtttagtagaaacggggtttcaccgtgttagccaggatggtctcaatctcctgacctcgtgatctgcctgcctcggcctcccaaagtgctgggattacaggctccaatcttaatttactatcgagaatccggctactggtgtttcatcctggatcctacaactagagaacacaattttcttgtatttccacaaccaaaaaatcaataggaatatttaataaaatttattgaagatatgattttaccagaaatacatagatataaaagcaattaattaaagcttttaatattgctttctacatatgatatgtacttgcttaaatcactgctaatttctggtaattaaatttgatgtgtatctattgaggagctactcagtccctagcatggttgatgcagtgattcccagactctggacttaactgatcagtaatgttccttataaaattgcggagtctaacctagggttgcctcctttttattttatcaagtaaaaatctagaactgaatcaagaatttttaggccaggcatggtggctcaagcctgtaatcccagcactttgggaggccgaggctggtggaccacctgaggttaggagttcgagatcagtctggccaacattgcgaaacctcgtctctactaaaaacacaaaaaaattagcagggcatggtggcacgtgtctgtaatcccagctactcaggaggctgaggcagaagaatcgcttgaacccaggaggtggaggttcagtgagccgggatcgcaccattgcactccagactgggcaacaagagcaagactccgtctcggaaaaaaaaagaaaaaaaaaaagaatttttatatctactatcaccattaactcaaaaaattaaacaacaccaaagggtgggaagtgaccaagaaaagattctgcgttatctccattacttttttatttatttatttatttatttatttatttatttatttatttttgagacagagtctcactgtgtcacccaggctggagtgcagtggtttgatctcggctcacagcaacctcggtctcctggacccatccattactttaataaaaatcagatttactgaggcataatttacacatgataaaaggcatccatcttaagtgacagagaaaagtagaaaggacaaaaatcttagattatagaacagttatcaaagaggaacaaattaagtttttaaaaaactcataactcacatttatttttctctttctaccgtgggttggtgaaaatttcatcggggctggtgcacaggtaaaagttaggagccaccatcctaggagtggcttaaaaaagggagcttttcggccgggcgcggtggctcacgcctgtaatcccagaactttgggaggccgaggcaggtggatcaagaggtcaggagattgagaccatcctggctaacacggtgaaaccctgtctctactaaaaatacaaaaaattagccgggcctggtggcacgcacctgtagtcccagctacttgggaggccgaggcaggagaatcgcttgaacccaggaggcggaggttgcagtgagctgagattgcaccactgcactccagcctgggcgacagggtgagactctgtctcagaaaacaacaacaacaacaacaacaaaaaactcttctcaatatggagagccttggagatagccattgaggatcccttgccagagagtaggaagttgtaggcgagggcacccctcaaggcagggtggtgactgtagagtcaggggagaccattcttgagaactcactcattccttcattacctccagccaatatgcttttttgtttgttttacgtttagcctatcagcttatcactgtggtgatcgcagccgcgggaggtgggctcctgctcatcctaggcatcgcactgattgttacctgttgcaggtaagtgatgagagttcaggttccaatcccgttcctttgcctgtgctatacaagggtcagtttgtattcttttacaggatacttgagatggttcacaatattaaaccataatgtgtgactaacccatttttaaaaaaggagaaagggaattcacgatagttggtgcctgtgaggaaaaagaaggggagtaaatggaacttcattttctttattagaaaagaatagctgaaagcacaagcaggaaatgaaaaaagaaataaactgggcttcatcagaattaaaaacttttgtactccaaaggacactatcaagaaagtgaaaagacaacccatacttgcaaatatgggttgcatgagaaaatacttgcaaattatgtgtctaataagggacttgtatctagaatatagaaggaactcttacaactcaacaacctaattttaaaactggacaaacacttgaatagacatttcttcaaagaagagatacagatggccaataagcacattgtcttagtccattttgtattgctgtaaaggaatacctgaggctgggtatattagtccatttttatactgctgataaagacatgcccaagactgagcaatctgcaaaataaagaggtttaatggacttacagttccaagtggctggggaagcctcataatcatggtggaaggcaaagaggagcaagacatgtcttacgtgaatggcagcaggcaaagagagagcttgtgcagggaaactcccccgtatagaaccatcagatctcatgagactcatttactatcatgagaacagcatgggaaagacccacccccatgattcaaccatctcccaccaggtccctcccacaacacgtgggaattcaagatgagatttggatggggacatagccgaaccatatcaatgggtagtttctaaagaaaaaggtttatttggctcacaattctgatggctgcaaattttgagattgggcgtctgtatctggtgagggcctcaggctgcttccactcctggaagaagatgaagggagccacctgatgagaaagaaagcaagaggtggggggctaggggagaggtatcaggctcttttgaacaaccagctttcccaggaaaggtattagtcctttcatgagagatctgccctcatggcccagacacctccctgtaggccccatcccccagcacctccacactggggattaaatttcagcatgagactgggtggggacaaactatatcccgatcgtggcacacacgaaaagatggtcaacatcattagtcacctaggaaatgcaaatcgaaaccaccatgagacaccacttcacacccactaagatggctattaaaaaaaaaaaaaatagaaaatagctgctgggcacagtggctcagcctgtaattccagcactttgggagttcgaggcgagtggatcacttcagatcaggagttcaagaccagcctggccaacatggtgaaaccctgtctccgccaaaaatataaaaaattagctgggtgtggtggtgcatgcctgtaatcccagctactcgggaggctgaggcaggagaattgcttgaacctgggaggcagaggtgcagtgacctgagatcatgccactgcactccagcctgggtgacagagccagactccgtctcaaacaaaacaaaacaaaacaaaaaaacacctagaaaataacaagcattggtgaggaagtggaaaaatcagaatcccccatacactgctagtgggaatgtaaaatggtgcagccgctttgaaaaagtctgaaagttaaagacagagttaccattggacccagcacttccactcttaggtatatcaagagaagtgaaaaggtatactcacacaaaaacttcacgtcaatgttcacagcaacattatttacaatagccaaaaggtgaaaactctaccaatgtttgtcaatggataaacaaaatgtgatatatttctacaatggaatatgattccggcataaaatgaatgaagtactgatacatactataacatgggtgaaccctgaaaatacgctaagtgaaacaagccagtcccaaaagaccacctactgtatgattctatttatatgacttatctgaaataggcaaatctaatagagttggaaagtagattaatggttgtctagggccagaatggtggggaaaaggggagaattggaagatggtggctaaggggtatggggtttcttcttggggtgatgaaactgttctaaaattgtgatgatggttgcacaagtctgaatatgccagaaaccattaaatgagtgaatcgcatgatatgtgaactgtttctcagtaaagctatgtacagaaagagaagcagacaaagaaagatgaaatatttttgcagtagagaagttgtagcagcagtgtgggatgctttgggcttcctggaagccactgagattgggtttctattggaaaaggaagagaaaggaggaaattgattccccttctctgtgatgatctattcagataagggaaaattatgacctctgacttagatgataataatggcaggaattatctagatgtaacagatggggggaacctcccaaaatagctagttatcttttctaccgttgacataaaggacattttaagatatcctctgtcttcaaaaaggcagcagagagcaatgtgccctaactgcccaactaggaatgcagcccttatggtatagcctttgcctattattttccaaattgccatcaaatcatcaaagataaaccatatgagtggaaataaacttcaggggatgagactaggaatggttacctagagggacataacctgagcgctcaagggacagaagcctcatatttgctacgtgttctgtactgtgtggtgtacccatttggggaaggagcctgtgcctgctggctcctgagaagagaaggtagttgtgcatgagtatgtcattgtctgagcccaggtaccccacccaccaggaagcaacacagtggcaggtctgttcccaacttccacaaagagccagcacctaagccacatgctagacatttggttttatgaccctgagtcactttttgccttccctagaaaacttatttgtactttaagtgaggtagaaagaaaaagatttcagattatcctatctgtgacaaatataatttaaaatttctgatcctggaccggttagataggtgaagaacacagattccaacaatttgcagtcagtgagatctcacgagtagcatttctgtaacctgctgaaatgagaatttgtacaggtgtataaataggtgggctttttcataaacaaaccattctgtttttatgacttgtgaaatatttgcttcgtgtagtagaaagagcactgcccggagagttggaggcctgaattctagttccacaccttctagtagcaaaaggtgacccagaggacaagtcaggtctctttactgagttggagctgccccatcctatccccagagctcctgattcagtcaatctgggggagacccagactcttcccatgtaaattctgatgcttgggcagcttgggatccactggactagaatgagtctaagggcccctctggctccagcattctgtgaatttatgacccttgttttcctggccacccccaagacacagtgatctctgtcctgtagaagagtctaaatctgccctattgctgctgtttttgtccccctaccccctgataatctggcccctttgggttggaagaatttttgtatctttttttgcacctaactgcatatttacttgttgtaggcaaataccaaataacaacaataataatactactcagtgggcagctacaaataaatataatggtagctttcagttgaatttacattataaaatcatagttggtgctttcacagtatcacttctttacggaattgagctttacaaatatttttgtatcccacagaaagaataaaaatgacataagcaaactcatcttcaaaagtggagatttccaaatgtccccgtatgctgaataccccaaaaatcctcgctcacaagaatggggccgagaagctattgaaatgcatgagaatggaagtaccaaaaacctcctccagatgacggatgtgtactactcggtgtgtattcctgtgtcaggatgaccccagggcccccggttcctctgagaagtaaaggaattctgttttgttgtagtaaaagcattacagttagttaagggttaaagagtagtggcatgaacctctgatttactagtcagtttacctacagtctatttgcatggtacttatcagtgttgctattgaggtatgaaggatatttccataaagcacattatatttatgtggttgtagcagtaaccctcttgttactaaacttggcttttaagttataggaatggaaactgaaaggtagagcaagaatttagtgatatttagcctttggccctttcatttttatctcctgtctgccatgcttaccttgtgtggttaggtacttaaaactagaggattggtggctgggcacagtggctcacacctgtaatcccagcactttgggaggccgaggtgggcagatcttgtgagtccaggagtttgagaccagcctgggcaacatggtgaaatcatgtctctacagaaaccgtgctcctctctacaaaaaattagcctggcatggtggtgctcgcctgtggttctagctacttgagaggctaagatgggaggattgcttgagttggggaggcagaggttgcagtgagccaagattgcaccactgtactccagcctgggcaacagagtgagatcctatctcaaaataataataataataataatagcaataataaacaacaacaacaaaaaaaccaactaggggatggggaaaaggtataaagagaacaacaattcaatgtcgtcctcaacaagcacttctcaggtttagaatattgtatactcagtaggcctttaataatttgctatgtccagcctggactgcatcatttggaaaggtaggagacaaccttgaacccttgctgcctttctcccatattgaatttaacctgtgtcatattcctgtaaactgcccagctcatttcatatcactgtatcaaccataaagcaaacacgaacaggcgtatctgagctgaaaagtaaacagttatcaggtgacttctcgtgccatgtggagctgtctgaggaatagcaataaatgtgaaaccttgccccatggggacttaatggtgttagacaatcttgtgacagaaaccataattcctctggttgctgtggcaattgaccatggggatgcagactttggatgggagggacaagtttgttcatgctaagaagctgtttatttccatggactctttttgaaaaatttgaacctagaggaagaacaaaaagttataaataaggaaaaaaacataaagaaatacaaacttagctctagcaaaaatattcccattgatatttctgcattgggctttgtttctctgtttatcaggaaagtccttttcctttactaactgaagctataactgagctggtattttaccctggtgtgtccccacactctcatcctttactcgggactcctcagccccagcacggttcaataactagcaacaaacaggcctgtgacatcataggaaccaacttcactgcatgtttccatggtattaaagagttaccttaaataaacgtagtcaagaatgtaaatgaaccccatttttattccaaaaatagcaggctggccaggcacagtggctcatgccgataatccctgtaatcactttgggaggccaagatcgggggattgcttgaccctaggagttcaagaccagcctgggcaacatggtgagaccctgtctctacaaatttttttctttttttaattagccaggcatggtggtggacccctgtacatccagctactcaggaggctaaggcaggaggatcacttaagcccaggaggtcaaggttacagtgaacagtgtttgtgccattgcactccaggctgggcaatagagcaagaccctgtctcaaaaaaaaaaaaaaaaaggccgggcgcagtggctcacgcctataatcccagcactttgggaggccaaggcaggtggatcacaaggtcaagagatcgagaccattctggctaacatggtgaaaccacgtctctactaaaaatacaaaaattagctgggcttggtagcatgcacctgtagtcccagctactcgggaggttgaggcaggagagtacctcaaacccaggaggcaggggttgcaatgagccgagattgtgccactgcactccggcctggcgacagagtgagactccatctaaaaaaagaaagaaaaagaaaaagaaaagaaaagaaagaaagagagggaaaggtaaaaaaagaaaaagaaagaaagggaaaggagaaaggaaaggaaggaggaaaagaaaaagaaagaaggaaaaaaatagctggctgagcagtctgtagaggcagagcctaagcttagggcatgaagctgtcacctgggtagacaagctgttccacacagtgggctcaggtgtcgtccaggtgattcccacattgggctctcctgcaacttatttatgatacatagtagctagtattttatttctgccaagaaataatttacctttgttgctactttgaaggcctcctcaaagtagcccctcttattcccagggagcctttttttgagatccaactggtcacttgaggattgctgttggcctcctggtttggggtcctaactccacctgcaactagatggtcgtaggaccttataaaggtcagttcctccgtttgcatcagttgccttctgcatggttgctgggacaggaaggattaaagtgggttgtgctccagagagaaagatactttaaaaaaattagaaataattggtagaaccacatcatacaggataaacccagatcttttcttacattggtctaaaatcattgggatttaacactgcaatttaaacccaagaatgataaattgacttttcttcttttctctttggcaaccagcctacaagtgtaaggaatccagaacttgaacgaaacggactctacccggcctacactggactgccaggatcacggcattcttgcattttccccggacagtataacccgtctttcatcagtgatgaaagcagaagaagagactacttttaagtccaggagagagagggactcattgctctgagccagtcacctgggacctctgctcagaggaccgcaccaggaggctgcgcccaggatttgtcgggagccacgctgagtggcaagcaggaagagggacaggcatgcggggcgtgaccacagtggaggagacaggtggatgtggaaccacaggctgctcattcagcacctttgttgttactgtgaacgtgaatgtgggccagtatcaagagagtctctctgagtgactgcaccatggcactggcaccagggcgactattagccagggcagaccactagacttcagtgcagggacctggttttcccttcgtttgcactttagtaaattgggtgggaggtttccttttggatctgttttgagactgttccagaaagaaggcttcctttcccgagacacttccataggcagcaatttggtgattcatttgcagcaaaatactggcttgttaattattttcctgcccagcgcctgcgtgctaaacaacagatgaggatgagcgtaccactgaagtctgaagatgtcgccattgaacggacagtgttttcatatgtttctaggttgtcttatgctacagtttccaagccagcccccacagtgaggaaatgtgtgaggcaccgcacacaactgcaatgtgttttttaagtcaaggtgacacatgtatttaagattttttttttaaatctctttgcagttaaatctcactttttcaaacaagcctggatcagggcaaaacaacttatatttggttttagctggaggctcagcaggcagattgcaggcaggggggcacttttcatccatgagggcccagcctggggcctgggactcgatcaccattgtggaggccagaggcagctgcgtatggaggagaaatgtcaaactgaacgcaggtttcaccactctaggaaagcagcttgttgagcccctgcagctggatgtggttagagggatgggctgaataggcaggttagatttcctgcatcaacagtgctttgggaagctgtgtggattcctgaggaagaacagggagccgagatggagccacacatgagtttgctcaccggctactgcagcactttgtacccagaatctcatgtccacaaaccccatgtaaactttcaaccactcaaagctgtttattcggctgaagaaataacttttttttctcacccagtcatttgtacctcttcatatggctatgtcgcaccctccagaaacgtggttatacttccagtcagtgtgggagaactgaagacttccggttggtcgaggaactgagggttgaccttcgggaaggaagttccactcatcttatttattatgcctgtgatgtgggtcctgccagggagacatccagtactcggtgtctttaattgccacctggggaactgtgtttattggccttctttggggcatcctggttttggatgaagtgaggggaatacagaggtaaaagaattgtctccaccctgaagcggggagtcccgcttcacatttctggaaatggtgcagccactggggacagttctgccccgggcatggttgtttcttcaaggtcctctaaatataatccctattcttacataatccttggccctgatggttttaagcaagaactcctgtgtcccatggtctccaccactcaccatcaccctgctgtagcaagagtcctagtcaggggaggtgcattttagtagttacattgcacttatccatgagataaataaaaggagaactgtttttatcagtggaggctaacctaaaatttcaaagtgtcgcctttttgaaatcttgggcctctctctctgtagaaccaatggccctttgtggctcacggcctcgcacctaactggagagttctgagctcctgcagctcacctgagcccacagactaggcttcttggctccttccgcagcatgcctgctcacccccagaacccgcagctgtgggaagagccatgtagggaggctattcccaggcatacacttccactgccttcagctgacgtcacagctgacaaatcatctcctctatcggagccagaagacttcagctccacaaaatgaagtgttctgtcctgaaaacattcttgggaagaatcccaacatcgagaaaacggtgtcctgtgagttccaacaatgcttcttgttcatgggtttcttccgtatggagtggattaagagtgttttattttgttgttctaactgagaaaaaaaggaggcacccacaaggttgaggtcacacagtctccacagtttccaggaggcgtttgggggtggggaaggcacctccagagcatgaggctctaaggggacatgagtaaagcatgtctgtgacccagtgaggaagggagaggccagctgcactcctgcacggggttcctagctgcagaagggtcccgcctaggccgaggggaaacacctgatagcagaagaggcctggatgcacacctggcacgccgaggctctccgcccagacacagtgctccatgtcagcccctgcacctggggtgtgtgattcacgtgcacagatgccacaatcctgcaccaatatcccacagatgggggaaggtgagaggaaggggcaagtgatgtgtaactgctcaagagatgcttaaacctccatagagaggagccgggcgcaggggcatctgtgtgtcccgtcacacactgcagcagggaagggtggctggctggctccctggcatcagtggtttggtttaagctccagagggtcttattgccattgtcttttcctctgccccttgagccagcctaaggccctggagtctgtttctttaggcggatgaactgacatgctcctaccatgaccaggctctgggcaaggctcctcacagtatccttgagaggtgggcatggaagtgcccatttctcaggtacagaaaccttcagagaggataaatagcttgccctgtagaagcaggactgaaacccttgtctgcctgactcccccagctactctgcccactgtagccccctgccttactgtcctggcacacccctcaccatcctgtataccttaaatatcaaagagggcaagagagaaagggctttaaagataagttatttttttaaggaaccttaatattatttttaagaagtaaccaaattagtgacgtgaaatgc

SEQ ID NO: 37800 - DNA, 5950 bp, Homo sapiens; identical to SEQ ID NO: 37614

SEQ ID NO: 37801 - DNA, 5950 bp, Homo sapiens; identical to SEQ ID NO: 37614

SEQ ID NO: 37802 - DNA, 77736 bp, Homo sapiens
aggaaatactcttaattctaaggaaaacctggaagcacaatgggagatgacagtgagtggttgaaactgccagttgatcagaaatgtgaacacaaggtaagattcttctggaattcgattttcagtgtcgttggcttgttttgtgagcagttatactatcatcttacttagaagtgtgtgaaaacattggcagtttcaaaaatactgatgccttgttagatatgttattttttctcattgaaaataggtttctgtagctcaactaaaaatttttttgtctctggaaagaattcaaagaaaagatattagtgaagtgaaaagtaagtggtatctatgaaaagtaactggctagttttttcatctccttgtatatacagtacaatatacttctggtacctaagtacttactaatattttattatatagagactcttcttttgagatgtgttctgaatttggccttagaaatccagcattttttaggttctctgatttatatgatcggcattccaatatttaccctcagaatctaccaatctttattttctagtttatgctagtaagatacaatttattacatcatgtcattatttggtgggcatcctttcagattatcttattttttccccaactatacctctagtttctttcatttttaatcattttaaacaaacatctaccatctggtagattttagaatttcatttcttcttgtaaatttattctactccaagtcctcaggtttaccactttatgttcttgacagttcttttaaagtttgttttgaatctgagtattcaagatttatggttgttgattactaaaaatactgaataaaatatactaacttacacagttgtatacatacagttctacctatgtagagtagaaatttggagccatggtccctatatcctccacagaaccactccttcatcctatataataaattagccaaggccgaatactgtatcaaaaatcaacatgtagctcttcaaataaggccagattaaaagtgagctagttggtttttattctaattcgcatagaaattgttggttatgtagtacattaaattgcaacaaaaattgggggagaattttggaacttatttagaatcgttaactataatgctttttttggtagatattgtatattctcactgaaaggggcagacaatatagataaatcttagactttccgatttttgattggttaatatgtgctaagagtttttcaatctcgtgtgatttggtactttatttttcccattttttgagcatttattgtgtgtttttgaaacttaaagcatagagatgttaaatctgtttagggaacactcattctactttatagaatgagatgttgcccaattttaaaaaataaaaaaataaatctggtttaaattggttagtaaatgttcaactatgatgttaatttatgttatacttcactctaattttgcagaataggtaatgccttcttcctaatgaatgcatcttatagtgggttaggcagcattccttccttagaaggaagagttttttctgtgagcatagcacctgccccaaatcacattttcaattacattaattgaatcaattcaattacattttcaattacatttttacttacattaaacaaataacatgtaaattatttctgtttttcaatcatatgttgatccttctgtctctttgatctaatagtgttgaggacaaacatctaattctttactaatgcttaacacagtaaatgcaaattcgatcatcccacaaactaacttctcatttaactgcccccaaatcatttcattgctttcccattgctcttagaataatgagtggaatcttttctttggccttcatagtcctgcatgatctggccttttccaatcctctccagcttactttgtaccatactccccttctctttctttataggagtgggaaataccatattccctgctgccatagggccttggagtatactgttccttctggaatgttctgtctccccttttgccactctttcctgattagttcctatttatctttcagggctcagctcaattaccatttctcaggaaattttttcttaacactaagacaaagccttttataatatatactttcatagcaccaagttgcttctcctttgtagtacttaatgctttgttaattttaaatttatttgtattatagcttaatgtcccctcctgctggagtgtaagctccacaagggccagagctgaattgatttttatttattaaacacctgttgaataaattaatgaaaaaagaatacctcagtaaaaatgtccggaatctactagctgaaattaatatacagtgtaatataaagctacctaatgattatacaaaaatagaaccaaaaaacagcatatactttggagacggggcagtttcatcagggtgatttctcatgtttgagttatcacatctttaatacaatattataaagaagtaataattcttagatacaatgtgagattcatttataatggcctattatgaatggcagagtatcataaacactaaacacttgtaagaagtttattagctaatcttttttgaaaactgccaatttcttaaactcttttttcatttctagtcatggggtcctttgtttacattacctgacataggatattcatttctattctcacaccctccccccccagattaatagtagatgataatatcattaaattatgttttgtttcaaaatactacttttcttttagctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaagtaagtactttctttccaactttactgataaaaacccctgtttggtgttacataatgtatgtttgtagatcactgtccttagttattagcagttttagaatagatgaattttcttactttcgtagtttcttgatacttgtttttcattcagtctttattctcagaaatctaaatggcacatgagatctgtagaggagtaaattagaaataatattttgagggtttaccttaaggtttgatgaccaagtggttttccttttaagctttttgtatgggaattattctaaactaaaaggaagagtctttagtaacttcaaaaagaaactgagagattgtcagtaaaggaattatcagaatttcactgaagacatttgggcattatagaaaactaaattttttacaagggttgttagataggtgatgttagaatcatgtctttctccctttgttcattaggcatttttatttcttgggggaggtaatgcttactaaacaacctcagtgactcctggccagtttaacttgatctgtgaatgacagatttctagtcatcctactatcccatacctcatagacctgattttcctaactctagtctctgtgtcattgaaaggaaccctccatacaaaaaaaaaagttgaaacacttgacttaattgcacaagaaatatatacttgacttacttcaaagattataccaataaagatcatcattaatttgacaatttggttaactggcatcactgggtttcctttaccgttagtaaaactatcactttttaatttctcttctgatactagaagcggttttttgataaatgctgcatgtaatctcaacccactcagttcttctgattcccggtagtgtaggtttcatttcatttagaggagattcaaagcagtaaagttattgtaaagtcttattaaggagtcaagagtagtcttttattattaaaggtacatatccgttccctctgtgaagaaattctcttttcctaaaaagtgtttaaaacgacttaaaaaatttttttgcccagatgcagtggcatgtgcctgtagtcctagctactcaggaggctgaggcaggaagatcgcttgagcccaggagtttgaggtcacagtgagctataatcccaccactgcactccaactgggtgacagcacaagaccctgtctctctctctttttttttttttttctttttgatacacagtttcgtacttgttgccctggctggagtgcaatggcgcgatcttggctcaccacaacctccacctcccaggttcaagtgattctcctgcctcagcctcctgagtagctggaattacaggcatgcgccaccacacctgagtaattttgtatttttagtagagatgaggtttctccattttggtcaggctggtcttgaactcctgacctcaggtgatccacccgcctcagcctcccaaagtgctgggattacaggcatgagccaccatacccgaccaaccctgtctctttaaaaaaaaaaaaaaaaaaaaaaaattgaaagcaagcattctgtaaccctacttttgtaaagtatatttgtatgtccatatacacacacacttagagaaaggtctggaaggagggatatcaaaaagttgaaagtagttttctctgggtggtgggatttcaagggatctttaattttttgtttgaattttctacatttataaactgttactatgcctgctatgacatgtcttaaaattttatgtttaacgttaagtttttaaaatattcttgaacataaatttaaaaattaaagactcatttactgtatttctagcatttgtaaaagtactagtacaccccctttccgtgacctttttccaattcttactacttaagtgggatttttgttctttataatatgttacagaaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagccttaaggtaagactttgttttagctttgttaactagagcagcagtccccaacctttttggcaccagggaccagtttcatggaagacaatttttccatggaagaattgtgtgttggggggaatgggggggtcgttttgagatgaaacagttccacctcataaggagcatgcactctagatccctcacatgtgcagttcacagtagggtttgcactcgtatgagaaccttaatgccctgctgatctggcaggaggcagagctcagggggtaattctcgcttggtagctgttcacctcctgttgtgtgcctggttcctaacaggccactgtactggccacagcccaggggttagggatccctgaactagagtatctcaattgagtttggattccgggtttaaacagaaatggaaactgcagaatttgacttggcatgccaaaacaagcaagaaagtgacctgaataaggaaagtcattccccaagtgtggcacttcatgttgactaattttagccttcaagtgtgttgtgtagttattttatctgaatccctttctaatgaagatgaatagagatttctgacctgttatcagattaagaattaggcttttcagttgggggcagtggctcatgcctgtaatcccagcactttggaaggctgagttaggaggatcacttggggccaggagtttaagaccagcctgggcaagatggcaagacccctgccactataaagaagctgaggtggggaggatctcttgagtctagaagttctaggctgcactgagctgtgattgtgccactgcaattcagcctgggtgagagagcaagaccctgtctctttaaaaaataaataaatatggccaggctcagtggctcactcctgtaatgctagcactttgggaggccaaggcaggcagatcacaaggtcaggagtttgagaccagcctggccaatgtggtgaaacgtctctaccaaaaatacgaaaaaattagctgggcatggtggcgcatgcctgtaattccagctactcggaaggctgaggcaggagaattgcttgaacctggaaggcagaggttgcagtgacccaagatcatgccactgcactacagcctgggtgacaaagcaagactccctctcaaaaataaataaataaatacattttaaaaattggccttttggtggaaaagcactgaaaagaaaagtactggccttttgttggaaaactactcctcagggtatttaagcagctctttttctcttgctatcttaagtatagactttcgaagtctatactttgagatgttggctaaagataaagtttgtggactaaagctaacctttatttaggtgcctttttagtaaagtagaagcaaatgctatatgcctttaaagagacgcacagtgaaagcaaatagaaaagtaacttttgctcttatgtagtaagttcttttcaaccctagactttcttgtttggccatgaaatttttcatgaataggatctctttcaggaacaagtggatgtaatttgctatggaaatctgaattagacagatcactagtttgttcagacttggcagttcttctaatctggtatcctgtccccaagtactgtctatatcagatattttagaaagcagctgtagtaaaatcctcacggaatgaagatcatccatctcacctctcatgattttgtgtatgacctacatcttggagaaaaatgtttcctttggtgtttatcttctgtgaaagtataaaaactcttgtattttgttgaatgatctttgatttataggtctttaatattgttttttgctttgctcataatgtacttttataaaatttgacttgcttagattcttacgtgaatgaagtttccttgtttctagcctattacaatatagtaagcagatgtttttctgagtagtaaacagtatgctcattctattatcttagaaatttagtgactcatcttagttatcagaactatgcttatatcaataaatcttttgtgtccttagtgatgtctaaattttaaaaaatactgtaatctttttttttttttttttttttttttgagacaaggtctcgctctgtcacccagactggagtgcagtggtacgatctcagctcactgcaacctccgcccctgggttcaagcgattctcatgcctccagcctcctgagtagctgggactacaggtgagcaccaccacacccagctaattttttttttctttaatagagatgggtttctccatgttggtcaggctggtctggaactcctggcatcaagtgatcccacctcggcctcccaaagtgctgggattacagacataagcaaccgcacctggcctataatcttctacctttaaattacaagtttctagtctggagtgctgtgtactctggttatttcattttttagctaaactgggagaataagggtaggaaaataacaagttacgtatatctcatgttttcttcatagatgttgttatgtagtcccatccctgtgtggttctttatttgtcctaaagcatttcagagtctatagtttaactaggtagctctctgggaccctcaagaaccttgaggccaaactgcttgatcctgggttccagagcttgctaaagctttgttagtgagagcttcaggtgaccagaaacatttgtggtacctaaaacaggtttctagtacccttttgtgttttctatagtaatacgtttagtatcaaaattaggttttattttattaaggtgtctattttccatgtggacttgctccatcttttttttcttacagaaggaggccaggatagagaaaaaagattcagatgaaacagtaataatatataggaagatttaagaaatctcaaatgttaggttcttcaggcaccatgttaaatatccctaaaacaaaatggtttattgccactataatttcttattttttgtttaatcttaaaggtcagctgagccaagttaaaatgtaatttttttaataatataaaagcattttaaaaaatcttagagattatgtaggttattctcatgatatttgtacttaaactatatcacatagccaggtatcttattaaaaattctttttttattgtgcctgtagtcccaccaactcaggaggcaggaagattacttgagcccagggggtgaggctgctgtgagctatgattgtgtcactgtactccagcctggttaacagagtgagacactatctcaaaaataataataataattaaggccaggagcagtggctcatgcctgtattgtcccagcactttgggttgggaggctgaggcaggcagattgcctgagcccaggagttcaagaccagcctgggcaacaaggagaaaccccgtctctacaaaaaatacaaaaaaaaaattagccgggcatggtggtgcccctctgtagtctcagctgcttgggggactgagtctggagaatagcttgagcagggaaggtcgaggctgcagtgagctgtgatcataccactgcattccagcctggatgacatagtgagaccctgtctccaaaaaagtaaaaacaaaaaccaagaaaaaaaaatcgttggagtacactagtagctattactgagtaattttgttgcatttgctcacatgagataaatttgtgcacattagataatagataaataataatttgggtcctactactcatacagaatttcagtgttctttcataaataaatctctcctgctccagaatctgatactcacaaatgttaatagtgatattagatagctaaaattggccagttgggaacttgaaaatgtaatctatgacagatatgtaaggttaaacacacttttttttaattttattttttttttgagacggaaccttgctctgttgcccaggctggatggagtgcagtggcgcgatctcggctcactgcaacctctgcctcccgggttcaagcgattcttccacctcagtctcccaggtagctgggattacaggcgcccactatcgtgcctggctaatttttgtatttttgtagagacagggtttcaccatgttggccaggctggccttgaacttctgaccccaggtgatctacctgcctcagcctcccaaagtgccgggattataggtgtgagccactgcgcctggccaaatatgctttttgaaagaagtcaaaatgcaacattttccccatagaaaactgaagtaaagaaagatttaagatgcccagagttatagtgtgatagccacaaagtcaggaacaaaatattgccaagatttgtgatctatctaggtaaatgaatcactttaattataggagctattaaaggtttattaaaagtagatttcattcatgtaaatatttataaactagtttatatttgtaagcttttatatgtatatacatacatatttgtggtattaggctgggtgtggtggctcacgcctgtaatccagcactttaggaggctgaggcgggtggatcacctgaagtcaggagttccagaccagcctggccaacatagtgaaaccccatctctactaaaaatacaaaaatttgctgggcgtggtggcgcatgcctgtaaccccagctacttgggagactgagacaggagaatcacctgaactcaggaggcagaggttgcagtgagctgcaatcatgccataccactctagcctgggcaacaagagcaaaatgccatctgaaaaagaaaaaaaaagggtattaaacatgttgatcctttataggttttaattattcctagtctgcttacctagaaagtttgtttaaaaatggtaatattattttgggccctacacattaaataatattcttagaagaacaacaccttagtaggtaagcagttatgagttccttttcttttgttgccttaaaaaaaactgaacttatataattcttctaatatgtagatatggaactatgtttgaatgaagaaaagctaatgctttatttaattgcattgcacgttgacagttttttcccaattttttacttgtagtgaatttggttccaaaatcatcttgcttaagccaattatcaaagtgttgccaaaactctttgagtctcgagagaaggctgttcgagatgaagccaaactaattgctgtggagatttacagatggattcgggatgctctgagacccccattacaaaatataaactctgttcaggtgagacaaaaagttttctggttgctttcgcacaaggttaatatgaaaatattttcttcctatcgttgttgatattctgtccttaaaaataattattttacattcttaattttgaaatcagcttttctgagcatagctaactttctcagcaattctcttgggtggcagaacttattatctgtgtgaagtacattctttctggctttttattacaattggttttggagactcttctgatgatgtaaatgtatctgaattaatgaactaatgagagtgtcttaaaaagtgggacttactgttctttcttagtgcttagacatacgtcttccttatagtaaattcaagttggtttgacttatgctgtaaaagaaataaaatttaattatatattttcttccgctggtgcagtggttcacacttataatcccagcactttggcaggcccagggagacagatcacttgagcctaggagttcgagaccagtctgggcaacatggcaaaccctatctctacaaataataaaaaaaaaattagccaagcatggtagcacagcctgtagtcctagctactcgtgaagcttaggtgggaggatcacctgaacctggggaggtggaggctgcagtgagccaaaattgtccagcctgggcaaaagagttgagaccctgtctctcaatgaatgaatgaatgaatctttcttgtttgccctggtagagccacataaataagaaattagaggccaggcacggtggcttatacctgtcatcccagcattttgggaggctgaagcaggaggatcacctgaggtcagaagttcaagaccagcctggccaacatagtgaaacctcatctctattaaaaatacaaaaattagccggatgtggtagtgcacacctgtaatcctagccactcgagaggctgaggcacgggaattgcttgaacccaagaggtggaggttgcagtgagccaagatcataccactgcacttcagcctgggtgacagagtaagactctgtctccaataaaaaaaaaagaaagaaattgggtcctgatatgtcaataaatgtaagtattaagtatgttaactaatggtggagatgcagatattatttaaatattatatgacatttgcagttgaaagaactagaagaagaatgggtcaaactgccaacaagtgctcctagacctactcgatttcttcgttcccaacaagaactagaagctaaattggaacaacaacagtctgctggtggagatgctgaaggaggtaagccaattttaaacaccggtttctgcaaaaattagcaagaactggcactgccatgagaatctgtgttcattaggcatattttgtaggattgcctttaataaaatataagttgcatgtagctttaataactctggtcccttctctattaaaatttcatcagggttgtgaaaggactgataactgataagtaaaacaattctaagcatttttaaggtttgtgttgtttttctccttaaaggtggtgatgatggtgatgaggtgccacaaatagatgcttatgagcttttagaagctgtagaaatcctttccaaacttcccaaagacttttatgacaaaattgtaagtaatagttaaacttctttcatttatttcttgtaaaataattacttgaatagaattagaatactctgctgagcccttgcctgatgcacccccttccatcccatatcttccctagtagagtgagttagttgcttcttcctctttgctcccacactactttgtacatatatatattatagcacttttttaaaacatgtcttgccataaaaccagaacattcttgacttcctttttctaattttctctctggtttttaacactaaagagctccggattcctcccctttctccgtttctactgccactactttaccccaaggtttcttgaccttagcactgttgacattttttgtcagctgtcctgtgcattgtatgatgtttagcagcatctttggcttttatccactagatgtcagtaataccatctccctaagtcatgacaatcaaaaatgtcttgaaacattgccggaagttccctaggagacaaaatcatccccagttgagaaacacagtcttatcccaaccaccactgtagtagtgggttgttggttatgtgattgttcttttctggtctttttaatgttgtcagtgtagaaattcctctcctgtaattgtgctgctgtgagatgggtgggctagaaatgctttctattaatgttttctgtttgacatctgcttactaacgtttgcctagaaaatgagaatgaaacgtctatggcattgtttgtttattatattactttagttataacatcttatgaaaatactttttatatatgaacaaaaatttatatatatgaacaaaatgttctgattgcctccacagttttattttttattattattactatttttttgagacggagtctcgctctgtcgcccaggctagagtgcagtggcgcgatcttggctcactgcaagctccgcctcccgggttcatgccattctcctgcctcagcctcccgagtagctgggactgcaggtgcctgccaccacgcccggctaattttttgtatttttagtagagacagggtttcaccttgttagtcaggatggtctcgatctcctgacctcatgatctgccctcctcggcctcccaaagtgctgggattacaggcgtgagccactgcgcccggccagttttataattttttaaaaaaattatgtatctttgaattagcagagtgcaataaatagacttttattccgctctcttatttcctgttacaaatgactcatattgtatcttgcaggaggcaaaaaaatggcaagagagaaaagaggccctggagtctgtagaagtactaataaaaaaccccaaactggaagctggcgattatgcagatttagtaaaagcattaaagaaggtaaatatgaggacttgcagtactggtattgtaacagccatcaggcctttgaatttctcatcagtcatctttttaattacacatacattgccacttaaggaacattactgatggtatttgaattacagacatacatttttaaagggttgttttaaattcctgttgtgggttagtttcattttcaatctttgttttttgtcactttgactttaggtatgctatttgatagcttctgtaactctctaggaaaagagagttgctgatctagaactacattttccagttttataattctataggatgagctatttaagttagctgtatttaattggacaaatattaaacatgaagatagcaaatgataacacactactttgtatcagtatgtaaagagtatacgaatatgaggtcagttctgaaacagacaagtactaagtaagagataaacatttttaggaaataatcttttggtattgcaagttgaatgctgctggtggacattttgtatgtagtaactttttatgaaaactgtaagtatagatcaaacactgtggatatgattatagtgcttaagaacaaactctgaaaacatcttcatgaatatagcaagaatgaaaattttgttttgtttgcttcctcagtctgaaattacagaggattacaatggtgaggggaggaagttgatttttaattatacgcacacctaagtcattacttgtagtagttatattctgtaaagccactgcgaacactaaattagtgaatattgaatcattgcttctaagagaaatacagggttaggatcctgcaaccctttggtcacaacatttccatcaatcagtacataactttgttttattctgtttggagatagcatatttaatatatgttgttgattcattaacattgaactcttggccgacaacactgtaactcttgcctgattgaagcttttcctaacgcatatattttctccctaaggtacatcacagcctgtttgcacttaggaatactagacagcatttcagcactacacttaggggccattttaaacaacaagagcaccaacaaaaaacacaaaaatgcaaaaacatggcactgaataaaccatgaaaaagacacttgtttatagtgtaaaagctaaagcaagaaggtagagtgttatcttgtctacctcagctgggaatgtgcacaatagacaacacaaaatgttcacagctctgaacttgtctgtaaatgaccaggaaagtaccatgagtgttgatttggggattataagcaagttttagcaagtaggtgaatttgcaaatatggattcgtgaatgatgaggatcaactatattctagtagttaaccttcctaggctttccttcagtgggacttggaggcagagatatgatttgtgaaatctttgttcagtcatcaattttccatcttgaagagttacactcgtgtaaaataaattaaaagagagttgccctaggggaaaaagagttttaccaacctggaacctgggaggaaagaatgggaaggggaatagtagagggcactgagacaaggaaagtcaggttccagtggcatatgaagagagctacagattctctgtcaattcttccagcatttggttattaattagaaatcttattgctctggtgctgaattctcgatgtgtcaaagaaaaccttttctttttccttatcattaatattatgtgttttctacatgtattttctaaggatattagcttctcacacaaagacagttctgtggtttccattggcattgtgaatgtaaatataatctcttgctgtactatataaagagagagcatcatggattttatatttgagtagacagacaatagatttctgagagatctagggtagcagtagaaacttctttcccttttcacgtggtggggtggagggaatcagagaccacaaacaagtaaaaagaaactgaattttgtggctaaaatatttaaaacaatgaaaagttaacttcagttgtaaaaattaacctgaaacgacattttcttttctttttgccttaagtagtgacagagacattttattttttttattttcttttttgagatggagtttcgttattgttgcccaggctggagtgcagtggcacgatctcggctcactgcaacctctgcctcccgtgttcaagtgattcttctgcctcagcctcccaaatagctgggatttataggcacttgccatcacacccagctaatttttgtgtttttagtagagacggggtttcaccatgttggccaggctagtctcgaactcctgacctcaggtgatctaccctccttggcctcccaaagtgctgggattacaggcatgagccacggtgcccagctgacattttattttttgtatttgattttagttatatgtacacacaaactttgtattatgttgacttcctagaaacataacaaaagtggggaaatggtgaaatggaaaaaagtggggaaatggtgaaatggaaaaaagaggatgagattgaagaatagattacagaccaatcctttttccctccttataattatctcttctttgtattgtataaatcaagtaatcccattaatttctcaatttttttcctttaatgaaagtagtaaaaaggcattaactttaaaatttcttatgatattcctgaaattatttttaaactgttttgagttgtcacctgatttagcatattctgtgggctttcctgttctcacagattatagttcttttttttctattatttttaattgatgtatttatttttgagacagagttgcgctttgtcacccaggctggagtgcagtggcacgatctcagctcactgcaacctccatctcccgagttcaagcgattctcctgcctcagccgcctgagtagctgggattacaggcgcgtgccaccatgcccggctaattttttttttttttaatttttagtagagacagggtttcatcatgttggtcttgaactcctgtcctcaagtgatttgcctgcctcagcctctgaaagtgctgggattacaggcgtgagccactgcgcctggcctatagttcttttatttataagatgcctccctcccagctcatcgcttctttgattttgtcatgtgcctatgcctatggacatttgattttttatatatatataatttatttatctttacattaagatttggattttcgaagtgctttcttatataatctttagacttctatgtggtattaatcttttttcacttgttctttctacttttccccccttaattattgcttgttttcatcatagttttctaaacacagtaattcataatgggtttcattaatttgtttcctttcctctgtcaacggtgtgctttagttattattaactagtggctttaatttctagttaaagataaataccaattgataattactttaaagcactttgttttaatactgtaggcctcaatttatgagaaaagtgacagcacttaaaactgtacaagatttcctattgtttaaattatattgagattatgagctaaagcttccattccctggtctagaacagaaattactgaaaagacagaagtcattgtttttcttacctctgaaatggagtcccccctcatatgttacttttcttaaaaataaacacttctccatcttccctactctcatttccctgttgagaataacttgtttatgggaataaacaatgagtgtcaatgagtgtgacaggcaggtattatattagggtatctggtccattgctcacttataagtttatttgagcctttgcaatcttgaaatttaacagattcgcagtatcttcttcaatactatacaataagatcatgagtgtctagagtctagctcccactggttactgttccaacaatggatagggagaggtattctcctaagaaaggaatagaatgatagttttttaactgagcccatatgacaaaatcaccctttgagccatttaaaaatactgatgtccaaatttcatcccagattcattgaactagaatttgttggaatgggatcttacatgtttttgatgtccattcctagaatatatatttagatgctaaatataaagcctagcatctaaatcatatctgagaggtattttgataaggaaaaataatcagaacatttataaataccaatagtgatttcaatacagaaatgaatggaaaatttttttcttcatagacttacagtaattagagatttaacaaaatgtttattaggaccctgatctcatcctctcgtaaggaaaagtgaacttaacacaagttgagagggagaacatgctttacttaataaaaggagcaaaaactttggagtcagaattgacctgggtttgaatcacacagcattaccatttgctaactacctgactgtaagcacattaatctttatttaatttttagaatctggctgggtacagtaggtcacatctgtaatcccaacactttgggaggccgaggcgggctgattgcttgagcccagtagtttaagaccagactgggcaacatgaagaaactctgtttctacaaaaaatagaaacattagcaggtgtggtagcatgtgcctttagtcccagccagtcgggaggctgaggtgggaagatcgcttgaacctgggagggggaggttgcggtgagctgagatcaagccagactctgtctcaaaaaaaaaatctttttgaagtctgcacttttttgttgtttttttgtttctgagatagtgtctcgctctgtcacccaagctggagtgcagtggtatgatcttggctcactgcaacctccgcctcccaggttcaagagattctcctacctcagcctcctgagtacctgggactacaggcgcatgccaccatgcctggctaatttttctatttttggtagagacagggtttcgctatgttgcccaggttggtcttgaactcctgggctcaagcgatcctcccacctcaacctcttaaggtcctgaggttacaagcgtgaaccaccatgcctggctgtgaatctgcaaagttgaaataataatagtccttacctcatagggtttgggtgaaaattaaacttaaaaaggattataaagtgcctacaaaattttggtgcctaatttgttttttcaataaatgttagtttctttatccttattcctcagcacttaaggagtgcatataagtgccaagtagaacttctttcatgttgcatgttaggagttgtttaatgcagagaatctagaataaagcattctgcttatggaacaccacattgtagggactagataaaattcaaagtagactggaggcattactcttactgggaaaagagtgaaaaaagaagagttgggggcatttaaaaataaagcagccgtgtgtgtgtgtgcatttataaataaagcagccgtgtgtgtgtgtgtgtgtgtgtgtgtgtgtctgtctgtctgtctgtctgtctgtcttgctctggtacccaggctggagtgcagtggtgcgatctgcactcactgcaacctctgcctcccagattcaagtgatccttttgcctcagcctcccaagtagctgggactacaggcacacgtcacactgcctgtattattatataataaagcagctttttaacaccaactgattgggcagtgtaccacagtaaaatcttaccaggaaggaacccagtcgtagtcagtatcttgttaaattgacacagatgcagctactacccgtgagtttagataagtgctgggctttgtgggttgtggcataggagggcagtaatataagcagtgctagaggagaatcgactgagactctgaattgaagcttaaccattattagatgactgaagtggcagcctcaaggccagaagctccctcagaagaatggttctcagaagaatgcagtagcattcacaatttagagtccccatggacttcctgaaggtacctgcagccgtttgtactggtgcttcttggttatgaatattagagctgttgccctgtgatgtctttcagagatacattgccttttcattttccttgtcccaaagcaaagtcagcagacctctcgtctctctgccattatcagggtcatttcctgcacagttgaacagtgctgacagcccagactgccactactggatagtgagcaatttgatgttgtggttttatctatgttttattagtagaactttaagatagaagactaaacataatgaagggaagctcccaaattcgatacaatgaaagaagaatttctcctctgttgtagtaaataaaattggtcatatattagcataagagctttcagagttcttttttttttttgagatggagtcttgctgcgttgcccaggctggagtgcaatggtgcaatctcggctcactgcagcctccgcctcccaggttcaagtgattctcctgcctcagccttccaaatagctgggattacaggtgcctgccaccatgcctgcttaatttttgtatttttagtagagacagggtctcaccatgttggtcaggctgatctcaaactcctgacctcaggtggtccacccaccttggcctcccaaagtgctgggattacaggtgtgagccgctgcacccggcctcagagttcttttgagaataaaatttcaatacccttctacatggctgtgactattttgttttcctttttacccccctttgtaggttgttggaaaggacaccaatgtcatgttggtggctttggcagcaaaatgtcttactggcctggctgttgggctaaggaagaaatttggacaatatgcaggacatgtaagtaacactcctttttagatacagatcaacaaaatttatcaaaaatggtaggcctagtttgctgtttgctttaaaacaactccttggcatagatgtgtatatactgtacaaagtaaatttctctctgttttgttaatattcagcatagatatatcttagaaatttcagtagatgtcagttgtaacaaaatttataggccttatgtagaaagtcaggcactaggcctaaagtacttagttgagtttatttatttgcttattacttatttacttactagtatcttgctttgttcttacaacattatacacatcataacaagatgaaacaaaacttgtaacgaccaggaccagaatgaaaatgagagtcggaaaggcaatgtaaaactataaatgtaaaactgtgaggttaatatataaaatgtgttttacattgttttcctattttaatatataatttacttacatatttgagacattttatataggttacaatgttatatattttatataggttatctccgttttacttattcaaagaaaatctgactggagacatttgttgacttactatttgtataagtttgtttccaatcaaatttggtaataattttaattaagatgttttctttaactgtggcatctgtcctttggcctctaaatccggtctgcattactaagaatggctcagcatcctaaaaattgaccttattgatctttagagtttagcttgctagccccttcatcatttgattccctagactgacttaggagtttcctaatagtccctagtcatgtgtccattttatattgtgaagctaatacctagcctcacatgagctatggtatttggagcttgcttactcatagcattaaaaataatctcagagaacttaactgaagaaaaagaagacactaccaaataaaaataaatcatgactggcttattactagggaaataaaaataagggtctgtaaaacccttagacatatacatcataaattgaaataaaattaaaatctatttttatagcaatcaatattatataatatcgatgtgtatatgccattttgatcaattttatattacttaggatattttacacttttatattgggaataatttttcaagataaaaaacaattttttcctacaccacttaaatatcagttcagagaataattttagttttttttttttgagacagggtctcactttgtcacccaggctggagtgcagtggcaccatctcagttcactgcagccttaacctcctaggcgcaggtgatcctcccacctcagtctcctgagtagctgggacttcaggcacaccccacaccatgcttgagtactttttgtatttttggtagagatggggttttgccaccttgcccaggctggtctcgaaatcctgagctcaagctatctgcctgcctcagcctcccaaagtgctgggattacaggcttgagccaccacacccggcctaaaattcattttaatttaccaaattatggttggataattaactggctttccagtttgagttctgattctggctttgtttcagtttgttgtcctggttaaagaatgtctctattgctctgtagtttggggtctcccccaccttaatactgtaatatatgcggtgtttagtatcaagcatgttactgacttggctttattttctttaaatgtttacaaactttttggcaatatttataaaagtgaatgttagctttatagacattaaaatatcttgattttcaagtttataactagtattaaaaagtcttgtatttttccatgggaaccatagtccttgaactataccaagtagtctataaccacttctgtgaaatcttgaaaacaattatttcttgtttttggatgccattgagctttgctgtgtcctttggaccttagaaattttcttccccagcctgggcaacatggagaaacccccgtctcgacaaaaaataaaataaaaaattatatttacagggaaatggtcaagaaattaagaattaaaaaaaaaaatagcaggtgtggtgacatatacctgaggcctacctactcgggaggctgagatgagaggattacttgagcccaggaggccgaggcttcagtgagccatgttcatcccactgcactcccacgtgggtgacagagcagaggcggcaaataggttgagaagcactgccatagtgggagagaatgagaattcttcattgttccggcataagatacgatgtccttcatgaaaggaaatgactttttattccacttaaatgtttgctttattggtttgttttggtggagacaaggtggttttttagaaagtaagttttattgagataaaacttgcatactataaaatttaccctcttaaagtgattttagaatattcacaatgttacataaccatcagcactatctaattccagaacatcttcatcaccccaaaaagaaaccccttgcccattaacagtctctccccatgctgctccctgcccttgactctagcaaccactaatctacttttttgtctctggatttaacatttcatgtaaatggagtcatacaatacatggtctttgtgactgctttttttttttttttggaagacagggtcttgctgtgttgcccaggctacaatacagtgatgcagtcgtagctcactgcagctttgacctcctgggttcaagtaatcctcccacctcagcctcccaagtagctgggatcataggcacataccaccacacctggctaatttttttttgtttgttttagtagagacaagatctcactctgttgcccaggctggtcttgaactccttgcctcaagcaacccacctgcctcagcctcccaaagtgctgggattacaggcatgagtcactgtgcccagcctgtgactggctttttttttaacttagcatactatttttaaggttcagccatgttctaggatatatcaatatatcattcctctttgttgctgaataatgtgctagccattcacttttacaggttgtgccaaccatcttggagaaattcaaagagaagaaacctcaagtggtacaagccctgcaggaggcaattgatgcaatcttccttactgtaagttgacagcatgagtttgtagttttatctgaagtaaagtttgtaaatataatattttgattgttctttacaattgaaaaaagctcattaaccacattttctttctaaagaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaaggtacagactctctttgaagttgggggaatattttatacctaggcaagattcttttcctgcaaattatgtacagtgactacttgactttcagactatagaggttatgatcttttgaggagcagagcctttgcagcttggaaactgaatccaaattctcctgtgttcctcttcttgaaagaaagcacaagttagtgttatgattccattaactgttaaacatgttgtttcttacttgtcccatatactggtgttcagctgaatctggccaagcataggcatcaaatgtggagtatttgaagatcatttgggagtgagttattttagatagagggtaagaggaaaaggaaatacttatttgctaaatggattaccaagggtttccttaacccgaaaaatttttgtttttttttttttgttgttgttgtttttgttttgtttgagatggagtttagctctgttgcccaggctggagtgcagtgacacaatcttggctcactgcagcctctgcctcctaggctcaagcaattctcctgcctcagcctcctgagtagctgggattataggcatgtgccaccacgcccggctagtttttgtattttagtagagatggggtttcaccatgtttgccagactggtctcgaacttggcctcccaaagtgctgggattacaggcatgaaccactgtgcctggcccaaaaagaatttttgaaagagtaactgtcaattggcacaaggaaagctatacttagttccagtaaattgtaaaaagcaaattctttatctagcaaccatcagtctgaattaaaatgagtaatgcctaaaataccttgcattaatatcattttgcttacttctggactatagcacatcaatgattctgctcctgaagtcagagatgccgcatttgaagcattgggtactgctttgaaggtggttggcgagaaagcagtaaacccattcctagctgatgtggacaaactcaagcttgataaggtaggttagtaatggattggactgaaattggacaacattcctgtctctttgcatcatggctttgtctcttgacagttatagagtactggtagttttgatgaggagttcttgattttttttaaattgccatttatagtaggaaagaaatgcataattgaaacaagttttggaggatgctctctggtactttttgtcttcaattttgtctgttgttttattaagaaaaaaatgctgatatcacctcaggaaatttatttcatcctccactgatagttcagaccgagtttgaaaacttagcttttgagaatttaagtttcattccaggctatgatggtgataattgtagaaatagctttcaaattataaccgaaaaaaagctgagtgaccaatctgtagagaaggtgaaaacagttctgtgagataaatttatttctaaggtccagaaaattaccttcttatatgtgaatgtcttccataaacaatgtggtcattttaagtttattacaattctaatttgtaaagaaataaaatgtaagattaatatcttacgtatgtctatctactgccaaaaaagtgtagataatttatcttttttgttgaaagggaaattttttctctgaaaattttttttttttttttttttttttggcaatgaatctcactctgtcacccaggctggagtgcagtggcacaatctcagcttactgcaacctctgccttctgagttcaaatgattttcgtgcctcagcctcccaagtagctgggattacaggcgcctgccaccacgcccggctaaacttttttatttttagtagagatggggtttcaccatgttggccaggctggtctcaaacctctgacctcaagtgatccacccatctcggccttccaaagtgctaggattataggtgtgagccaccttgcctggccatttctctgaattcttatgtgtagttgtggtttagaaatgtaataacgtagtggttgtgtttcaaagttgggcttaatgatgttcatctcactttcattctccagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggttaatagattatttaaaaatagaagttagtaaggaagggtctgagtctcaggttcgtggttgttcctctaaaattattttgtttgagaaatgaattcattggccacattaaaaatacagcagaaaatctgttaatgaagataggatattccagcaataaattcagctgtttggagctttaatagagataaaaatggtgatgaaggcacagaagtgtgttttgtcaatttaacataaaatttactatcttaactttttttttttttgagatggagtctcgctctgttgcccaggctggagtgcagtgatgcaatcttggctcactgcaacctccgcctcccaggttcaagtgatcctcctgccttagccccccagtagctggaattacaggcacgtgccaccatgccaggctaatttttgtatttttagtagagatgggaatttgccatgttggccaggttggtcttgaactcctgacctcaggtgatccacccgccttgacctcccaaagtgctgagattacaggcgtgagccaccgtgcctggtctgtcttaactttttaatgtgcagttcattaatattaagtatgtttataatgttgtgcagcatcaccacaatccattgccgtaatgcttttcatgttttaacactgaaactctatgaatcaattaactatcctcccattctcagcttcttccagccccttctttctgtttctatgaatttgactactttgtttttattttctatattttttagagacaaggtcttgctctgttgtccaagctggagggcagtggtgcgattatagctcactgcaacctggaactcccaggctcaagtgatcctcctcactcagcctcccaagtagctaggatgacagggacttgccaccatacccagcttatttttaaaaattttttatagagggcctcgctgtgttgcccaagctagtcttgaactcctggcctcaagtgatcctcctgccttggcctcccaaagtgctgaggttacaggcatgagccaccaagcctggccttgagcatcttttcatgtgcaggtggcaatctgtagttgtatagttcttcttggaaaaaaatatctactcaagttctttgcccatttttgaattgggttgttttgaggcaaggtctcactctgttccccaggctggagtgcaatggcacaatcacagcatacctcccaggctcaagcaatcctcccacctcagccttttgagtagctgggaccagaagcacgtgccaccacacacagctgattttttattttttaatatttttgtagagacgggtttcactgtgttgcccaggcaggtctcaaactcctaggctcaatgaatcctcctgcctccgcctcccaaattcctgggatcacaaacctgagccactgcccccaggcttatgatgcttttgccctctattttgttctaaagattttatagttttaggtcttacatttatgtctttattttgactttatttttatatacggtgtccaacttcattctttttgcatgtggatattcagttttcccagcaccatttgttgaatagactgtcctttccccattaaaccgccttggtacccttgtcaaaaatcattttactgcatatgcaagggaggagtattttttttttgttttttctgaggtggagtcttgcactgtcacccaggctggagtgcagtggcacaatctcggctcactgcaacctccaccccctaggttcaagcctcctcaagcgattctcagcctcctgagtagctgggtttacaggcacctgccaccatgcccagctaattttttctatttttagtagagatggggttttgccgtgttggccaagctggtctcgaactcctgacctcagttgatccgcctgcctcagcccctcaaagtgctggaattacaggcatgagccactgcgcccagccaggaggagtatattttaaaggatcagaaagtatcattaaataatgaaataaaatgtggcaacacacttaacattaataactaataataccaattggtcattttactgataatgccgatggatcacatcactgagtcttcatgccagtccaggtgtttacacctttgtacagtgtagaagtggggcaaatgcctagtggcaattacggcattcttttaatgagcatgtgtcctgtggactctcttaagagtgagagttatctgctgcagatgcaaaaagtttaactctccttccccacgccagccccatcttgaaccactcagcatggagttaggggaagagaactgatatttagtgagcatcattttatgaaacactttgcctttataatgtcatttaatcactgtaacaactcttgaggtaggtattcattatccttgtttttccaaaaaatgaaactaagactcagggagtttgtgtcctacacatgctctgatatttttattgttgatttgattgttttgtttactgtatccccacaccatattgtaagcttttaaaggatagagatcttgtcactgcttgatcctccatgcatagaatagtttctggcgtatagtagaaaccgggtatctgtttgtggaatgtgtagagtggcagagctgggatttaccctgagtacctctagttacagactctactttctttcacattatgctgtctccttggcattctagaacaggaaatcggcagctattttctcctttctcactagttcctgtttctctggacaattacctggacccaaaaccttaaaagatgtgtccagattttcttgctgtaacccacttgcctcttacctctttaaacccttccatgttcatgctggctgaccttctcttattatgaggaattatcttaaaaattaaaatgctgggagcaacctccttctattcccattctgaaaaagataagtaggacaatatcagcagcacgtgagccactgagccagctatcatgtagaatgataattctgtcttttttgtttggttggttttgttgttgttgttgttgtttttgtttttttttgagacagagtctccttttatcccccaagctggagtgcggtggcacgatttcatctcactgcaacctctgcctccctggttcaagtgattctcctgcctcagcctcccgagtagctaggattaaaggcacctgccaccacgcctggctaatttttgtatttttagtagagatgagatttcaccatgtcgtccagcctggtctcaaactcctgacctcaaattatctgcctgcctcagactcccaaagtgctggaattacaggcatgagccaccatgcccagcctcgataaatctgtcaattaataaataaaaattgatgtctgttaacaacaacaaaaagaatagtagatttgttatttgaagtatctctccatatagagaatgctattacagagaaagatccagaagaggtatcctagttaatcaaagagtacagaattttccatttttagggttagaatgcaaatccttttatggggttattactgtgaaccagcaaaaccatactgtcgatatgacatggtaagtattacaggtttccatttagttaaaaactagtatccttagttttgctaaatacaacttacaatattggaatatattcaagataacattagtttcagaacaggtctggatgttgaagactaatttgatcccctttcattttatcttttctttttaggtttggggcatttcataacaaatatccaaaataggtacaaggaacaatgtgaatggtgatgtgtgttgccataatacagttatcatttgctgtgtacattgtaatatactactttcttgtgactttttcccccgtacatattctgcttttgtatcttgggacttttgaaaactggagtggaatgaatttatttattttgagacagggtctcactctgccacccaagccagagtatagtgacatgatcatggctcactgcagactcaacttcctgggctcaagcagccctcccacctcagcctcccaagtagctgagactataggcatacaccaacacacctggctaatttttttgtattttttgtagagatggggttttgccatactgcccaggctggtctcaaactgctgggctcaagggatccttagcctcccagagtgctgggattacaggtgtgaactactgtgctcagctacttgggaagctgagatgggagggctgcttgagatgggaggctcgcttaagcccaggaggtcaaggctatagtgagccgtgatcaggccactgcactccagtctggatgacagagcaagaccctgtctcagaaaacaaaaaaaaaaaaaaacccaaataaatgtaaaaaaaataaaggtatcaggatgtcattctcaaattaatttgtaaatgtagtataatttcaggccatcacttctgtttcatttatctcattaattctaaattcaagtttttaatatggggtctacagattaccccatgggtggtcttcagggcttctgtctgaccttgaaactgctaaattttgtaggtacaaaaaatgtttattttagggtaatccctcattttaatcaaatttttaagggagtgtgtgactcaataaaagtttaaaaaccactgttttaggccgggttcagtgatacatgcttgtaatcccagcactttgggaggccaagacaggaggatctcttgcagccaggaattcgagaccagcctgggcaacatggcaaaatcctgtctctacaaaaaaaattttttttaattagccaggcatggtagcacacgcctgtggtcccagctacacagtaggctgaggtgggaaggaagatcccttgagcccaggaggttgaacctgtagcaagctgagcttgtgcagctgcattccaggctcgacaacaatatgagacactgtctcaaaaaaaataaaaataaaaaactccactattttaaatccttaggtggtttaatttttattttttaaattgtttttaggctggtgggccaccaaaaaaggggaaaccagctgcaccaggaggcgcagggaatactggaaccaagaacaagaaaggactggagactaaagaaatagtggagcctgagctctcggtcagtattaacacactgagcctgaaaatcatgaaccctgcaaagtgagaccaatgagaagactggagttctttgctgggttctacaacgtacagttaattgatattttttagcttattgaaactgccttggacaatctcctttatcaaagtataatagaagcctcagaaactatagcatacctatgggagtattcttttagttttggctggagtatgtttacgttcttgtcatctgttcccttaagcaattcctaattctaatatgtttttgtatcttacagatagaagtatgtgaagaaaaagcttcagctgttcttccccctacctgtatacagcttcttgacagcagtaactggaaagaaaggctggcttgtatggaagagttccagaaggtagtgcatagggaagaattgagtgtgaaagaaaattagattatatggaagcagcgaaattgatgaatgaaggatttgtcctaattgctgtgttttataaccggtgaacacgttttatggcattaaagatgaggtgggactttttatttcttgtagctgtgtagtgtttgctatctttaaacatcagtattctatggcctttataagctcatgacttaatacttaagaaaattagattcttattctgaattataaggcttagattatttttttattttttgagacggaatcttgctctgttgcccaggctggagtacagtggggcgatcttggctcactgcaagctccacctgctgggttcacgccattctcctgcctcagcctcctaagtagctgggactacaggcgcccaccaccacacccggctaattttttggatttttagtagagatggggtttcaccatgttagccaggatggtcttgatctcctgacctcgtgatccgcccgcctcagcctcccaaagtgctgggattacaggcatgagccactgtgcccagcccagcccagcttagattaattttttaactatggtacttgctcataaacttcctaggcaaataggtcactctacttaaaccacccctcatccagtactttttctcccctttatcatcatgattccttggtagaatggacattatccattggtatgaaaacctctcaaaaacctgtgttgtaaaggagcatggcagttcattttggcatataccgggtgattctaatgaggaacggtaaggagaaacactgcaagagcactgtcacttatggcagaagccgtctagtcctgcgtctgctgcccattgggtttagatctgagtttgtgcatctttgatattcggtactttagaacttcaaatctattctgctttgctgtttttaggaaaatcaaggaagagaaaatacatataagcagtttctgccacacactaggcaaatgaaaactattattttgcatggagcaaactatttgtgaattcctgaaatgtgagataaacgttcagtgatactaatttaacagccatataccaagcatctagcttaagaaataaagcattatagacataaaaacacaaagaaataaagcataacagcggaagctatataagctccctcaataaccctcctcagttctattccactcctttcttcagaggtaaccacttacttgactttggtatttactcttcctttggaagtaacctttaacccttaaactcttattctcttattttacttcaaggctgttgagctaatggaccgaactgaaatgccatgccaggcattagtgaggatgctagccaagaaacctggatggaaagaaactaattttcaggtattttaaaatgtgagatttgatgtcttttattgaagtaatttacattacatcatcctatggagtaatacagcagaatagttttcgtaatgatttttttttttttgagacggagtttcgctcttgttgcccaggctggagtgcaatggcacgaccttggctcaccacaacctccacctcctgggttcaagcaattctcctgcctcagcctcccgagtagctgggattacaggcacccgctaccatgcccggctaattttgtatttttagtagagacgcggtttctctatgttggtcaggctggtctcgaactcctgacctcaggtgatccgcctgccttggcctcccaaaatgctgggattacgggcgtgagccaccgcgcccagcttggtaatgatttttaatgaacaatggggtgtgtgcattttgattgaacacataactacagttgactcttgaacaatgtggtgattaggggtactaccccttgtgcagttgaaacttcacatataactctggactccccaagaacttaactactaatagcctactgttgccagaagccctactgataacatagtcagttaacatattttgaatggtacatgtattgtatattgtattcttacaataaagtaagctagagagaaaatgtgattaagaaaatcctaaggaagagaaaacatatttactatttattaagtggcagtggatcatcataaaggtcttcaattcccatcatcttcatgttgaataggctgaaggaggagaaagagtaagaaaaggggtttgtcttgctgtttcaggagtggcagaggcagaagaaaattcatgcataagtggatcttcgcagttcaaacccatgttgttcaagggtcaactgtataactttatataattaggaatttatatgtgtataaatatgtaaatatgtatacatccatatataatttgtataatttagatatatacatttttttcttctcatttttaggcctagaagcctccttatccaatctttacatattcaagggagaaataaacagtgagatagcttttttatttgataggataaaaaataagtgcagtccttaaattgccagtgaaaatttaccacataatcaattgtatagccccattaactgataatagagctgaaatttagcagtaccaagttattagtctaaggggtgggtatagagggaagtataggaaagtgctgcaggaaggaaaatgagaaaaagtttccttctctttttctagatgtacatacaatagacctcatgctaaacaaacttgaaatgtatcaggtttattattggcatcctgctagtctctttttggtttctcttctgctgccacctcttgttttctgtctaggatgtttagctccctcatacactgtgtgtcccttacattgtgttacatagcaccttattcgtataggccagctccacaaaggctaaatattctaaaagattcttgaggtgccctcttcctctcacaccaccttctttttttttgagaaagggcttcactcagttgtccaggctggagtgtggtggtgcaaacgtggctcactgcagtgttgacaccttaggctccagagatcctcccacttcagcctcccaagtagtcgggaccacaggcgtgcatcactacaccttgctaatttttttctcaaattcatagacagtatgaagtgtaatctcattgtgattttgattttcagccaccaaagactctctccttggttaacttaatgaccagctaatgactggagagattttcttaaatgccttgaaccaatgtgatctgtctcccaccctctgccaagggggaaggtgtgtatgtttgtgtgtgtgtgcgcgctgggtcatgccagagatactcaggcactttacagctttaccctggaattcactttttaagcaaggtcttgaaggtcagtcagagattagggcccttttcagtctttcctgggcatacacataaccttgaatattcgcatgaccttctagattctcaaagtcctctgtggatatcttattccctaggtccttttatgtttttgaccaagctgggttcccccagctggtattatggacttacacagttctgatgttagatgttaaacagttgccactcattgttttcgttgttttcaacaaaatccctggggatagggcttttcccactgagctagccagagtccagtcaaataacaggactttcaaatggagcttttctaggaagctgccagacaagacagtactttgggtcaaaactttttgaggaggtccaaacctgagctgtccccccacctgccagtggctgcacagctctaggttttcatagttgccatggttacaagacttcaggttttgaaggctactgtggagctggaagaaaaggggagcaaggcaagttaaatcaccagaaacctcactgtccttactaaaattcagcatcctttctttaaatggttcttgtatgttacaagccttatttaattttcagagttgtgagataagttgatttggatagtttttgccagtgttctttgttgcttttgaggaagatcagtttttcagaggtattgactccacaattgcagaagtcccacccaagataattacatttctttggtttgttttttggtttgggaattttttttttaattttttaaatttttattttttcacatgcctgctatgtcaaattttgggggtttgagacaaagtctcactctcttgcccaggctagatagtgcagtggtgtcaacatgtctctctgcagcttcagcctcctgggttcaagtgatcctcccacctcagcctcccaagtagctgggactacaggcgagggccaccatacccaactaatttttgtacttgttgtagagctggggtccctccatattgaccaggctggtcttgaactcctgggctcaagcattcccctcgactcaacctaccaaagtgctgggattacaggcatgagccaggcgataattgcattttaaaagaggatgtttgtgtggctgggcacagtggctcacgcctgtaatcccagcacttggagaggctgaggtgagatcccacttgagatccacttgaggtcaggagatcgagaccagcccggccaacatggtgaaacctcatctctactaaaaatacaaaaatgagccaagcgtggtggcgggcgcctgtaagtaatcccagctacttgcgaggctgaggcatgagaatcgcttgaacccaggaggcagaggttgcagtaagctgatatctcaccactgcactccagcctgggtgacagaacaagattctgtcaaataaatacataaataaatgggagtatttgtcacctaaattaatctgtataataggatttctagtggcgtaacaaaaaaagttaaaatattcacacagtacaaagaaaaatatttatgagcaaaggggtccttaatcccataggtctgccatcacaataatatctttaaattattttccacagatctttttattcttatacttaaaagccaacaagttctctaaaatctctgaagttctgtgttgcatgtgtgtataagagggttgtagtgtttttgtaggcagccctagtagtaattctcagttatgcagtcagtatagtaatttattgtgtattttagggtgtgtattcagtactaaatgcaaataatcataagaggaggaaaatttaaaaatcagatttttcaattaataaactttctgtgcaatattacttgttagtattttggaacactgagtagctttttttccctctcttcactgtcagttaagtaattggtaacaattaaaggatacaaattattttgcatatttgtttaaaatcctgattttactttagttgtgtttccagctgtccctaaccatgtcatatctgttacatgctgttaatacaagtaaataaataaatgtccttggcttgctcttagctttatgatactgatccttgttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttagtgacacagaagtcttattcctctagttttcccaattttttcccccaaactttaagcttactaattaaacattagtttttatcttctcaagtaaaatcttttttgatactgcattttttttgagatggagtttcactctgtcgcccaggctggaatgcaatggtgcaatctcggctcactgcaaccctcccgggttcaagtgattctcctgcttcagcctcccgcatagctgggattacaggcacctgccaccacgcctgcctaatttttgaattttaatagagacaggatttcgccacgttggccaggcttgtctcgaactcctgacctcaggtgatctgcctgcctcggcctcccaaagtgctgggattacaggtgtgagccaccatgcccggccctttgatactgcatttttatttttaccttaaaaaatactctattgcctagtgatgaaaattcatcttagtcaaaaatattcggtcagacacagaggctcacacctgcaatcccagcactttgggaggccgaggcaggaggatgacttgaggccaggagtttgagagcagcctggccaacatggtgaaatcccgtctctaccaaaaatacaaaaattagccaggcgtggtggtgcacacctgtaatgccagctactagggaggctgaggcaggagaatcacttgaacctgggagacagacgtggcagtgagccgagatcacgccactgtactccagcctgggcaacagagtgagactgtctcaaaacaaataaacaaaaaattctatagaaggtgaaagcccacgagcttgaggctgcaatgattgatgattgtgccactgtactcctgggtgacagagcaagaccctgtctctaaaaaaaaaaaaaaaacattataatgcagagtaattgctgcaaagctataaatagtccagaatgcctttagtcctactatcatttcacctcattttcttgtgtaggttcactcttgttcctaaggcattcttgcagttgttttagcgtcagaaaactagtttaatgcacatctgccttaatgtcatgctgtatttctataagaaatacgagataaaacacagatctgctgtttttcccttttcaggttgtgtcaatggctttctcacaaaagaatcccaaaaatcagtcagaaactctgaattggctatcaaatgccataaaagaatttggtttttctgggtaagtcagaacgaaatcaagtggaaaatagttaaatgttctgtcagtctctaagtcgtgctgtttataataatagctattgctgtttatttctgaagagtgagagctggattgtctcatttatataaaagaaaattacctttgttctcaaaggtctatattggcttgtgttcctgctttttgatgttcactgaaagagttctctacgttatttttccttaagcattaatagctgtcccacagaaaatccagttccaagaatttctagtcaaatacattaggaaatttctgtatataattacatttgtttaaagacctatagtatgccttggcgaattaactgctgtcagaaatcctgcaatagaagagcttgtttaactttgtttaacccactgttcccaaacttatttgcttatagagcacggttgtttatttaaaacaaaactttatacagtttactttatcccaggtacttttaaaaagcactttctaaatcataattcatttgatttaatcatcataacaactaagcgaggtattatattatccctatcttatagatgaggactaaggcacagaaagtttaagtaatttgggcccatcatagttaggaaagtggcaaaaccaagattttaatccaggcattctggtttggagaaagaatgatgtagctgctatactatgttacctttctctgtgccatgctacattttgcaacatgcctgttaatatcttgtaaaagggtattttgagttctactgattgaaaaaacactactctagaagttactcaaataacaaagaacggtttgttatgttattatctgtggtgttcgcccatagttgagggtattgttataattcctcttaattgtatagtctttgatataacacacatctcttggcatgtcacttataaaagccatatattttcctcttttttgttatgatctttcatttattcatttattaaacaattacatattggccactacaatgttccaattgtttgttccagtccttcagaatacatcatgaacgaaattaaatttctgtttcatgggagttacatttgagtaaagaaagataggtaataaacagttaaaaatatatatatagagagagagagacagagacagagaggcaggcaggccgggcgcggtggctcatgcttgtaatcccagaactttgggaggctgaggtgtgcagattacctgaggtcaggagttcgagaccagcctgaccaacatggagaaaccctgcttctactaaaaatacaaaattagctgggtgtggtggtgtacgcctgtaatcccagctactcaggaggctgaggcaggagaatcacttgcacccaggaggcagaggttgcagtgagccaagatcatgccattgctctccagcctcggcaacaagaacaaaactccatctcaaaaaatatatatctatttttttttacatatatatgtttatgtaaagcaggatgaagggttaaatggaataatgtggtatagtttagatggtgttgttttctatatagtagttgaagagttcttcctgaaaaaatgacatttgagtagagaccaggacatgagagagcaagctgtgataatcagagaggagcattctagaccaagggaagagcaaatgccaaaagctctgtggtaggagtacatgtgatgtatttaaaatagcaaggagtgtcttttcttcagaatgtagctgtaggacaatgagtgagtgggtaggaagtggtaggagataaagctagagaaagaataggggctaggtcatgtggggcctcaacattttgaataagttgggaaggcattaggggcttttgagaagagtaacaggttcatattctgactgttgtcagagaagacagagaggagatcaaagacaggaagacgaattagtaggctattggaataatcctgtcgagaaattctggtggcttggacatagattgtagaagtggaagtgttataactgataagatatttaaaaagtagaatagaacaagagagagacaagtcagggataacttcaaaaagtcaaggatagcctgaataactggaagaacaatgtggctctttactgaggtgtagaagactctgggaggaacaggttttgggactggagtgaggacaatcaggagtttggtttcagtatattagatgtaggctgtcttccaggcatacaaatggaaatatcacaaaggcagctggatgatgtgaatctggagttcaggagagagttcaagattggatttaggagttgtaattaagcataataggattgtcagcctatagatagtatttaaagctcactttaaagttagtgtaggaggctgggtgtggtagctcatgcctgtaatcccagcactttgggaggctgaggcaggcagatcacttgaggtaaggagtgcgagaccagcctggccaacatggtgaaaccctgtctctactaaaaacaaacaaacaaaaaaaattagctgggcatggtgttacacacctgtaatctcagctactcaggaggctgaggcatgagaatcgcttgaaccagagaggcagaggttgcagtgagctatcatgtactgtactgtagcctaggtgacagagcaagactctgtctcaaataaataaaataaaataaagttagtgtaggaagagaaaaagtgagaactttgccaaagggagccagtcctagagtctggctttataaaacgttattgagtattttgagggtttcatttgtttgcttttaattctaaatgtttcttctaggttgaatgtcaaagctttcattagcaatgtgaagacagctcttgctgcaacaaacccagtgagtacataacaacatatatagggcagtattgccatctttgtggatttaaaaagttattattgccatctttgtgatttaaaaagttatttttcttctgtctggcaggctgtgaggactgctgccataaccctgcttggcgtgatgtatctgtatgttggtccctctttgcgaatgttctttgaggatgagaagcctgccctcctatcccagatagatgcagaatttgagaaggtagaatttccacaaatgatacaatctgttagtggacttgagaatctcattaagactaaactgttgggtgtagtggtgcacgcctgtagtcccagctactcaggagcctgaggaaggaggattgcttaagtgcagatgttttgggctgtagtgtgctatgccagttgggtgtccacactaagttcagcattagtattgtgacctcccaggagctgagaccaccagttgcccaaggagaggtaaactggcccagatcagaaacagagcaggtcggccaggtgcagtggttcatgcctgtaattccagcactttgggaggccaaggcaggaggaccccctgagcccaggagtttaagaccagcctgggcaacaaaatgagaccttctctacaaaaaaataatcaaaaaattagccaggcatagtggcacatgcctgtggtcccagctacacaggaggccaaggtgggaggatcacctgagcctaggaggttgaggctccagtgagccatgtttgtaccactgtactcaagcctaggccacacagagagaccttttctcaaaagaaaaaaaaagaaagaaagaaacagagcaggtcaaaactccagtgcagatcagtagtgggatcacaactatgaatagccactgcactccagcctgggcaacatactgagactctgtctttctggaatgaagaatatgtatgtatttgcttttatgcacaataaagtatccatggaagagttcataagaaattgatgattttggccgggcttggtggctcacgcctgtaatcccatcactttgggaggccaaggcgggcagatcacttgaggtcaggagtttgagaccagcctggccaacatggcaaaactccatctctactaaaaatacaaaagtcagccgagtgtggtagcacgccctggaatcccagctacttaggaggctgaggcataagaatcacttcaacccgggaggcataggttgcagtgaaccaagatcatgccactgcactccagcctgggtgacagagcaagattctgtctcaaaaagaaaaaaaaaaatttttatgttttgtttgttttgtttttgggttgttttgtttgtttgtttgttttgaggtggagtttcactcttgttgcccaggctggagtacaatggcgcttcctgggcttattccaacctccaccttccaggttcaagcaattctcctgcctcagcctcctcagctgggaagctgggattacacgcacgtgccaccatgccaggctaatttttgtatttttagtatagacgaggtttcaccgtatcagccaggctggtcttgaactcctgacctcagatgatccacccgccttggcctcccaaagtactgggattataagtgtgagccaccacaccctgccttctagtaggttttgtataaaaataccttttgacatatggtctcaaaattgtaatctaggtagtagtcaaattacctactgtgtaaataggtattacaaaggaatgagagtttgacacaggcaccctctctaatttgtttgttcccatatcctatataaatttcattagccttactcattcatttgtgtatagatgcagggacaaagtccacctgctccaaccagaggaatttccaagcatagcacaagtggtacagatgaaggagaagatggagatgaaccagatgacgggagcaatgatgtcgttgatcttttgccgaggacggagatcaggtaggttccagtctgtgaaatggtttatttcattcattgtattgaattcagaatgttgtcttctttttgaattcagtgaggggaacttaacgtgatatcatcatttttttggagtctggaattaaaggttattttctgtttttcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtatgtagagcatacggctgttctttttatctcccctccccactgctgcaggagttaccttttcagtgtagccttcacttgcaaaaaataagtggttactttatttgctttgaactagaaatagctgcctttaatttattaagtgtatctcaagatatgatggtagttggcagatttattcatcaaatttttatgagtctcagaatttgctttttgcaggaatccaatattgaatatatttgtataaaactgcttgtaatacatgtaaacataatgatttctgatttttaaatgtggatttttatgtcaggatttccttaaactaggttttaccttaaagttgtaaagtactatgatctctggtctaaaattctgataatctagttttacgaactgatgataaaaaggccactgcctaaaaattaattagaataatctaagtcgaatagcatgacaagccagtgtctctgtctcttgagtaggccaaaaatctcctgctgtattgacagtatagcagcaaatttacggaagtttgcacacaacttgcttatcgtttcaacataaagtattggctctttccactcaggtacagcaaacgctgaatatcctgcaacaactggcagtagccatgggcccaaatattaagcaacatgtaaaaaatttaggcatccctatcatcacagtccttggagacagcaaggtaaacctaactcttttcaccatgcctccattctggaataggccagccatatttttgggttaaagataattctctttttagagtcatgtaaagacctgataaactttataaagatgaaaatattagaagaaaaacagtaaacatttttatcttccaggcagtattaaggtgaccaggtatcacttattagttttgtgacttttagataagctatctttgttgagggtcagtttctttatctgtgaaatttctttcttacagaattaaatgagtctgtatgtaaggtacattttattgtgcctgtctcatatagtatgcacacaataaatggttgctattatgattataacgtaattgtgtaacattttgctatagtgaataaatatgtgaatttggagttcattaagttattttctacttttatttttctgaactattagagtgggatcttctagtagttcagcaagatatttgtagtttcatagttctagaagtcactgaaatatcattgaaggttacaatgtttagccgtagactaaatatttgaatatctctatactgttgtataatttatttaacttgaggaactttatttaatataatttgtgcttttaatattaatgtaaattaatataaaaatataactaattttcagtcaatttattagcagtttcagtcttaaccattatgatgtctttaacatttagaatttcattctttagcagacagacatggacgtaaatgcccccaactactcaggaaacaaaatataagagttattcttcttacatgatattttatgcccagatcactcactgttttgcctgattaactgagtacacaagttttacaatttggagttttatatttctactttactttggagttttagtacaatcatagaactagtttctgtttcagagaagatggtttcatgtatgttcatgtgggccttagataaccctccattgttcatgttcataaagcaacagtgatcaccccctacctccaaactgtagtagatattatttttgctgattatcttctccatttagaacaatgttcgagctgctgccctagcgactgtgaatgcttgggcagaacagactggcatgaaggaatggctggaaggagaagatctttctgaagagctcaaaaaggaaaatcctttcttgaggcaagaggttagtatcataaattaatcatgtgcattactcatgtcatttacttccataggggcttgggcctgtctgataaatacgcatttatggttagaatgagtttcattataaaacagttaataaaatgaaatcacattcctggggcctttgtattcatgtgcttccattttttcctttcacatgcttctttatcaataacgctttttagaggactaggctttttgtggaatttttcccttttcttaaacatttaaatggtaaaatcagaggttttgtgttttttttattattatttaagctctgggatacatgtgcagaacatgcaggttcgttacatgggtatacatgtgccatggtggtttgctgcatccatcaacccgtcatcttcattaggtatttctcctaatgctatccctccccttgccccgctaacccccgacaggccccactgtgtgatgttcccctccctgtgcccgtacgttctcattgttcaactcccacttacaagtgagaaattgcggtgtttggtgttctgttcctatgttagtttgctgagaatgacggtttccagcttcatcaatgtccctgcaaaggacacgaactcattcttcttctgtggttgcatagtattccatggtgtatatgtgccacattttctttatccagtctaacatgatgggcatttgggttggttccgagtctttgctattgtgaatagtgctgcaataaacatacgtatgcatgtgtctttatagtagaatgatttataatcttttgggtattacccagtaatgggattgctgggtcaaatggtatttctagttctgggtccttgaggaattgccacactgtcttccacaatgattgaactaatttacactccagccaacagtgtaaaagtggttcctgtttctccacatcctctccagcatctgttgttttaatgatcgccattctaactggcgtgagatggtatctcattgtgttttgatttgcatttctctaatgaccagtgatgatctttttcatatgtttgttggccacataaatgtcttcttttgaaaagtttctgttcatatccttcacccactttttgatggggttgtttgtttttttcttataaatttgtttaagttccttgtagcttctggatattagccctttgtcagatggatagattgcaaaaattttctcccattctgtaggttgcctgttcactctgatgatagtttcttttgccgtgcagaagctctttaatttaattagatcccatttgtcaattttggcttttgttgtgattgcttttggtgttttagtcacgaagtctttgtccatgcctatgtcctgaatggtattctaggttttcttctagggtttttatggtttaaggtcttaggtttaaatctttaattcatcttgagttaatttttatataaggtgtaaggaaggggtccagttcagttttctgcatatggctaaccagttttcccaataccatttattaaatagtgaatcctttccccatttcttgttttttgtcagatttgtcaaagatcagatggttgtagatgtgtggtgttatttctgaggcctctgttctgttccattggtctatatatctgttttggtaccagtaccatgctgttttggttactgtagccttgtagtataatttgaaatcaggtagcgtgatgcctccagctttgttctttttacttaggattgtcttggctatacaggctcttttttggttccatatgaaatttaaagtagttttttctaattctgtgaagagagtcattggtagcttgatgggaatagcactgaatctataaattacttcaggcagtatggccattttcatgatattgattcttcctatccatgagcatggaatgttcttccatttgtttgtgtttgttgagcagtggtttgtagttctccttgaagaggtattcctaggtattttattttctttgtagcaattgtgaatgggagtttgctcatgatttggctctctgtttgtccattattggtgtataggaatgcttgtgattttcgcacattgattttgtatcctgagactttgctgaagttgcttatcagtttaaggagttcttgggctgagaggatggggttttgtaaatatgcaatcatgttcatctgtaaacagagataatttgacttcctctcttcctatttcaatacccttatttctttctcttgcctgattgccctggctagaacttccaataatatattgaaaaggagtggtaagagagggcatccttgtcttatgccggttttcaaagggaatccttccagcttttgcccattcagtatgatattggctgtgggtttgtcataaatagctctaattaaaatcagaggttttaatcagaacataaaaatagaggctgggtgcagtgactcatgcctgtaatcccagcactttgggaggccgagcaagcagatcacttgagatcaggggttggagaccagcctgcccaacatggtgaaaccctgtctctactaaaaatacaaaaaattagctgggtgtggtggtgcgggcctatagtcctagctactcgggaggctgaggcaggagaatcgcttgaatccaggaggcagaggttgcagtgagctgagatcacaccactgtactccagcctgggtaacagagcaagattccatctcaaaaaaaaaaaagtccagttgcagtggctcacgcctgtaatcccagcactttgggaggccacggtgggtggatcacctgaggtcaggagttcaagaccagcctagccaacatggtgaaaccccatctctaccaaaaatagaaaaattagctgggcatggtggtgggcacctctaatcccagctactcaggaggctgagacaggagaatcacttgaaccgggaggcggaggttgcagtgagccaagatcgcgtcattgcactctagcctgggcaacaaaagcgaaacttcgtctcaaaaaaaaaaaaaatagaacattcaaaaatccatcagagtaatcataacaacagaataacaaaatttgtgattatatcaactgatgcaaaaaaggcatttgacatatccaacatgcattcatgattaaaaactcttagcaagtcagtaatgaaagagaattacctcaacttgatataagcatctgcataacaacctctacagataacatgaaacttaatggtgagggccaggcgcggtggctcacgcctgtaatcccagcactttggaaggccaaggcgggggcagatcacgaggtcaagagatcgagaccatcctggcaaacatggtgaaaccccgtctctaccaaaaatacaaaaattagctgggtgtggtggcatgcgcctgtagtcccagctactcgagaggctgtggcaggagaatcacttgaacccgggaggcagaggttgcagtgagccaagatcgtgccactgcactccagcctgagtgacagagcaagactccgtctcaaaaacaaaaaaacaaaaaaaaaaaagaggaatcactttacaattagcttactatattgctaatgtaatcaagacactgtgatagtggtagcaggaggatggggtggagatagacacgtagatcattggaacaacagagagaacccagaaatagacccacactaatatcaactaattttttacaaagctacaaaaataagtccgtgaaggaagtatagtcttttcaacaaatgattctggagcaattggacatccataaacaaaaaaatgaacctcaccctaaacctcactgtctcaaaacagattatggacttaaatttgaaacataaaactatagaacttttaagtgcaaactagaaaatctccaggatgggaggctggcaaagaattcttagacttaaaaccaaaaccataatccataaaaggaaagttgataaattggaccacatgaaaattaaaaacttttactctgcaaaaaaaaccacatgaaaataataaaacaagctacagaacaacagaaaagatttgtaagccagtatccaataaaggactaatatctagaatatataaagaactctgaaaactcaacagtaacaacaacaacaacagaaaaatcagaaaatgggtatccatggccaagcctgtgagtagtgagctgagatcatgccattgcactccagcctgggtgacaagagcaagacttaatttaaaaaaaaaaaaaaaaaagatgctcagtgttattagcaaccagggaaatgcaaattaaaactgtgttgaaatatcactatacaatcatcagaattgctaaaattaaaaataatggtaacgtgaaatgctggagaaacctaaacagtcatgcattgctgctggaaatgtaaaatggtacaactacttcaggaaatagtttggtattttcttataaaactaaacgtgcagttactatatgagccagcaattgcactcttggacatttatttcagaaaaatgaaaatttatatccatacaaaaatctatgtacaaatattcataacaacttcaatcatagtagccaaaaactgggactatagctcaagggtagagcattttactgcataatagccaaaaactagaaacagttcagatacctttcagtaggtgaatggttaaacaaatctcttgtacatccatacatggaatactatttagcaattaagaacaaactgctggtaaatacaataattcagataaatctccaaggaattgtgctgcatgactaaagccaatcccactggcctgcgagccaagattatgccattgccctccagcctgggtgacgggagtgaaaccttgtctcaaaaatgaaaaatacaaatatgaactattttagggatatagagaagaaaaatgtcaacataaggcaaaaaataagaagtcttggtaaaatttgtaaccttctgatcacaataagtgctttgggtcttctagctaaatatttttcagaactaaagggagataagtaaaagtttttcatctttaagatgtattaaagctttataatttaatacccaaatatagtccaaagaaatgtgtccttatcttaaagatgattgtcatcattgcatatgttatttaaatttagcacagttcttgaattatgaaaagtactgatttcatattggaaagttatagtgtgaaagctaattcagtgcttgagactaatgaaatcagtaagcctgagatcataaatgataacagtcttcatttgaagtgtgtaactagtctttatttcttttggcagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaaggtactacttcttgttgctgctactgctgttaaaagctattaaaaaatatatttaacatgggcctggcacggtggctcacgcctgtaatcccaacactttgggaggccgagacaggtggattacctgaggtcaggagttcaagaccagcctggccaacatggtgaaaccccatctctacaaaaacaaaatttagccgggtttggtggcacatgcctgtaatcccagctacttgggagggtgaggcaggagaatcgcatgaacccaggaggcagaggttgcaatcagctgagatcgtgccactgcactccagcctgggcaacaagagagaaactctgtcttaaaaatatatatatattaaacatgaatttatatgaggaaaaaaccatattacctcctgtgagtctcaatttgaaatcgtaacaagcaaaaataaaatattaagcagtgtagaagtaaaaatctgctgacctcacaggggtgaaaactgtgaccttctagaatgatacctaccttagtgtgacttcataatgtgtgtgacttctctgacaccatgtactgcctcccttacttcagtggtatttcaaaactaggagctcaatcatttgtttgacagaggatttgttcataagctttgtatgactttatcatttatgtgacctctcactttttatgtcattttgtctctctagccaacttctaaagatcaggtattggccatgctagagaaagccaaagttaacatgccagccaagcctgctccacccactaaagcaacttctaaaccaatgggagggtccgctccagccaaattccagcctgcatcaggtaactctatcttaagaaggttaaaggggaaggaaatagccctgaggaactctaaaaagacattcagccttgtcttttttaaatcacatttccttacagcgtagatccaagctctccttccttctctgcttactttcctttcacaaacacttgtcaagtagtcaagtacctattttatgccaggaactgtactaagggtacaaacgtgactaatttggtttctaattctaaaaagttttttttgtttttgttttgtttttttttttagagatggcatcttgctctgtcacccaggagggagtgtagtggcgtgatcatagctcactgcaacctcgaactcctgggctcaagtgttccttctgcctcatcctcccaagttgctgggactacaggcatgcgccatcacacctggctaaattttttactttttatagagatgaggttttgttgtgatgcgcaggttggtctcaaactcctggcctcaggcgatcctcccatctcagtctcctaaagtgctggacttacaggcttgaaccaccacacccgatcccaaaaggagttttggaatagtacattaaaatagtcctttctgaagtgttgcatcctacatttccacaactattttctgctcctggatactataattagaagaggaattgggagaatctagcttaatccactttattaaccttctttaagggataattcttgatttctttatcctgatattaaaattccataataggctgggcacagtggctcatgcttgtaatcccagcactttgggaggccaaggccagtggatcattgaagtcaggagtttgagatcagcctggccaacatggagaaaccccacctctactaaaaatacaaaaattagctgggtgtggtggtgcatacctgtaatcccagctactcaggaggctgaggcaggagaattgcttgaatccgggaggcagaggttgcagtaagccaagatcacgccagtgcactccagcctgggggacagagcaagactctgtctcaaaataaataaataaaaataaataaaatttgataatatataacctgtgaccaattcatttttagacttactgcttaaacaaaacaatattcttgaatttagtggaatagaaattgttgatgctataaagttagaaattttacagcctgagcaacatggcaaaactccatctctacaaaaattacaaaaattagctagtcttggtggcgcacacctgtggtcccagctacccaggaggctgaggtgggaggatcgcttcagcccaggaggttgaggcttcaatgagccacgatcgcaccactgcactccagcctgggtgagccagaactagtctcaaaaaaaaaaaattttacctgtgtaaaactctttattaaagtacatattcagtttttattgaaatcttgctatgtagcagatactgaatatcaaagatgtctttacctttaagaaagtatcagtctgggctgggcatggtggctcacgcctgtaattccaccactttgagaggacaaggaggtcaagaccagcctgggcaacatagtgggaccctgtctctaaaaaaaaaaaaaaagttgttttaattagttgggcttggtggtgcacgcctgtagtcccagctattcaggaggctgaggtaggaggactgttttagccagggaggtcaaggctgcagtgagccctgaacgtgctattgcactctagtctgtgtgacagaaaccctgtctaaacaaacaaatgaaactacagtttaaatgttggtaaatgagatacagattttctgaattaatttctctcttacgcttaaagattttgggagaaaaattattaggaaaaaaaaatctaagccaggcacagtgactcacgcctgtaatcccagcactttgggaagccaaggtgggtggattgcttgagcccaggagtttgagaccagcctgggcaacatggcgaaaccctgtctccacaaaaattacaaagaaaattagctgggtgcggtggcacgggcctgtagtcccagctactagggaggctgaggtgggagaattcattgagcccaggaggtcaggactgcagtgagcaccgtgaaggcaccactgtactccagcctgggagatagagcaaaatcctgtctcataaaaaaaaaactaactgaaaacatcttataaattgatacatttaagactgcaagcttccttgtcatcattatatatttaacctgtccaaaataaaatgatattagttaaagtttatagtatatatatatttttttcctcaaagcacctgctgaagattgtatttccagcagtacagaacccaaacctgatccaaaaaaggccaaagctccaggattatcctctaaagcaaaggtatgttaactctgtatacttcgatgtagacttgcttttaaatatattttatatactgagtcattctattaggaaggatcatattatatataaaagaacatcactgctgttgatattatcaaattatttatacaaatttctgtggttcatttttaataaggtcctaaaacggagacatcctgctctcaagaggtgctgtcatcttcctttcatgtagattttcggggaaagatttactttattgaaagaagaaagggccgggcacagtggctcacgcctgtaatcccagcactttgggaggccgaggcaggcggatcacctgaggtcaggagttcgagaccagcctggccaacatagcgaaaccctgtctctcctaaaaatacaaaaattagttgggcatggtggcacacctgtaatcccagctacttgggaagttgaggcaggagaatcgcttgaacccaggaggtggaggttgcagtgagccaatatctcgccattgcactccagcctggatgacagagcgagactcaggaaaaaaaaaaaaaaggagaaagcatttgtagctctggcataataaacactttaggctgatttggatttaagaaaaggaagttaaatcaacctccttcaaatttggcactgttgtcatcatattagaagatgtttcggttagtctgcagggaaatatcttttgtcccagtgggatttattttgatgcatcagcaattctttcaatattcatggagagttggacaatttaaagcagtgtgttcaaatgttcaactttatcctctgggtgattttttcatttaattaagttttaaaatcacagtaaattgtcattatctctatcaagattgagattaataaacatattcagagtgttaattatttaacacttacaaaaggaaaattgcaaaactgtgcaatgggtaatgaatctaatagtaagtctaaatagagaattatttaatttacttcctgtaattgatgaaaaaatatagagaatgttttttaaccagtacatgtattattacacccccattttggagtacacactctagggcctttcttctaaatattacaattaaccatttttcttccctatgctcaggccctttaactcctcagtgaattaatttaaatgggtaattatcttcaactatccaatgacgttgttcttttcctgtctgcctgtcctcatcccaaatttaacaagtgcttattttagtttagatcacgagtgttttgcagtatttttgactccgttcttaatgccataatttttttcccaatctttttaaacttacgaagcagtttcatataaatgatctcatatttgtttggtctgaatgacattagtgtttatactagaaagaaattgtggccaactagaaatagtggccatgctacatttataataataatgattccagtaatgaaatttgaattttaccttaaatatgtgtactattgtttactattttctttctatctgatatgaagattttaaatcttggattattttttaaaaccactttagtgacttaaatatttaaagcatttcttgtaactttctctagaagcaagttcaaaaggtcttcagttacactgttatgataagagatacatttaaatatcaatggaaagaaacagaaaagctttcaaactaagtgtttggaaatgtgtaaatgccattcaagatgtcattaatggctgaggtgggtggatcacttgaggtcaggagctcgagaccagcctggacaacatggtgaaaccctgtctctactaaaaatacaaaaattagccaggggtggtggtgggcgcctttggtcccacctactgaggaggctgagtcaggagaatcacttgaacctaggaggtggagattgcagtgagctgagatcacgccactgcactccagcctgggcgacagagtgagactccgtctcaaaaaaaaaaaaaaaaaaaaaaagatgtcattaatatggaaagctataaatagtgttgaagatttcaagaaaacaaaaacaaaaagtttgtgacctagactaatgatcagtaatagcagtttttccaactacataacatgccagtccaagaactaaccaacagttacttaagaatattctcagaaaaatttctagagaacctgttcaaaaacatatacaagattctgtgatgcatgtttttttcatgtgaaatatcacgtagaaagatatctctgttttctacagtgcccttttactgggcagcagcatcatattcttaaggagaagtggccaagctaatcagtattccctgaaccttggttgtagagtgcacaagggaagaagatgccaagcaaaaccagcttaaaggaggatgaagacaaatccgggcctatttttattgttgttccaaatggaaaagagcaaaggatgaaagatgaaaaaggattgaaggtaaggaaggattaagaatcgtcaggagatttttgcttgtattgttattcaagaatagttttgctgtctgaattcatgttattgtttaatatctaggaattaagtgtttcttttgcttataaattatattatttagtttatgggagcattaattcctacaaaagaaactatagaatagagttattgcctatttttccctgtaaatagaaataaatgatttagtagcttttttggtatcttcattgatttttttttttaattaattggatgtataagcttcttcattaatccttctttttaagaccttacaaggcagactttgtgactgtataaatggctagttcagtcatttatgttactttgatttcattagatacttaaatttgttttcaaaatacataatcttttttaaaaattatatgcagtacagaaagtgcaaagtatagtaagaaaagcatgtctctgttccagtatccctccacagggaggatattagtcctcattttttcaatgtattactccagaaatattttatacctctactatcatatgtatatttttatatagccctccttttatacagatggcatatacagacatgccgtactgtttgttctgtatctcactattttcttttaatgatgtttgaaatatctgaaagatcattcgtatctgtgtatatatgtgtgtatcactgtttgtattggtgcattgtatgtatgtacctttctttatccttcgcccactatgttggacatttaggttgtttctggtctttcactattacaaacactgctgctgtgaatatctttgaatgtaggtctttgtacacatatgtgagtgtatctatattaaactcctagaatgatgatatgcataattttgatagatatttcaaattttctctctatcaaagatgtggcagcagtgtccaccatgttatatagttatatgtaggattaattttttttttttctttagtaagaattgcaaggccaggcacagtggctcatgcctgtcatcccaacaatttgggaggctaaggcaggcaaattgcctgagcccaggaattcaaaaccagcctggacaacatattgagacttcatctctacgaaaaaaattttttaattagctgggcatagtggtgcatgtctgtagtcccagctacttggggggctaaggcagaagaatcacttgagcctgggaggttaatgctacagtgatctatgatcatgccactgcactctgccatgcccaggcaacaggtgagactctgtctcaaaaacaaacaattccaaaaatttttattcctagaagattttcagagttgttaagcttcaagaagtatgacaccttgaaatttgcattcatatttaattacaaatgaatattgttgaatttttaaatattttattgttcctgcagctgcattatataaggctctctacctcatttcagttgaacaccctgtagccccttttcaccgtttgttttttccaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatgtaagtctgcaatagataaatatacatgtatttcagacatgtaaaaataccgagccctatgaaataatctgaagtttgcatgacttggaagtagaatatactatgttctctatttttagagctgtcttgttatttggtagaataaatgaatgtgtgtgtatattttttaggtcttaattgaaggcttaaaaatctgtcattttctttttgggctccaataaaatttaaaagacacttgcctagtagaattaagattttgattattcttatttgtgggagttttgttttgttttattttaagcacttggagagtgaaaaagaaggagttattggttgcctggatcttatcttaaagtggcttaccctgaggttttttgacaccaatacaagcgtcctgatgaaagcactagaatatttaaaattgctcttcaccttgctaagtgaagaagaatatcatcttactgagaatgaagcatcttccttcatcccctatcttgtcgtcaaggtaatgtggtgttctctctctgggagactgcttaagttcccagctgacctcagtttctgtacttttatttcctctcccttttttactgattatatcacggtaccttccctacttatccctatttccctattctttcaaaacatagtaatgcatgggagaatcattgctacttaggaaatgcctcacttaatcattattttccttatcgactaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcaggtgaagcaaacagtttaaactgagatgtgaatctctgcagcagtagcctatagaagaaatagtttatagatgaacaaataaatttctccagtgcctatgtagttgattccaacctcctgatttagactgtgagagtgatgagttgcacactggtggagccatggtatcaggtgatacaggcaccactcagtatcaccctggtgacaaaatcaagtgcacaggggccatctgactcacaggcatctcttcctttcaggagcacttgctgaaataccattttttcactgataaaaggcagtaaacaaaaaatcctaggcagagccagagtaaggttttagtccttcatatatgccaagggaaatttctctagtaaggataagtctctgtcccaaatatgtgttgtctcattaatctagcctttctcccccatcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatgtgagtgacttctctgaacactgtcagcatgtcgtgaaaagaattgcaagatctcctaggtgttaggtttcctgtcctctcaactgtagctaagtttttactactttttagtcaactcaacctatcaatgtgtcctagaatccagatagacccttgaggtgtctctgattaggctgttttaatggaaatcaagttttcttttctgagcattctattcatagcaaatttgctttagaaatgagtgctatttttgaatcaagaaatctgagctagtcccgggtttaaattctgcctggcagtctgctctgtaatttttactgcatcgagtttttggttaaaaagtgcttatttgtgtatagtgtggatgctagtatctgtcagatcacatcttgcgctacagccgtgagccagtttttcactcacattaggttctgcctctgacctcttatttcgtttgagtgagtctggacctccgtcttcagttacctcatagtgtcaccatgtatttacacagggcttaaatatgtttacttatattttctaattaaattctcactactacccagtgaagaatataaagcagttgggaattttacagatgaccaaaaatgaagtttcttgcccatagtcacacagctagatagtggtgacaaaacaaaaaatgaggaagcttcatttaatttttgacctttttatttgtagttactaattggctttcttttttttatcgtttctttttttttttttttttgagacagggtcttgctctgtcacctaggttggagtgcagtggtgtgatcatggttcaccgcagcctcgacctcccaggctcaagtgatcctctgacttcagcctcctgagtagcaaggactacaggcgcgtgccaccacacccagcttatttttatactttatgtatagatggggtttcaccatgttgcccaagctggtgtcaaactcctgggctcaagtgatcctcctgctttggcctcccaaagtgctgggattacatgcatgagccactgtgcccagcccctctccttctttcatatctcctcttcctatagcagctaggcaggtattaatagtagttgattttgaaatgtggtgctttgaaagtaaacatgtcctaacatagaaggttctatttgttttgatatgaaaatagatattattgtgttatccagttaggtttctaaatttggcctctttacagctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaagtatgtagatagagatacttgtctgagagcatctccatggcctttgccttgtgtgctcacagcctgtcctgtaacataatcttgagttcttgtagccattatcatgcatgacagagtgtctgggtaaatgtattgtaaccaaatgtttgattcttcagtcttcattgtctttgtctttgtctcaaaaccacttctaaatggtcttgtgccttctttcactgcttttccgtggacagaattatgtatcgcacttataggatgtaagtactgcctgctaatttctcattagcagggctcttatatctttctaacttctgacttggattcatcccctctggagggtgactagcttagagtttataatcagggtagagggtgtccataagtaccccatgaatcaagtcttccacaaaagttcaatgtcatgtggctaaaatactgattcactttcttctttgtgttatacttggttgtgcttagtttcctattcttgagataaggctaattaaaatacatgcaacccaaaattggcttagggactcaaaatactgcctcctaagcaagacagctctattttgggttgtgtcatgagtataattttaacgaacttgaatttggaaactttgaatccctatttcttggatgtaaagctggccctgacctgtcaagagtgaatattctaaaaaggggtgactggtggtctcacaaaatataaaatgtgctgaacacggcatggaatggtacttatgattagcaaaattaaagcactggttaatttggtggaaaagaaccagccagtctaaatttttcttatatatttgctcataagtagtgaactttgagtcaatacaaatatattttattgttttctgccccttcaggaatagaaatacaaggtttgttggctttagtgaactagaacaaatacttataacttggcaggtaatgtaagtacaaattaaagttatctgccctcttaggatattcatgaaccaatgttgttacctattaaaggcacttgcttagactcagggacttaaatcattcaggggggctgaaaccagaagttgaacatctgtcctgaagctttggggcaactgacagtgctactcttgccctttggttaagaagtctcttttagttcaggagcctccttttgcttcccttagccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagtgagttaaactctttcatttaaatatgagcagttcatgatgatcagacggcctacgtgaaatgtgccctttgtaatgtgcagttaaaactttttagaactgattattttttgaatgatagcagttgttaactaagacctggacctagtggagaattgtataactccaactgactgggatgtcttgtaatagaggttgaagttttctctttgttctgctatctaggatccgggctgtttctccacacttcgatgacatgcacagtaatacagcatccacaatcaatttcattatctcccaagtagccagtggtgacatcaacacaagtatccaagctctgacacaggtaatgggtgtgctcccgtgacagggattccattggtggacatagaggctataaatgtgatgaattgcacactcgcagagtcatagcattaggggatgcaggcagtgtttcatactttcccgaggaaagaaatgcacaggtgccactcagtcatcacttgcctcagaggatgtgactctaatagagccttatttttttttttttttttcctcttttgagaccaggtctcactatgttgtccaggctggagtacagtggctattcacaggcactatcatagcacattgcagccccaaactcctggactcaagtaatcctcctctctcagcttcctgagtagctgggacaacaggcttgcatcactgcacctagctaagccttgcattttttataattgcattgattcaccagaggctagagataaaacagcagctaacaagtaaggaccaactctcatggaacttatttagattttagtggacagagacaagtaaacaagaaaatatcacacagttgtaacaactgtgtaaatataacttaaatggggtaatgacggaaaggaagtgagtagatacttagactgggtgatcaggaaaactctgatatccttggggcttagagtatgccaaggagaggaaagagctagtggtcaaaggccttagggcagaaatgagcgtgaagttcaaggaaataagagaaggttcatgtgcctggagcatagtgttaaagggggacaatgatacagaatgagatttgagaggcagacagtgatcatatcatgtagggctttaaaagcaccagggtgagttgtttggattttatttcaattatgataggaaaccattagaaattttttaaaagagaagtcatgggtgggtatggtggctcctgcctggagtcccagctgctcaggaggctgaggcaggaagattgcttgagcctgggaggttgaggctgcagtgagctgtgattgcaccactatactccagcctgggtgacagagtgagaccatgtctcaaaaaaaaaaaaaaaaaataggccaggtgtggtggctcacacctgtaatcccagcactttgggaagccaaggtgggtggatcacgaggtcaggagttcgagaccagcctggccaatgtggtgaaaccccgtctctactaaaaatacaaaaattagctgggcatggtggcgcacgcctatagtcccagctgctcaggaggctgaggcaggagaatcactttaacccaggaggcagaggttgcagtgagccgaaatcgtgccagtgtaccccagcctgggtgacagagcgagatctcgctccatctccaaaaaataaacaaataaataaataaaatttaaaaaataaaaaataaaacaacccaaagtgaatcaacaacaatgtgacaaaatgaaaatttttttgtaattttttttttgagatggagtctcgccgttgccaagtctggagtgcagtggggcgatttcagctcactgcagcctctgcctcctgggttcaagcaattctcctgcctcggcctccctagcagctgggattacaggcacccaccaccacgcccagctaatttttgtgtttttagtagagacagggtttcaccaggttgaccaggctggtcttgaactcccaacctcaggtgatccacctgcctcggcctcccaaagtgctgggattacaggcgtgagccactgcgtcagggtgataaaaggaaattatgtgctacactgataggatccagtgacagttccacatcactttgctgataattctaatgttgcataacctgaatcatgggaaacatcagagaaatacaaattaaggacattttataaagattcaaggtcaaagctgggcgctgtggctcatgcctataatcccagcactttgggaggccgaggtgggcagatcacctgaggtcaggggttcgagaccagcctgaccaacatggagaaaccctgactctattaaaaatacaaaaaaaaaaaaaaatagccgggcatagtggcacatgcctgtaatcccagctactccggaggctgaggcaggaggatagcttgaacccgggaggtggaggttgctatgagccaagattgtgccattgcactccagcctgggcaacaagaatgaaactttgtctcaaaaaaaaaaaaaaaaaattcaaggtccagaaagtcaaggaaacactgaagaactgtcctacactataaagagactgagagacatgacaggtaaatgcagtgcatgattctcgactggtcttttgctttaaaggacataattgaggtcattagagaaaatggaatggggtctgaggattagatggtagtaacatcaatgttaatttcttgatgttgatggttttattgtacttatgaaggagaatgtccttgttgttaataagtataccctaaagtatcagggtatggaacatcagattgacaacttactcttaaatgattcaggataaaagagttcctttactaccctttcaacgtttctgtaatgtactttttttttcacctttgcaggttttttgtttgtattaattgtggaagaaattactctggctgctctagagataagattatatgcatggcaagagtgaattcagcaatttttttaggaagttgtggccaaaatttatatgaaagatattatgtgccactaggatgataatggtgaagaggaaggaagtcatggtttcagggtttcttttggaagtagaatccacagaacttgccaatagattagatataaacaatgccttattatcattagtgacaaccagtgtactgcaacagaacactggaccagtatgtgagaaagctgagtttttgagtttggaccagtagtctgatctttctgagcctcacttttcatctgttaaatggagatcttaatatcagccctgtctgaagagtctaaaaagcactctttttaataaattgaacatttaaacataagtatttttgttttgtttctgagacggagtctcgctttgtcacccaggctggagttcagtgtcgtgatctcggttcactgcatcctccgcctcctgggttcaagcaattctcctgcctcagcctcccgagtagctgagattacaggtgcctaccaccatgccaggctaatttttctatttttggtagagatggggtttcaccatgttggccaggctgatctcctactcgtgacctcaagtgactcacctaccttggcctcccaaagtgctgggattacagatgtgagccactgtgcccagccaaacataaggattattattccctgaactagacaatgagcctcttagaatcgaacctgtgactaatgtatctagtatcttgctcagtaaatatttgccgaatgactgaatccctaaggactagttatttatatttaaatggggccaggtgcggtggctcacgcctgtaatcccagcactttgggaagccaaggtgggtggatcacgaggtcaagagttcgagaccagcctggccaacatggtgaaaccccgtctctacttaaaatacaaaaattggcgtggtggcaggcgcctgtaatcctagctacttaggaggctgaggcaggagaatcacttgaaaccggaaggtggaggttgcagtgagccaagatcgtgccactgcacaccagcctgggtgaaagcaaaattctctctcaaaataataaatgaataaaataaataagtaaatgggcttttttttaaggtaagactttagaagtactttgctaataaatattcttatggagaagtttcatatagtgtcttccgctattttagaagtatgaagcttggaaaatatatcttgaaatttttgttatcagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcggtaagggcacctctgcagaatttcagcttcccatcaatctctcagcctacagaggttcaaaagccagagtccatgcagatgttgcagtgagtcctgtgtcacttggtagaattttacatgcattgtatatagcaagctactgatggcttccattggatgtttggctacactccatcccaccttactgttaggatataaagtaacatgcttacagactacctagcttcttccggccagtttcttcatcaggcatggtaggccatagctgcctttccacagataagtatggttctattaaaaatgctaattagcctggtttgatcagtatacattgtatacatgtgttgaaataccactctgtattccataaatttgtacaattattacatgtcaactaaaaataaaagggaaaaaatttgttaatgttttacctgtagagcagattataaggataataaagacattctcactcagatttcaatattctttcttaaactggggctaaaagggtggacttaatgacaccaactagccagaaattacaaatttggcataacagtaaataatttcacatgtaaaaacaaatactttggccaggcacagtggctcacacctataatctcagcacgttgggaggccaaggcgggtggatcacaatgtcaggagttcaagatcagcctggccaagatggtgaaaccccatctctactaaaaatacaaaaaattagccaggcctggtggcgggcgcctgtaatcccagctactcgggaggctgaggcagagaattgcttgaacccaggaggcggagctttcagtgagccgagatcgtgccactgcactccagtctgggcaacagagcaagactctgtctcaaaaaaaaaacaaaaaatttcacaattagaagcacaccgattaattttgcctattactagaggcttgggggagtgtggtgattttgttttttctttaatactctgaatttttacaaatataacatagccgggcgcggtggctcacgcctgtaatcccagcacttcaggaggccaaggcaggtggatcacgaagtcaggagatcgagaccatcctggctaacacggtgaaaccccatctctactaaaaaaaaaaaatacaaaaattagcccagcgtggtggtgggtgcctgtagtcccagctactcgggagactgaggcaggagaatggcatgaaccggggaggcagagcttgcagtaagccaagatcacgccactggcactccagcctgggcgacagaggagactccgtctcaaaaaaaaaatacaacataattgaatatttatcagaatatgccacccacatttctttactctctatattgagttttacacctccctgacacaagtatgtctggatagctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgaggtatatctgtactctcagccaatagagcctggggcatcctcgcttttgtttacacttagaaaccataatgtccgtaagtcaacttcctaggcaacctaacaatcataatcaacttcctaggcacacttaaagttatagctacatcagttataactatatcagttaaaactttaagtgtgcctaggaagttgatttattactcttcttcatcatggaccaaaggtattttagcctgagaccatagctaaaactagtaaatacttagttagccagccaatatcatgcattttctataataggactgtaaagtttgtcagttacatttttcttgtacatttcaggtacattttattctttctcagctaccaatgacaatgaaaaatagagtcacaaaccttacacttaccaagtggtgacttaaaaggcttaaacaatgtttattttcttaactgaatgtcaggtagtccaggacaattcctgatccatgacctctcagtttattagatgaatagagtaatctcacttgccctttcaactgctgattctaattggaatgcaggtttgaaacttaatgctgttgtgttgggtttttcttccagtgccctacttgttttgctccaagacagcctgctagcaacagccagttctcccaaattctcagagcttgttatgaaggtgaagttgaaatgatttgatctcttttctttcaaagatgcaatcactttgttaaaagtatggggaaagaggaattggagctaagaaagacataggctcaaatcaaccaagtcacacctgaaaatatatttttcgtaataaaaatattaataaatttttaaaaatttagccaggtgcagtggcatgcacctatagtagcagctactcaggaggctgagttgaggagattacttgaacccagaagtgagcttgatcataccactacactccagccttggcaacagtgagaccccatctcttaaaaaatatatatatggttttttatatatatgtgtattatatatatgtatatatgtattatatatgtatatcttaatatgttatatatgtatataatacacgtgtgtgtgtgtgtgtgtgtgtgtgtgtgtgtgtgtgtgtatatatatatatatatatatatatatatatatgaattggtcttcagtttttcccttcctacaatttatattctaagttcaggcctaaacagttcgtggcctcaaacagtgaaagggaggaaatattttgtaaatattttactaattctctgaggatcaaaaggaaagaagtttgaaacagatttcatttattttggggaaaaagatatctacagccctatgatatttggtctcttttgtgaaagagaccaaatgaacatatttataacattgtaatactgttattacactgaattagtatcagatattttgtccccttgcattagatttggttaagcaacatgaactactttactctcaggaacgaaggaaacccaagagagaatttctaccaggttaaatgatggcccctagctctggggagtgggaaggagtagagatggatgattagatgaatgactggacacacttcagctggtgtcatggtagaagtgattaaaaattttcatgttttagcagctgaacttgaaagatatgatgtgccacatttatagccctggccatcttttagaagtgagctcaaagcttagggaagatgaatggtgacaaattatcctcattcttcagtcactcctaactcttttattcttttttcaatagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaaggtgagtaagaatcgcaactggtctctgagggagcttgagagaaaatcatggaaatggcagtgctatcagtcatgcatgtgtctccctcagatcctggaccacctaacgatgatcgacaacaaaaacgagtctgagctggaggcccatctctgccggatgatgaagcacagtatggaccagactgggagcaagtctgataaggaaacagaaaagggagcatctcgaatagtgagtggcctgacttgaaagattgagggacatgaggctacaccggaagtgatcttatctaaggtgtaggtcaccaggatatgctttccgaaggtccaaggtgaaggctcatggactggttgaatcagtctcctgctgtggtgcagtaaccatttccaccttgaaattttaaaatctaaactaagtataaccatgtgttttttggtccccaagaaagatgcctaaggcattggtcaccagataaatagctagttctgcttaacatggaaagaatatgtcagttccttctccatcaagttgaggtggaaatctgagactggaggcattcagtaacacagaatgttagtgcttctgctgcaagacctgcatcatcggtgcatctgttatctgtaggaacataccaataaggcccagattttgagatattttctgttcatatccaaccatcagttcctaattaataactcaagtctaaccaattcttcctatgtctttcaacttttcaggatgaaaaatcatcaaaggccaaagtgaatgatttcttagctgagatttttaagaagattggctctaaagaaaacactaaagaggtgagagtgaaagggttaagcagaataggggtctgctttatggtaaagggacactaacattcatccccacctcttcccttttcctgttcaccagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggtatggtttcctgttatagctccaggaataagctcaaaatagctcctagcacaggaacctgaagttttggttagtttaaattcatatccatgaacctcaatacttaatggtcaccaaatggccttcccattgctatatccagtggtcaattcttagccacctgaattgacccatcatcagtatttgacaatggtaaataaattgttccctgcccttgagacagcttcttcacttcgcttccagttctccatgctgtcttgttttcctccagtctcactggctattccttcttggcctttgactgattcttgctcacttgctctgacctctttttttttttttttttgagatggagtttcactcttgttgctcgggctggagtgcagtggtgcaatctcgggttcaagctattctcctgcctcagcctcccgagtagctgggattacaggcatgcgccaccacgccaggctaattttttgtatttttagtaaagacggggtttctccatgttaggctggtctggaactcctgacctcaggtgatccgcccgcctcagcctcccaaagtgctgagatgatgctcatgagccactgcgcctggcctcactctgaccttttaatgtggacatcccccagggttcagtctatggttgtcttctctctttctcttatttccttaatgagttcatctactttcaccactttaaataacatttaaatctccagcttagacctccttcctgatttccaaactgctatatcctacatgatatctccacctgggtttcaaatagattttttttttttttttttttttcttgagacggagtctcaccctgtcacccaggctggggtgcagtggtgtaatctcagctcactgcaacctccgcctcccaggttcaagtgattctcctgcctcagcctcttgagtagctggaaccacaggcgggtgccaccacacccagctaatgtttgtatttttaatggagatggggtttctccatgttggccaggctggtcttgaactcctgacctcaggtgatccacccaccttggcctcccaaagtgctgggattacaggcttgagtcaccatgcccagcctcacatagacattgtaaactctacatgtcaaaaactaaagtcctggccaggcatggtggctcacgcctgtaatccaggactttgggaggctgaggcgggcagatcacgaggtcaggagttcaagactagcctggccaatatggtgaaaccccgtctctactaaaaatacaaaaattagttgggtgtggtggcgtgcgcctgtagtcccagctactcaagaggctgagatagaagaatcacttgaacccaggaggcggaggttgcactgggccgagatcgcatcactgcactccagcctgggcgacagagcgagactccatctcaaaaacaaacaaacaaaaaaactaaagtcctgatcatcccgtaagcctgatccattgacttttgttttgttttgttttgttttgagacagtctcgctctgttgctcgggctggagtgcagtggtgcgatcttggctcactgcaacctccacctcccgggtttaagcaattctcctgcctcagcctcccgagtagctgggattacagatgcctgctaccatggctaatttttgtatttttagtagagacggggtttcaccatgttggccaggctggtcttgatctcctgacctcgtgatccgcccacttcggcctcccaaagttccgggattacaggcgtgagccaccatgcccagccgatccatttacattcttctccatcttggttgatggcaactttatccttcgagtttgttcagatccaaagcttttgagtcttctcttcctttccgtcaggaaattattttggctctacctgcaaaccatatgcagaattcatccacacttctcttcactgctaccaccttggtgtgtgtgttctctctcatctgtattactgtactatcttcctgcttgatctccctgcttccaccctgccttcctctgttcttttctacacatagcatcagaatgactctaatgaaacattttccagaggctctccctttcactcagcaaaagcaaaaggccctttaaaggtctctgaggtcctgtgtttataggacccgccagtgcccctagtacctcatcacctagtcctcttcctgttgtttcactccagccccaccagcccccttgtttcttttagagtcagggtctcgctctctcactcaggctggagtgcagtggcgcaatcatggctcactgggttcaagcagtcctcctgcctcagcctcccgagtagctgggactacaggtgcatgccaccatgcctggctaatttttgtattttttgtagagacagggtttctccttgttgcccaggctggtctctaactcctgggctcaagtgatccacccacatcggcctcccaaagttctgggatttcaggtgtgagccaccacgcctggcctccccctggttgtttctggaacacaccaggcatatgtcttcttagggcctttgcactggctatttcttacacataaatgctcttccttagatggctttgttgcctagctccctttcctctttcacatctttgttcaaataccaccatcttagtgaaacctttttttttttttttttgagatgaagtcttgctctctcgcccaggctggagtgctatggcacgatcttggctcactgcaccctccgcctcccaggcttaagagattctcttgcctcagcttcccgagtagctgggattatagacgtgcacctccacgcccagctaagttttgtagttttagtagaggcggggtttcaccgtattggccaggctggtctccaactcctgacctcagttgatccacctgccttggcctcccaaagtactcccaggcatgagccactgtgcctggccagtaaaaccttattgtttaaaacttgcaacctatccctcaccccaccatagcacttacacctctaacatactatataatgtagtatttattaggttaattgttcagcatctgtgtctagtcatgcatatcaacattttgcccagtgatggactgcatatatgatggtggtcccataagattatttattttgagacagggtctcactctgtcatccaggctggaatgcagtgacgatctcggctcactgcaacctccacctcctaggttcaagtgattcttttgccttggcctcccgagtagctggacagttgcgtgccaccacacccagctaattttttgtgtgtatttttagtagagacagggtttcaccatgttgccccagctggtcttgaactcctggtcttcctggtctcaagtgatccccccacctcagcctcccaaagacctaggattacaggtgtgagccaccatacccagctggagctgaaaaattgctatcacctgatgataccatagctgtcataatgtcatagcacaattatttttgtataagtttagtgtagcctaagtgtacagtgtttataaagttgacagtagtgtcctaggctttcaccttcacacaccactcacccagagcaacttccagtcctgcaagctccattcctggtaaatgtcctatacaggtgtaccatttatcttttatacaacattcttactgtaccttctctatgtttagatacataaatactttgtgttaacattgcctatagtattcagtacagtaacatgctgtacaggcttgtagcctaggtgtgtggcaggttataccaactaggtgttcacataacaatgaaattatctaacaaatgcatttctcagaatgtatccctgcccttaagccacacatgatgatatttgttaaatgatataaatgaatgcagtaactaagtttaagctgaaatgttactgcccccacagtgaaaaagtccctattcgagaattactgctcacaggatctagagacaaacagaagacttaggaggtttcagttatagaaaatagctatcatgagccttaaaccaagacaagacagacccaactgcaaaagtgccctctcatcagttctatgcttagttctttccgagtttagtgacattcacctactcttacatttgagaatgtgtttgcctgtcaaagcatgtccctttgtgtttttcagaccctgatcatatccactctcagcctgtatcttgctgggctgaagcttcagttaaattttgttctcttaaataggagttcttttttgtttttgacaccttaaattacgcctttccaagactttacaagtgtttttattttttgaggtttttttgagataggttctcactctgtcacccaggctggagtacagtggtgcgatctcggctcactgcagcttctgcctcctgggttcaagtgattctcatgtcttggcctcccgagtagctgggattataggtgtgtgccaccacccccagctaatttttgaattttttttaagagggtttcaccatgttggccaggttggtcttgaacccctgacctctaagtgatccacctgtcttggtctcccaaagtgcttggattacaggcatgagccactgtgcccagccagggtctctttttgttgcccaggctggtctttaatgaaaaagacctcttaggagttaaagtgtggtgtgcagaatgtccaacagtatgccacatgtaaacataccatggtttgatcagggcaggcatcctatccttgtttccaaagccctttttggggatgttcaacgtgtgataattttggcctaaacagcacatttgcaacccaagcatgtattcccactgattattaaattgattttgtgccttagagtattcagacatctcatattgctggcttttacataattcttcattcatttttcaccccctcagaggattctcctcatctttacattaaaggagtcctttttccctggagtaacctttctacttttctatttaccataaggcagtgtttcctcccagtaccttacctttggggcctgtggaatgcatttgcattgataccaagtgaaatattttaaaggcccgcattgtatcattgttcattctcagaaatttaggaagtgtgatggattttttgttgttttggttttcctctctcctgccagaatattgatcttagtggtagggttacagacactccagttctatgccctctttagataattgttggacaccttctcttccccatgaatacaccatagccttggacaccttgcttccttcacaggttcaaatgagtttctcctatgtgacattggtccaaacttaatctaattcttccaaacatttaaggtcctcgggtttttcagttgggcaattacagtatgcttaggagtagcttcagctttttggattgcccaagtcagccctgggattactggagtacaatcccctgcataacccaggatgcagatggatgacccaatttacattctgcctttctatatcagttttttgcattctcaagaagcttatattgtatatttcagagcacccttatcaccaactccaggtagattcttgtggaatttgtcgttttcaagtataggaaattcttaattgttctttttggtgggagattaaccaaggcactttagaagggggatatgtggatatctgaatattctttctactttttcccctctaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaaggtactgctccttttcttctgtgcagttcagggagggtagtcacaagcaggtccgaggcaggctggcccacagagaagtggcttagtcttgctgtagttctggagctgcatcttgacctgcttgacctgaccttagacaatctctctccttctctcaatagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttcttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaactatacctg

SEQ ID NO: 37803 - DNA, 23729 bp, Homo sapiens
cttaggtcgtggtggccccggtggtggtgggctccgggcgggctcgcgtcatcctgcccccgctgcgatgcatccgcggcgcccggacggatttgatggcttgggctaccggggtggtgcccgggacgagcagggctttggcggcgccttccctgcaaggtccttcagcaccgggtcggacctgggccactgggtgacgactcccccagatatccccggcagccgcaacctgcactggggcgagaagagcccgccctacggcgtgcccaccacctccaccccgtacgaaggccccacggaggaacccttttccagtggcggcggcggcagtgtgcaggggcagagcagtggtgagaagcatggggaccgacacagggatgaggggttactggggccgcggcttgcggcctgcagaccccggaagcggcgcagaggatcccgcctcctattccttctcatcctatcgcgcgccacaccctttgccctcctttggtcctctgcccctgaggctggcctcctcttcctcacaaacgaattctcctggatcaactccaaaaaagacatctgccttagctatggggtgcatagcaggaatttttagaggttttggtgtctcaactgatggtctgagttaaaaaggagattggattattaactgttccctgattcactttggcagctctattttcttgatttaattaattaattaatgtgtttacttgtagttttgtgttctgaaaagagaagcctttcagcataagcatacttgggttcaaacttggttgtgccactcgtaatctgaacaacttaacctctgtgagccctcagttttctcatctttaagatgtgtagaagaatcctgtatgggacacataggctaaaaaaaaaaagtttccttccttttcctttttgaacacaggagttttgtctgcttttcagatccccagtctagaaagtttccttcctataattttcctttctgctttccttctgctgacctaaaaactacatataaaagttagaaacactgatacaatttcaagataggacttcggaatcatgacataattattctccatgggatgtcagaaaagctgcaacactgcatgatgtagatattttcaacatccttttttattcataaaatgtgaataatggctacctctttctattcttctggaattgttagaataatagattaatggtattaatattaaatttattgtagaaatcagctttattcttatttcctcgactttgacttggaagtacaataatatttaactaagaagaacagactaacgaatgtctagtgagtaaatgaggatgtgaagaaagatagatgacttacctagctaattgtcatacaattagctttttgactcttcccggtttaaagttatgctttggtggttacaatgaggaggagttccttgacacaagcaggggtttattttgcagccttaacaggtgggtgaatgttaattttgcaacaaagatagacacctaagagacttacacagtaaacaagattaaaccttcctaacaccttccagaaaatgctagtagcattttctgttgctatttggggatgatctatacatacaaaatgggtaaggccgggcgtggtggctcacgcctgtaatcctagcactttgggaggccaaggcgggcggatcacgaggtcaggagatcgagaccatcctggctaacacgatgaaaccccgtctccactaaaaaatagaaaaaattagccgggcgtggtggcggatgcctgtagtcccagctactcgggaggctgaggcaggagaatggcgtgaacccgggaggcggagcttgcagtgagccgagatcgcgtcactgcactccagcctgggcgacagagcgagactccgtctcaaaacaaacaaaaaaaggtaaaatctaaggtaaaagtaccgtaggtgggtaaaagaagctttctatttagcttatacatttttctagggtaaactgcgtaatttcccaggaacatgcttaggtggccttgttctgattgaaagggaatagtgagggcagttgcttcacttgaaagagaagaggagagaaagaattgtaacttgtgaatattgtattatagttagaatttgatgtctggtcccctggggttgtaatagttcaccactatgactttgagtttagtcaagaagaaaggcttttctcttttgacatatgcataggaatgttcccagctgtgaacttttccagtaacataacagacataccatctgtagtagcatttaggtatccagtaacctactccaattaattaaacagctagcctcaaactatttaaaacttgaagagatgggggagagctgtatttacccattttggttatccctaagtaccctttcaagttaataatttagaggtgctttacttgtagttattggtttaataaagtgctctccgtcagtaacagtgaataactagttttacagcataagaggtaaagtcgcaggtggaatatcagctgcggccaaccatggaaaattttttatttgattggaatcagaagctgaaaactggtagcccttaggttctgtccggatatttgtttcattaggccaagacaatgtgttaacagtttttgaaatagttgtccaggactttaaaattggaagcttttatataaaatgagaatatctttttttgaaaaaattacaacttcaaaaccctgggcccacactctaatgtggcaacaatgaattggagtgaaagcgtaattgtgctttaaacactctacaccttgcaatttgccacagaccccagcagagtccttcattcatttaaattatttacctggcccctatcagaatttgactttgaggtttaaatgaacagcaggttaataaaataaattttttaaaattgttttgagactaaacctaaattgtcagtaattggttatcagtaatcttatttttttatttctatttttttttactttagaacagctgaatagatttgctggatttggtattggacttgcaaggtaatgttttatctaaagacgtttacagcttttatttattgaatttagagtttttctttaatttacaatattaaatgattattattgcttcctttaggttgtttctttgaagcagcagcttaaattttgaataatattttgcagaaaaaaaatgaccattatttaaaatatataatttgatagtttttccagtaaggatagactagtcatccaattttataaacacaaagtaattttgtaatgagtattgtaactgttttcatgggtctatccaaaaaataaaatgaagtgtaatcttatctctctcccatcaaaataataatttagaatggggttcatgaagatcaaatggctctgctgataagaacttttttcataggacattttctgaaagaaaaattacatggcatttaatgatgccatgtaactgacgtgtcatttcccacatcaaacatacagtgatctagtttcattttataccgtagatattaatattgtgtattatatattgtttcccttacttacctgtttgcagatctggttttcattcttttcatgggtctatccaaagaataaaatgaaatgtaatctgtctgtctcccatcaaaaaagtaattgtgcatggaggcttctttctaaacactctaatgcttacaagatatttagcaacatagcatctagattttgttcataatcagcgtttggtgatagcattacttttttttatatctaacgatcattttaagaaaatcctttagtcttgattattgtgatccttagtgaataccattttcaaaaatattggaattgcacaaagcttacatttcatgccataatgatcattattttaaacattttaacgaagaaaaacaccttatttgcataattaaacccgagggtgttaatgtcaatataaataaaatctgtgttttccattctgctggagttgttttttgcttcaatatttatacttaaagctttgattcatttgatagactattattacatataaatatgtgtgcacatgtatgtatatgtcactctgagacctgaaacccacagctgtaattgttttgtggggcacattctcaaaataaatatttgatacataaatattagtcaattaacatggtcattaagaatcttataatttaagatttatacttaaatttatacttaaaccttataatttaagtgcaccaaaaccaaacatttttagaatggggttcatgaagatcaaatgactctgctgataggaattctgttattaggacattttctgaaagaaataatttgcagcattaaatgccatttaattgatgtgccatttcccacattaaacattcagagatctagtttcatcttatactatagacattaatattatgtattatgtattgtttcccttatttactagtatgcagatctggttttcattcttttcatattgaatttcgttatgggtagaatcatttgcaaacatttctagacatttttaaagatctatttaatttgtttaagaatggaaaacataaaataatgcatgattcttcaggcaagaataatttcagaaagatacctgttgtaaatttaatttatctctatgtagacatacatatacataaattatttttatatagtctctttacagaaaatgtattggcacatccttgcattgttctacgccgccaatgtcaggtaaatgtaatttctgtgatcttttgaagcaatacttctgaccctaatatgaagggcagaactcacataaatgacatgaaaccaggtaattgttacttcatgtgaaatgttccaaactttttggtctcaaaacctctttaaagtcttaaaaaaatattgaggatcctaaataactttggtttatgttggtcatatctattgatagttaccatttcagaaattaaaattgggaaaatttcaatgcatctatataattcattaaaataataacacctgttagtaagataatatgtttttatgaaagtaactattttgcatttttgcaaatatctttaatatctgacataataggagagagccagtttctctcgtatgcttctgcagtcaatctgttgcatcacgtggtttttgaaagaagcaaggaagtttagtcttgtacacatgtatagttgaaagcaggagaggagtatattatattcttttgagataattgtgggtattctttgcaattgcaccaaaactcactgtgtcgcagtttcttaaaggttatttgcaatgtgaaatcagaaatcattttagtgaactttttatactttgttacattaaaaaatccatttaactatactgcatcttgaatagatatttttacttatgcctgattccatgtaattgtgcataagttatttgaaaaatattgaccaattgagttacatagatcttcctgttgttaaaacatttgattataaaatatcaaaaaatcatcttcattaaaaatactactgatctcactagaaaagtctataagtattgtcagctcttgacgatgcatatagattttccaaaattctgagttttagttgaaaattcaaacttatcattgacagtaaatactgttatttatttttgttttaatcaacaatctcactttgtttattttttaaaatatgtctgtcctgaaagtgaataggtatagtccgtcaatgagtttttctaagtaaaaatgatgttccgtgaaaaaagtggctagtttagcttgcagttctatcatacaagtgctttcctcatgacagcaatcttacttccttatgtaacacacaggatattaattagaaagaggatgtgtactcaaaggtcaaggattcataaaattaacattttgttacttcattgtcaaggatattactatatgaaggttgcttttttctctctatgggtaaatgaggtgaaaaattactgtaagtacgaaaatacagtttgatggtgctgcctcaatttgtgctaatgagctgggagttttacctaccattgcttttgtaccattagtgaaaatgtcaagacagtgaaaaaaggaaattatatcttagtaatcactaggaaaataattttgaacttgtcaagcccctgaaagggtaatggggccctcaggagtcagtggaccccacttgcaaactctgttataacccactttttttttttgtttgtttgagacggagtctcgctctgttgcccaaactggagtgcagtggcatgatctcggctcactgcaaactccgcctcctgggttcacgccattctcctgcctcagcctcccgagtagctgggactacaggagcccgccaccgtgcccagctaattttttgtatttttagtagagacggggtttcatcgtgttagccaggatggtctcgatctcctgacctcatgatccgcccgcctcagcctcccaaagtggtgggattacaggtgtgagccactgcgcccgtcctgttataacccactttctctgtaaagtaatgcttcctgtatttgttagctgttagagttcaaaacagtataaatcattataaattaatctgttcatgcttagcactgaaaagtatgtatacagaaataccattaaagtagcattgactgtatgtgccacagaacagtgtatttcagatatatattttacattgtagtaatattaacatggagatccaatggatacattacatataagtaacaaatatattatttttaaatgttttatgaaataataccattagaatgtaatacattctaatattttattgtttcacataataaatattgttttgacactcccccagttgatttcatataccagtcagttgccaagtacagtttgaaaaatgcttgcctaaaatgaacatgagttgggagatgtaattcagttgtttaaggcaaaccaaatatcaaataagaccctctttattatatagtctacagtactgtgtgtattatgcattggtcttcagattgtatttatataaccatacatactgtacttttaataggttatttaaagcacttttaagagtaattttgcttatgtgtaatttatgttgactttggaattaacttttgtttatactgcaattccaccatatttctttcatggctctgttatttcttgacaaaacattaacagaaaaaaataatgaaatatcttttttacaggttaattaccatgctcagcattaccatctcactccatttacagtcatcaatattatgtacagtttcaacaaaactcaggtgagaattttgtctggattctattaaaggtttatataagtgtcatttgggtttagtaatcattaaagcaagaataattactttcagtttggtcaataaaacatcttaactgttgtagtaaaactaaagtagcacaacgatatgtttttgaatctttcaaaatgtaatttagcaaaagtacaatttaatttagcaaaaccacaaagagctgtgctaagatgatgtctctgctatcaagaggctcatatttattcatggagacaaaatctttgaagattgtgctgcagtaagataaaggcaatattagaagtacagaatgctgtcagaatacaaaagagaagtaccttatcaaaactgggcttgggcacagtgtatggctgggaaaaactttgggaaaagaaaggcccgaattgtgtgcttcttgttgagaagtctgactcttcatgatgaggatagagaaaaggtttttaaagtagacgtgtgaaggcagaagacaaagagagatcataatgtttgggaatggatttaatggagtacaatgggagcttgaagtgggggttgaagagtaagagaaagatgaaaaagtagccagagaagtaagcaggatccagattctaaagcaccttctaagaactgcacactactagatcttaaaagctacaagagtactgttgaaggtgttttagccatgaccaaaatatcttgaagacctttggattgtttggcaatatctattaaaatttaaaatgtacatgttctttcacttccaggaacttatcccacatagatgtgcacatatatatgcaaaaatatatatacaaggatgtcctatgacattgcatataatagactggaaatgattaaatgtccatcactagggtaccagtgaaataattatggtatattatggtgaaacaccttgtaacctttaaaaataagagggtagctctgtgtatactaatgtggaatgatctccaggatattttttatgtttcaagataatactacctgttaaaaataagcaaaacaaaaatatttctataacatacacacacagatatacttgtatatgcatggattatcccgataaattttaaaactgctgctgaggactgggatgaaaaggagacagacttttcagctgataccctattgcttctttttaattctatcatgtatatctattaataatatagataatatagataaataataggagtattactgatggtatcatgcaaaggggcaaaaccagagacagtgaaacttgtagtcaaattgatataaagtaatagtgttaagtatggagaagagcatggatttgtaagatactaagggagtagaatttgtagaacctggggactgattagataggaagagtgagataaaaatgttttctagatatattgtttggacactaggatgatgaagctgctatctagggaaataggaaatacagcagagaaggaaagaattggtgtggtatgagtgagtatgattgggttaagttgtggatatgtaagtttcaagttaccttgtgtcatccacaggacaggactagtagggagttgaatatatagatattagggatatttaataaattagttaatcattaggggttttaattaataggaatgttcttcttggcctaagtataactttaaaatgatataaaattaattgtagttctctactaatatttctattagaataatgttttattggaaaatgtctacacaatatcaagttttattaagatcttttgtgtttcagatgtaggtattaacagaaataacatgaattttgttcaatttagggacctagagccctgtggaaaggaatgggaagtacatttattgtccagggagtcacacttggagcagaaggcataattagtgaatttacacctttgccaaggtaccatttttagcatttcttcagtattagtttcatgtggtgatgtgtttttagatgcaggcggtacatgtgcaggcttgttacatgggtatattgtgtgatgctaaagtttggacttctaatgatcctctcatccaacaattctcaattgtgtaaacatcatacccaataggtagctttcaacccttgtccccatccctcccctattatattgttttaataataaataaaaaataccttgaatctgaaaacttgtctgaagtaactaaaagaaaaaacaaagaataaaattaattatatattattaaattagtatgtgataaagaaaatgtgtcttggcttagtatctattgagatgtatctttcagcttctactgctatgtgccagcaactgccagctgaggaacaaatgtgggtatgtgagcaattcccgctctttaagtattcatttaatgaaggagacacatgtaagcaagaagaggtaacatgtccaatgtcacggggttggacagtctaggtaataaaagaagtgtcttatgtttggaatattgggtatgtatgaaattgaatatcaggaaaagaagctgaggtgctacattaaaatacgattgtgcctttttaagtttattctctatgggtttggaatgtgtttctttttttaatatatagatgttctgatcaagatatattcaaatggcagtataaaataaatggagttgtatagacagatttatggagatctattgtaataatctaggcgaggctgagaaggttctgaactgtggaacagaacagaaagggatgagctggctagacatttctgaagtatagtcgatggtcattatgttagcttggtaattggagataggagagaatgagttgtcagtagtgactgagatttctagattggaaaatgttaaccaagatggagaattcaagaagaagaaaaagttggagtagggaagaagataaagaatttatctttcaataaatgaagtttgagattcttgcaagacattgagggagagggacatgtctcatatttggttggaaccatggatcagagtaaaaaaaaaaaaatagaaaattgaagcacagggagagctttgggtattgtggcataaaagtagcagctgaagcttaggatagatgaaatcacctaaggagaaagcatagattaaatgaataaaatggaccaaggacagaatcctaggcatacatgtgtgccgtgtgtgtgtgggagcggtgggaaggggggtagttgggggagataatgagagaaattagagagggcctcagacaaattggaaatagcataagatgtaggacaatcatgttctagaaaccaaaaatgggagaattagaagtgtagatacatttgagagagagggtagagaaattagggaaatttgctttgggtctctcttttctctgtgaagcaggatacagggttatttggtgaaaaaatgataagcattggggttgtagtagaaaagcatgagaggaatgatacacatttgggacagtcacaatgatgggtaacaaaggaatcttacaaagagtatatgaaaggaatgttaataggtaatattggaaattagaaatttttaaggtgctatttggcattactctgattttctatatcagcactatatttttgtatatcatcctatcgataatgttaaaggctttggaatggtttgttaatccaaatttattctctggcaaggtgaattttttgcattgttaaagaagtgagatagttgaaggcatagctactagtgtaacgcatatgcccaatgttgggatttagtccttacagggaaggaaatgaaagcaagagaaactgatagtaagcttttttccaatgtgattgcttttgaaggacctcgtagtcttgaagtgccttaaataaactttgctaaaacgtttgaaacaaaacaaagattagaaaggtcagcaacatttgggcagctcagagtttcttgttttattctttaaaaatctgtatttcgttgtttggctaactattcactttattgcttttatatcactagataagatcccaagttagtacttatagtcaaatattcttgaaattctttaacaaacaattctgtaaaaaaataacaaaatgcaggaaattccatttggtagagtgaaaaaaattcaatgcagttgttcctcatatctgtaggggattgattccaggacccccagtggataccaaaatccagagatgcttaagtcccttttataaaatggtgttgtatttgcatacaacctgtacataacctcctgtatactttaaatcatttcttgattccttgtaataccaaatacaatgtaaatgctatgtaaatagttgttattctatattgtttagggaataatgacaagaaagaaaaaaactctgtacacattcagtacagatgcaactatcccttttttaaataaatattgtaaatccgtagttgcctgaatccatgtatgtggaacccatggatatggagggttgactatatttgcaaccagaacactattggttcaggtcctggctattccactttttatttctgggaccttatgcaagtaatgttgcctctctaaagcagagatgaaggaataacattaatttcaggctacagggaagaaaaaagaaaaataggaatgggaaggcataggactttataaaattttatcatctaactttcttactcagtagacagacatgtcaactgagtgggaatatattttcatcattttgaatctttccaaagaagacaaaatagtaacctctattgcattgttctacttggataattttggtgataaggcccactcattaattcattcatttacttggctaacatttcctgagtacttactatgtgccaggttctgtgctaaaaaccgggtttacagtgaggaaaataaacaaaaggtaactgttgccaggaagctcagaatctaataaaagtacattcactaagaacaataattccattaatgaataattgcaaattgaaatttgttttctgaagcaaaagaatatagttccatgaaagtattaaagggctagaaacagtgtccctagtaacatgacacttaaggtagatcagagtggtaattaggaggtacataccagtttgtacaaaaatgctgttgcagtggggagcctagagaattcaggtgtaactgagagaagcctcacatggctggagctctggccaagggtaagggtacagagcaggtgggagccagaacatgtgtggccctgtaggccattttaagaatattgaagaggttcagtaaggtcagtgacatcagatttgttttcaaagggtcattgtaactgtagatgaaaaggttgtatgaggaccaaagtgaataaaaggagacatcttagtattctattacaataataaaggtaagaaaagatagtggctaagatcagggtggtatcttttgagatagaggtaagtggacagttttgaaatatacttaggtcaaactgagggaatttggtgatgctttaggaatggtagatcaaagagaaggcagtatgaagaatgacttcttgtatttgggcttgtgtaactagttgtcaaatgaagctgtttttttgaagtatagtgtgaatatcttttaaaaaattatttattcttctttgggcagatttgacctttcctattaatgggaagaaggcagagtttgtttctgtatcctattaatgggaagaaggagcaaacaaggtcacaaaacattaacagcagttcacagaagctactacatgaggaggatgagctctgaggtctcctagcctggggttttttaattgcgtaacatttactaggtagaacaggggagatagtacagatttgccaatatttaggggtttttaaatacagtttatgatcaaatcaaagagaaaaacagcagatctctagtgttcattaagtcagcaaatttataatttctcagtagtattactttttaacaaattatatattagccaggatcgtcatgtgtgatctctttagcagtagatactgctaaacccttccctgttctctctcccagttgcagtgagttaaaccatgtgtcgttctacccccacagtaccctttacttaatttacatgtggcttttttcagactgttaacgcgaggtaggagttcctgtaaccaaggctacctgtgtggttcagtctctcacaaaacccatttggttcaactccaacttagttttgactcatcacacatctgtggttataccactgtaaacatcttgtagttttcctccaacggttccctccgaatttgcttattttaaacacacgttattttaaacacaatgaaatcttcctcaaattcaatagatttcctttctgattaatagttcctgagtagggaacactgaaagagtttaagtagaaaagaaagattttaagttggactttagtacaagtgcattttcagatcttttatcatatccagatggagttgtctgtaggcacatgatatggggctggcatataaagaattcttaactgaaggtaaattaatttgggagattttgaagctctaaccctagatatgagcgtcgctagggaagaaggatacactatggtagaagaatagagtctgaaccttaggaactccaaccaaggggtggctgggttaagaaaggtggtcttgaaaaggagtcaggagagaccagaaggcaggataaaaaccaacagaatgggctagtggagcacaggggcaaagagtgcttcaaggagagaagaggctctgatggctgctgaaatgtcaaataaggtagagacttaaaaatgtccatcagatttaatgacatgcagattattggagactttggtaagagctgtttttgttcaaaaccaatttgaagtgggttcagaggtgagtgggaaagtacagacgtggaaacagaaagtttagatggttggctctgactaggattgatgaagagaggtaactggaagatgaggggtttagagtaggttggggtaagttttttttttttttttttaattaggatagctatttgaccatttgaaaattaaagactgctgagacagagttattttagaattttattgccttttttgtgttgattatgcataggagtatgtgttttgatttgttaaatgaaaaactagactgttttgagaaaagcaaggtactcgaataaattttattaattttttcgttcattagggagggcattttttgcttggaaatagataatttagatatatttacatgtttggtatttgataatgaattataaaaaggtttagtgactgaagcttttaagtatgcttatttaaatttctagagctgtaacagtaaattttacccattttataaagtagtagagaacagatacaaagaagagtcccaaaagcatttttttaaatacttggttttaagtctccttttatcttaatgatcttaagaattggcagtagtcatcaaaggggaggtaactcagaattgacattgtatttaaaggggaggctacccagtcctaagtgtttaccacagtttcatacttaaaattggtgtcgtcataaactgtggtaatactttgtgaggccatgagtattagctgtgccaagatgatttacaaagcatgtaacgtattttgttttataatcataaagtaactttcagtaagatgggaggcctaatctattttttatatttttcgacttaatcattgaataatatgatttcagctacattgtgttgttcaggccaaataaatatcctaatagtaatttaatcagagttcggcccagaaggtgctctaaggtcttagaaatcgggggtagttgctctattgtctgaaagtctctgatgtatgtatatgctgttgtttttcaaattcagtcatgtgaaatagaaaatgtttatctagattcctgctgtagccatagccatgatggaatgagtacccattccatcagagaaactgttggtagcaagtcttatctttattttgcacttccctttctgttttttttttctctttttcttttcatttttcttctatctcccctgccttttcatttttttcttcttatttactttctttttttttcttttcttttttttttaccctctataatcttgactctttttggacttttctcttgatagaacttactcccttttttcacctttggttctatttcatttcagcttgcctccctccctcccttccttctttctttcttttttttttcttccttccttttttttctttcttttcttgttttccaaaggtaaccaaactagcagacagaatgcacaaaatcctacaccttggttccagacctggcatttttgcctgtttcctttgaacattttcctgtgatctttttgaccctgatttttctcatcagtaagacaagtgtgacaatatctgctctgcttatctcacaaggttcttctttgtatcaaataagatgagaggcagtacaggcagagagtaccggggtttagaacagagttccacactaactggttacttggctttggatgagttattaatcccctctgatcctatctcctcatctatgaaatggagaaaatagggttattatgaagattagaaatagttcatgcaaagcactttgcatagtcatggcatttagtaggtgctcacaaagataatagaatataatggtcacaaaattatgtaattgtactaagtaaagataattcagaaattaggtactacataaatgtaatgtgtcagcctgcattagagttacttaacttttttaaaaaattgtcattcttatatactttgtaaagccttttttaatcctgttctttgtttccatatctattctctttcttttaaccaatcatcttaattttcttcctttaatttctcatgtttactttcataatcagttgtgcctcttgcttctctgccagccccttctatcagcacgtatgaaaacaccttgtatttttttctctcaaaccatcacagttgtttacactgtgttctagaaaagaaaatgttcaccattagaatatatttctcctacagattgaaaaaaattagaagttgattactgttttgaaaattgggctaattccagatgttttaaataacatggcttttgttttatttaagtttatttttatgttttagggaggttttacataaatggagtcctaaacaaataggagaacaccttctactgaaatcgtaagtatcaaaaaatggcatttttattgggcattttcactaatttttatagtattagaactggaaacaaatcttattaaataactgtagagaaggaaattagagcagtgaaatgttggtgggactataacttcaaaggacaaagtaacacagagtttaggaataaatcctgaaatatatattatctttaaaataaattcctaatttgaaaggctagaatcacagactaattttgtgtatgttttcttaggaagttagcataggtcttcaatttatttaacccagattttcaaagaaagtataactattttattgttaatcagagatgcaaatgtatttgtatggtgataagcaaacccaaaaaaccttagtgacattgaaatgtagtcctgaaggcacttagtgattttacaacggtaaccatttttgtagattagaattttattcttcactttttaatttttttttttgaagattgtgaattggaaatcccccagcttgctggctccctcagtgggacattccagcacattattacttagtgatgttccattcaccttgaaaaccactacttgccaggacctggcccataagggttaggtaagtcccaccttgatattattttgaataactatattttgcaggcttgcaaagttgtaatattactatgtctaaatattggtgataggaaacaactttgcaaagctgtataatgtttttttttttttttaataataaaagggacttcactcaccattgaagactggcctaactctgctggatgggaaatctgggaattgatataagaggatagtaacagaaaagttacttgctcaaatatcactaaaaaggcaaactatggaatggatccctcatcctcaattttaagttttagatttataggctgcattagctatgtgtaggtagatgtccaatctattttctttgcaggctgtccttgttttatcatttgattttttcatctctgttgaataaagcatcctacgttacagatttctgaagttaatatttttaggctgtaggtattaatagttgaaaaccttaaaaagattattctagcttgactataaattatgttgacatattaaagcagatattaaaaaatttagtataagcatcttgtttcagtatactgataaatttgttttaatttctatagcctaacttacgtggtggcaatgcctttttattcagcaagtctgattgaaacagtgcaggtgagcttttttttactgtcattttttttttatttaagaatagttttttgactattcagtatattgtagatatctaacatttcagcagaaaattttaagactatgtcttaaaatatttattttataaatatcacagttatatcgcacgttgcttgtctgtatatttccattggtatcttaagtcacacttctagttttaattatttttgtcctttccataggcaactatactcttcatttagacatctcagaacacagcctataacttgctctgaaaacaaagaatctataaactttttaaggcccttacatacaactcagatggttatggcttatcattggacagtaaattaataattacctgagaataaacatgatggataatcatccgaacaggaagcaggttgtccccacaggtagtttactgacaggattcttttaaaacatgcctttaagtgacatttgatactattgggtgtggtaaatactacaaagctgaagcaattttctgctagcacttgaaattctgtttgcttgtgttactattcctaaccacatggtggcgcttcaagtacatttaattaaatgtcttaccctccttcctacacttaaaactgtaagatgaaggtagtttttacttcacctgtatacaaaatccaactatttgtacacctgtcttctatttccacatcagatcctctagcatattcttttctctagtatatgtgagtgccctctctgtaaaaactcgcactggatcagcctttgctcttctaattactcttttctaccttgtttcttttctggctgtatcattcatctttgatttatgattattattattattatttctgttagaactaacttcagttaactgaagttagtgtcttgcgacccaaatcatactttcccttccccttgcatttggcattgtgttaaataaatgatgaatttttgtatggtgctatagaatttacagagttgtcacttgtatgagatagcctcattttaaaggtaagggaaaaatgtcaggaaggtaattatttaaggaaaaacaactaagcagaatgatttattggggaaaacaatttttagcttgagacagacccattatcacatttctctgcttaaattagacctgggactttagacagatttcttaacctttataattttcttatccataaattgtgaatagtattttaataactgacgtgtaacattgaatgagttatttatataagtgcccggctcactatgtgatagggttttttctgtgtatgtgttttttttaacccagtatttactccttgtttcctgcttcaagttccacttgctaactccttttgatctcttttgtctgcttttctagaactcttttttctttagatttctctctcttgaacatcttttttcaataatgcctttgccatctcttgtcttataccttaaggcccaatccttgaccctctgttttttatcctatactcattattctgaaagagctaatttattcacaggaatcattagctctaatctcatgtgagttaaatcttcagactcaacttttaaaaacaatctcatctgtccctctaaaaattagcttcctttagaacctcttctccttggcaatatattagtgatactattgttatcttcacactaaagattcaaaactttagtttttgttttaggaaagttttttatttttacatttctttcatccttcataattacccagtcatcatgaactttgtagttatctatttcttcattaagaatccttgaggcctaggtgggcggatcatgaggtcaggagttcgagaccagcctggccaacagtgaaatcccatctctactaaaaatacaaaaattagccgggtgtggtagtgggcgcctgttgtcccagctattcaggaggctgagatggaagaatcgcttgaacccgggaggcagaggttgcagtgagctgagatcacgccactgtactccagcctcggtgacagagtaagactctgtcttaaaaaaaataaaaaagaaagaaagaaagaaatccttgtactagtctccacattttaaaagtcaatactcatacaagattgttttcaagttgcaatacttatatatatccttttactgattaaggattcatattgactcatattccctaaaatcaacttcagacttcttattatagttttaaaccaaggttttaattacatcactttacctttcagatttgcagattatcttaactgctaaacttttaaaaaaaatgtatcaattgtttattgagtacttgcctatatcaggtactgttatagaccctggggatacaacagcaaacaaaaccaaaatgctctgttctcatagcacttatattcttatggggaaagtagacataaacaactaaataaaaggtatatttcatggcgattaactgctaaagaaagcaaaaataaagcaaggaaggcaaataggatgtgtaatgggtagggaggggcggttaatatttttttaagaagataagtaaaggtctcactgagaaggtgacatttgtgtaaagatcaacatgcatatttgggagaatattctaagtagagggaaggcaagtgcaaatgcccttacatgggactgtgtcatgtgtgttgtatcatacatgcttgagaagtaggaaggatgccgatgtggctggtgctaactaagcacaaaataagcaaatgttgaattgtatttagagggaaagcaggtgcaaaaactctcaagtgggactgtgtcatgtgtgttgtatcacacatgcttaagaagtagaaaggaagctgttatggttggtgctaagtaagcaaggggggaatacaggagatgaggcctgagtggtaagaggggaccagattacataggacattgtaaatcattgtaataattgggcttttgtttgagaaggatggaaagtctttgataggtttgagcagagcggtggtgtgatctgacttacatctttattaggatctctttgactgttgcattaaaaataaactggagtgggaaggatgtcagggtcagaagtaggaagatggattagaaggctaggcaagctcactgtcatctcatagttttaaatatcatctatttactaaagactcccacatttataatacagtgctcctccactcacgatgggattacatcccaataaacctgtcataaattcgaaaaatcttaggttgagacatcgtaagttggaaaccatctgtaggtccattgtgtacctttttctgtaatttctattgtgaactccatttggagttaatttacttaacatttctgaactcttgatcttcaccaaattgctactctggcaatttttcatctcaataaaaggcagtgctattcccccagttcctctggacagcaaccttggggttatccttgacccttctcttgcataccccaaatgcaattcaccagtaattcccatagactttgattttaggataaaagcacaattgaaccactttacttctgttgccaccttctagtccaagccaccatcatctctttgttactggaatcattccagtaacttttgaactggtttctcaactgatcttgttctcctttgcacaacagccagtattctttcaaaatacaaattatgtcatgtccgtcttctgcttaaaatcaaccagttatttcccatctgactagaagccaaagtctacagattagtctctaaggcatgatatagcccctggctaccttataaatttcatctgctactttcctgcagtcattgctgcagccaaagtgccttttggcaagttcttttctatctatctatacctcggtaatccacatcaaactttcttattcatatccccaaaattctacaaaagcagacattgcaggtggtaataagactaacatttattgagtgactcctgagtgccaagccttttttcatttaatattcacaacaaccctgtgcataaaaagtagacagtgctcatttccatttttgtagaatgcgaaactgtgcttaggagaagttaagtaacttgacaatggttacatagccagtaagtaatggagccaggatttaaacatgtttaagaactataagcactatattgtctccttaagcgttacatagttattgcctttccatgtgagttctaagaagtttcttgagatgtatccacctacacatctccccagtctccctaccccaataagattagctcccaacttcactgctagcaattttatgagatttcatttgaaaaaaaatctgatgcctagataacagttaaagtctgcaaatcatggatgtttccctcttcagtcactatgttaggatttaaaaggaacctaaaaagagtcctttttctgtggcaaaataagcaaatgttaagttttacttatttcatcatttttatttcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacatttgagatttaggttccttcactgagtagtctggaagatataatctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagacttaagggatgattagacttggcaatctgtaagcaggagtataaatgttttaaattgcattgtccctatgtaactatcttaatggctatatatatgtattttataaagccatttatgtatacacatgtaacttggaatttccttcatccctacacattttctacacttacatcaccttattgcataaaacaaagtcacgcgctttctgcttgaacatcaaaatatcaaaaaccaaggtacccaaaagatacaagtcagagacaacatccttgtccatatccaaacccagtgtttcagtgctagcaacttaatttctcatacatttatagagtttggtttgctttgctagttgtgtgaatcattgggctgtttttagagccactgttaagagagaatataaaataatcatgacaattactactgtttccacatttacaaattgtgtacttaaatgaacctcatttcccttttatttctgaatggcttgtctgagaggaaacaaaattaaaattcatctggg

SEQ ID NO: 37804 - DNA, 134342 bp, Homo sapiens
aggggcggaggtgacagcgggctggggactggcggctgcaactgcctgccgcgccgagggaccgccgggcggcggaaagcaggtcagaggccgggccaggccggagccgggcgggggccgggcggggagcgggggtcgcggtccggggccgcgggcggaggggacccgcaccccgagagacgcgccgcgccgcgccgcgcggctaggcctgtatcggccctttcccagcggcggcgctgtgctgcgctctgtgggccaggagcccgcgagggacagtggggcgcagcgggccccctcgcactcctgtagtccccgggagttggaggggtggtcagagcaatgcgaacgtgggcttttcaagcggtgtcaagcccagggctctttctctgcaccgccctgccactccggcaatgaggcggaattttgagagctggaaaaagaattctgcgttagtccaccccgctgattttacagatgttcggagccttacggcataggaggccgtgattctgtgtcagggagacagggacagatggcttccgaagcaagggttagacctgttcagctggagatgcagctttggtcatggtggagttttgcagaaacccgcggacacccgcgttcctgctgcaggcacagatgtccaccgggcatctgtgtctcaaagggtggtgatgctgtcactttagtaaaggaatattgaggttaccaaacaggccggggcctgatgcagatgaggagtatagacttaaattttaagtgcaaaaacaactttaaatgcagtctcattattactgcctgtctcatttgtactgtaatgaagggtgaatatttttggcactcacttattctggaatatgggtaacttgcctttaggtctgttttatagtaattcttttacacaaacatgaagatcttgtattaaaacactttcataactaatgatgctgtagtatgtggcaggcgagtggtaacgctaatatttagggtttgagcatagtctagctctgcttgtttacatagctgagttaaacggatgagcaggactgattaatctgtagtagtttttgcaagactgaagtacctgacagcattcggggatcatttctcagttggtgttccgtttattactttcacagcatgaataccgacacggtgatcagcaagttagtttatcctctacccatttttctctaaaatattgaattaaaggatctctaaggtcctcttctgtctcgagttctccgattttacatgttaacttgaaacacgtcactcattgtgataataaaaatgttttaagaagaaaagatttttagaattctgcataatggggcatagcgaatcttcaaattcattattctcagctctctcagtcactttatcagggttgggctaaaataagtgaaaagtgacttttcaaattgcagatacttacgtgttaaattcacttaaattcagaggctgcaatggagtgatttctggagggtggagagtagctcaagtctggcttgggaacggggttcgtgcagtgcactgataacttttgcaataagccaagaacagtctgactcagagaatgtgataaattgacttttatacagtgttcatattgtgtattttttggctgagataataataatcttcataaacgatctgtttaaatatgcaccagttatttatttgtcttgcagccccaaggcagggcatttccctcaacgttccatcaatctcttcctcttttctggctcctgacttcaggtgatccgcctgcctcagcctcccaaaatgctgggattacaggcgtgagccaccgagcctggcttttggcttattttctaggtttagtattctgttgtttctagagtcagctaatggattacctacaacatggtattattacgagattatctcctgtgaaattctcgaatgtgcttgatcatctgccaaagcatccttagaattcattcagaatacttctggaaagttttgcaacaccaattcaattaatatgaaatagtttcttattatacacactctggaaaacatctgaataagctaattttcaagattggttaacttagtcttgttggtcaggagttaattatgagttattagtttcttgcctggaaaggcagaaagttcttaagtagcagcagtaaaatgagctctttaatgaaagagccgttaaaccaagatgttaacttttagttgtgttctttatcctccctgctatgaaaggcagctgtgggaggtgaaatagagtagctaaaatgtattatttcatttttagatttctagatcttttcttctgactgaaggacgtgaccaccaagaattgaaccagcacttgagggcaggcacatagggcattgtgtgaggagtctgaaggcatggcttttggtccttacttgtttattcactgaacacattctcactgagcacctgtgtgtgctgagagggtgggcacctgtgtgtgccgggaggaggaacacctgtatgtgcttgtggggggcacctgtgtgtgccggggtcgtggtagcacttgtgtatgctgtgggtgctgggagggggaaccagtttgaacaaaacagactaagccctcgtggaacagacacattctaattgggtggaaacagacaaatatgtgaatgaataggtcaaaggatcataatgctgtggagaactttagagtcaggaaagggtaagagtgtgtgtgtgtgtatgtatatgtgtggtaggggatttactttttatatagaggggtcaaataaagcctctactgagataacttttttttttttggagacagagtcttgctctgtcacccaggctggagtgcagtggcgtgatcacagctcactgtagcctcaacctcctgggctcaagtgatcctcccatctcagcctcccgagtaagctgggactgcaggcttatatcaccacgctgggccaatgtttgtatttttagtagacgcggggtttcactatgtcgctcaggctggtctggaactcctggcctcaagcgatccacccaccttggcctcccaaagtgctgggattacaggcatgggccaccacacctggcctaactcatggtgggagactggaaggaaatgaggaagtgagcaggaggcagtgggatgagcatgttccaaaccctggtgcaggagcatgcttggcatgttaggggtggcaaggtcatggtggccagtcagtgtggatgtgggttggggggaggtggcagcagatgagagggggtgggagtggggaggacacatcagtgtaggtcattgtaaggattttggcctttacactgagtgagggggaagccgttggagagctttgaacagtgaagttgatgatgacttatgttttaaaaggataactggctgctgggttgagaatagacaggaagaggacaagggctgagtcagggagaccttttcaagctagagctgtgtgactcacaccataattcttccctgagtcttcgtttcctcatctgtaaaataactgggccctctctagctcaagaattttaagttttcaagtagtgcagggtattatttctacagggaggcaagaggattgcgtgggaagaggttctgaaagtaaatcgcttcagatgacctgaaaacttgacaccaacctgcctgtagctgaatcatcccaaatcaagaggtaatcaggtctttttcagtcagattgtcaggtcatgagaacaaaaacactgtttcgtaaatattctctgctcatcccttttgtactttgctgatccctgaattttcccttcctgattgaaaaaggatgaaaagctgttactcatcaacagaactggcaaccagagtagcttttgttgtttggaaaattgggaactttggggaaggaaacaattctgtgtttatcgtaggtcataagagtttttcttttataacacgcaaggaatctaaaagattggttttgttgtagaattcccttgtcccattcatctcatgtctcacaggtgttcattcttaatgcattgcatgtgcttccttttgtttatgtaggagcttgcaaagtgggaatgtttgttttatgtgtatgtatcttgatttataatgctgtaattcattttcctttatgtagtttggttttttttttttttttttttggagacttttgagacaagagtctcactctgttgcccaggctggagtacagtggcgagatctcggctcactgcagcctccgcctcccgggttcaagccatttcctgcctcagcctcttgagtagctggaattacagtcatgcgccaccacgcccagctaatttttttgtattttagtagagacggggtttcaccatgttggccaggctggtctcgaactcctgacctcaggtgatccgcctgccttggcctcccaaagtactgggattacaggtatgaaccaccatgccaggtctctgagtagtgtttttaagatccatccatattgttatgtgtctaattctctgctttggaatgctgcatttataccccatgctgtttgcatccattggttttgctttatctgctctctgtgtagtgagtggttactcaagttgttcctaccccctaacaccataaatattgctgcagtgaacatcttcctacatgtctccttacaaagctgtataatatttctgtggaattgctggattataggcttgcagagactgaatttgattaaatagtgccagatgcctctccacagtggctgccccagtctctgtgcctctggaagtattaatatttgaggactcctgtatcctcatgtcccaccagcactcgcctctttccagctatccatggttttcaatctcgtaagcacaaagtgatatcttgtcgttttaatttatatttctttgatgactagagattttgagtatctcttatacagatagcttcctctgtaaattgcttattcatgtctttggcattttctgttggagttgatatctattttgttgctgttgacttgcagaaatgattttataatataggtatttattccctgttatgtttagactttgcagatgtcttctcatttgggcatcttgacatctgttgatcaaatcttctcatttagttctcgttttgtctttgccatcctttgatcaagaaatatttttaattttgatgtaatcaaatagataaattctttgacttgcggtttatgtttttggagttttgtttaaggaactcttcctgaaccctaggtcatgtctgtgactttcatctctctagggcccgcattttcatgtgttagataggaatccagccctatttttctccatttaatgacccagtttttctaataacatgtcaacaaaatccatgctttcctctatgaaattatggtatctctttctcatttgtggtttccatggatacacttgtctggccctaagcatttattttgttccattagtctgtcagttcttacttcatttttttaattgctctaattttattacagtgactttgtagtatgtcctaatgactggcacagcaagccattcatcttaaagtttatttagctcttcctggaccaaaatttattttttccatataaaatttggaataagtttaccaggctacccaaacattatatatacatatatatttatatatatatattttttcttttgagaccttgtgtcactctgttacccaggctggagtgcagtggcaccatcacggctcactgcagcctcaacctcccaggctcaagtgatcctcccattctagcctcccaagtagctgagaccacaggcatgtgccaccatccctggctaatttttcttttttttttttgtaatttttttagagatagggacgccctttgttgtccaggccggtcttgaactcccgggctccagcaatcttcctgccttggcctcccaaagtgcttggattacaggcatgagccactgtgcctggccaaaaaattatatttttgaggaatttttattggagtttattgagtttataaattatttgaggagggttaacatcttattttatttatttatttattttttatgtgccatgttgcttttttattttttatttttctttttaagacagggtctccctctgttgcccaggctggagtacagtggtgcgatgatagctcactgcagccaccacacccagctaaatatttttataagttttttgttgttgttgttgttgttttaatagagatgaggtctcactctgttgccctggctgggccctggccagtaactcctggcctcaaatggtcttcccacctcaaagtgtgctgggattacaagtgtgagccactgaaatagtaactcattccatccaagagcatataatgtgtctttccgtttattcagctcatttttctgacatttttataattttggaaataatttaaagctaacagaagagtgctaagagtatgttttctttgtgtgctttttcccctgacccctttaattgtagacatcatgtccctttaatctctaaatacatgcttcatcagttctttttgtttgtttgtttgtttttcttttggaatggagtctcgctctgtcgcccaggctggagtgcagtggctcgatctctgctcactgtaacctccgcctcccaggttcaagcaattctcctgcctcagcctcctgagtagctggggctaccggtgtgtgccaccacgcctggctaatttttttgtatttttggtaaagatggggttttaccatgatagccaggatggtctcaatgtgaccttgtgatccacgtgccttggcctcccaaagtgctgggattacaggcctgagccaccgtgcccagccctttcccattcttatacttcttattcatttttctttccttacagcattggccaggactactagaactgtgtcaaaacagctgctacactaacgggcatctttgtcttgttctcagtcttaaaaagagtgagtctaaagatttcctatttcatataatgtttgttttaggttttgtatgttacctttatcaagttttaaggtattaccctcaatcctagtttactgagagttttcatcataaataggtattaagccttaccaagtactttttcaggatctgtccttgaggaaataagatggcatcaggaaggctgtataccaaaatcctaaccctatgctgactttgtttcaagcagaagatatttattaaccctacatatataatttgtggaaagcatctcaagattccaatacaagtttatttcaccattaggtcagctttttcctcctggcattacgagtcagaatttaaatagctgatgtgaaaaatgagagaaagagccatactcaggatgataagttttgttgtcagcatgattgtaaatataagatatgtaaaattatagtttccttactctgtggatcggtctttacttcaggcataaatcttactaaattatatctcaagaaatattgaggtggctcgtcagtagagccatagatagctgtttagcagcactaactgctagggtgttgggcagtgaattctcatggccagctcttctctctctttctttttctttctttttagactagccattttttttcctaattgtgaaattatacctctttattacagagcatctgtaaaatatagaaaagcgaatctataatcctgccttttagcaccaacccctgctaaaacgttggttatttctctgtctctgttttttattggggtgggggagcatgttgaggaggagagggcacttaacattgcactatatcattttctatcacccctcctttttcagggctagatcattaactcatgttcattttgctttgattggctctctggggaaaaatcgatagaaaacttacaattaacttgtagcagtggggtgatagcttgctcctctcttggaacagtttatgcctgagggagcctccgtgcacaaacagcccagagtcattgtcagaacttggagcaatcctagccctaagcccaacagaccaaaaactagcttaagggtgtggaggggagaagtacttttgaggtctctttgcttcagttcagtcctcccaggttgtcaccttccttatctagaccacacttgctttaatctttcagaaaataaatagaatggagaaaatagtcatttattttcttttgactctgaaaacctagcacaggccacgtacggtggctcacacctgtaatcccggcactttggtaggccaaggcgggcggatcacttgagctcaggagttcaagaccagcctggacaacatggccaaaccccatcactaccaaaaaatacaaaaactagccgggcatggtggcatgtgcctgtagtcctagcgactcaggatgctgaggtgggagaattgcttgaacctgggaggtggaggttgcagtgagttgtgcttgcaccactgcactccagcctgggcaacagagtgagaccctgtctcaaaaaaaaaaaaaaaacaacaacaacaaaaccccatcacaattgttttgtttccctaatcactttttgctagtgtggaagtgacagaattcataggtgaacatccctatggtgaggagattcaatgtctacctgccttcctttctcactctctatcctttttttttttttttttttttttttttttttttttttttaatgagacggagtcttgctctgtcctccaggctggagtgcagtggtgccatctcggctcactgcaacctccacctcctgggttcaagcaattctcctgccttagcctcccgagtagctgggattacaggcacgcaccaccacacctggctaatttttgtattctttagtagagatggagtttccccatgttggccaggctggtcttgaactcctccctcgtgatctgcccgcctcggcctcccaaagtgctgggattacaggcgtgagccaccgtgcccggctcttttttcccccagtgtcctttggtgttgaaactgaaattccccattcctgtaccctgctgggttttttttttttttttttttttttttttgccataacaggtgtcactttctaaaacacaatggtctgccttcccaattcctcaaggagaaaattcttcaagggcaggaatctttgttttgttccctgttcataacccaagcccacctcgaacagtgcctggtacctgatgtgccctcaacagatgaatctataagatgaatcaacctgtaaagaagccacactgtgatccagagaagggtcatctaagggaggggtgagagaagaaagctctcttagcttcctttcaatgcataggttcagcaggctagtagaatccccatttttgtctttgacattgcaaatgaaaccatccacccagacacagagaaattagctctctgcatctgttctagcccctcctgcggaggctgcattttcccgaaagtagcatgtgaatgtttgtgttgctgacaaacacatggactgggagagaataatcagcactgacattctagctgtgggtctgggcccagagtgcattctgcattgttttcatgaggtgattctcttaggataaatgagcctgccccatcagcagaaaatgttgcaatggatgtgccgagttatgcttacctccccagcctcacaccccaggtcctcctgctttctagttggttctttcctcccctcccctgcaatgtggaaactttttagcttttctgtcatttccgaacaataagtattctgaacggtaagtattctaatctggttcagaattgttacgatgaacagttatgccttgcatacctggtcactgttttctaaagcaagtcttcaaattatattaatagcactatataaaatgctaaaaaattaaaaagctgccacaaatacaccataatggtgttcttgaggccagtgtcacacacccagtctatcctgtagaggccattgcttggctcatattcctgaaataccgcttttgtttattattctactgcctgacacttaccagtgcctaccacctctcccagtaaattttaaactctgctgcctgcctggccctcaagtctggcccaaatccacttatataaagtagtccctgcttttccacagggtatacattccaagacctccagtaaatacgtgaaactgtggatagcaccaaccctacatatactctgcattttcctatacgtacctacctgcgatccagtttaatttataaattaggtgcagtaagagattaacaacaataataacaaaatagaatacttataacactatattgtaataaaagctatgtgaatgtgggctctcttgctatcaaaatgtcttagtagtgtactcacctatttttagactgcagttgaccataggtaactgaaactgtggaaagtgaaaccgcggataaggtggggactactgtgtgtaacaacaacaataatgtaaaaacagcagctcatattttagctaccatactacatgcattgtcatttaattgtaaaatgattttacgaggaaggtgctgttagaatcttcattttatagatggagaaactgaggtacagatcgtaagaaacttgccctaaagttgtaccactgttaagtgaatagaattaaattcaaactcatgtctgtttacctccaaagcccgtgctctcaaccgtcttgccatagtggtccccaggtaaatgagtgcctgaagacagtgagtgacttgtacagtccagcagttactgaggttgtcctttttcagggtatgcgagactaactcaccagcactctgttagctgtggagggaagggaggattctgtctggagctggaactgctcagggagcccctctctggattctgcactgacagctgcagacagaaaccacgtggcacctccgaaaggagaaagctctgaaatcatccaggtagcattctttgacttttcaatccttttcataataaagtatttaaaatgtacaaaaatgaataaagaataatacatctgacgtccatgtatccaacactcaatttaaaatctaaaaagctaacttggtttctgtatttcacctccctttgccgttttatagaccttttggttctaatgacttaaaaaaaataggattcccttttatttatgtatgacaacaataccattattatcaccccccaaaacagcagtaattccttaatataatcaacagtctagtcaatgttcacaatttcccacttacctcatttttccttaaacaattgatttgtttgaatcagcgttcaagaaaagtacatgtattgtatttagttaatgtgtttctttttttttttttttttttgagacggagtctcactctgtcacccaaactggagtgcagtggtgtgatcttggctcactgcaacctttgcctcctgggctctagcgattctcccgccccagcctcctgagtagctggcattacaggcgtgtgccactatacccggctaatgttttttgtagtttagtagagacagggtttcaccatgttgcccagggtggtttcaaactcctgagctcaggcaatccacccacctcagcctcccaaagtgttgggattacaggcgtgagccactgcgcccggccgttaatgtgtttcttaagtggcttttaatttatgaatttatggttttcctttttttttttttgagacggagtcttgctctgtcaccaggctggagtacagtggcgcgatcactgctcattgcaacctccacctcccgggttcaagcgattctcctgcctcagcctcccgagaagctgggaatacaggtgtgcgccaccacgcctggctaattttttgtatttttagtagagatggggtttcactgtgttagccaggatggtcttgatctcctgaccttgtgatctgcccaccttggcctcccaaagtgctggggattacaggtgtgagccaccgcgtccagcttttttttttttttttttttttttttgagacagagtctcattctgtcacccaggctagagtgcagtggcgtgatctcagctcactgcagcctttgcctcctggattcaagcgattcttgtgccccacccacccaagtagcttgaattatgggtgtgagccaccatgcctggaatagagatggttttgccatgttgcccaggctggtctcgaactcctgagctcaagtgatccatctgcctcagccttccaaagtgctgggattataggcatgagccaccgcacctggcctccttttttaaatttaaattttttgcttgtaatttatttgttgaagaaactggtcgtttattctctagagtttcccacattctggattttttaagggtgtctgatataactttgctgttgtctctgtagtgagttaacttaccctttaatctgttggtcactgcaggaggttccaagttattcaggcctccataaatagaagggattcactggcccttgtagtttggtctggccccaaggtcatttctgaggagtctttcaaaatgttccaggtgtcagggaatgacattatcaacagcaggccatctctagttgaaaacattctgcctcagaaggaattttacaactgctatgtggaagggcattttcgtgttccctagagttaggggagaaaattgttaagagaataagtaccctggttttcttcttttagacagtgcttgtagctttaaggatttctgaggctgagtgccagaaactccttgggatattattgtcttacagtttagatctgcttatcaggaaacatctgagaatccctagagggtcagggaagaggaggatgagtttacattaaaaccagactttgttagtgcctgttagagtcccgtatttttgagcagctatatgggctgtggaacataacactcatccatgtttttcaaacccatagttttaattacttgttctttttgctaccagtgtctagatgttgttcaataattataacatctggactgctgtagacacaaagaaatccgttttcttgtatttttcttttagttttgctgccttgaccttctagtcagctgtgatagttctgtgggatagtgagccagtattaaagtgaaaagaatgaaaattgttgaagtatgcagctgtgtttggatttatttagtgatttgaagggtgtaagaagaaagtatctcaatgtcaatattttcatttaaagtcaaatggttaataagtcaagactaaaaatctaaactagaaaaagaaagacattcaataaatttattataaccctacttaatacttttattattattttactagctggttattttaagtaaggattttgctttgattaaagatgttgaaaacagttatgaaaatcttttgggttgaattttatttttttaatttagttggagtctcgctttgtcactcaggctggattgcagtggtgcgatttcggctcactgcaaccgctgcctcctggtttcaagtgatcctcgtgtctcagcctcctgagtagctgggattacaggcgggtgccaccatgcctggccaattttttatttttagtagagacggggtttcgccattttggccaggctggtctcaaacttctgacctcaggtgatccacctgccttggcctcccaaagttctgagattacaggtgtgaaccaccgcccccagcctttgggttgaattttaccaacatgttcaaacgttattcttgtatcccataggtgggattcaggcttggtgaatattctcttcttgtgattccaaacgtttaaaaattaaaatataattattattcacagtaagtgttgatgagaggtgatttgctagtttactgattgttttccctgcagtgatcagctaacaataaaaatagcacttcatgttcacaactgttcacaggtagcaataatacatacaggagataatgtatttgaaaagcagtctgtaaatgtaattgtactgtaataatgtgtccacgtggccttgcagagaactgcccattgtagatcaatgcctactgtgcctgacgtggcagcacctgggtgactccactgtcccttcttgaagacagacgtgtttattattttggcaacagccactggccccaaaaggcaaagataatcagacagtgtttatatagttgctcttccagattgtttgtcacattcttatagaatagcctgtctctctgtgtattcacttttatttctgtccatcataagacacaggtgctccaagtcacatatctgcaaccactctggcccaccagcacttcaaagctcaccccatgaaatgcccccaacaagcctgtttggtcatgacttaaacaaaattggatgtctttttcctagattcccctgccagtattttggtgaggctagagcttagtgtatatggtaggtagaagggtgtcaagaaatgaggtcaaacttgtatgccgggactagctcatgacaagctttgtatgatctgcaaacaagttttagacacttcctgcaagtgatggatggggaagccttagaggaacttcaggcggtaaagatgtataagatttctgtttttgccaggtgccgtgatcatgcctgtaatcccagcagttcaggaggctaaggtgggtggatggcttgagcccaggaagagaccaacctgggcaacatggggaaatccatctctacaaaaaatacaaaaattagctgagcgtgatggcccacgtctgccgtcccagctacttgggaggctgagatgggaggattgcttgagactgggaggtcaaggctgcagtgagctgtcatcgcaccaccgcactccagtctgggcaacagagtgagactgtctcaaaaaaaaaaaaaaaattgttttcaagctgggcacagtggcgcatgcccagctgcttgggaggctgaagccataggatcacttgagtaggagtttgagtccagcctgggcaacatagcaagaccctgtctctttaaacaaacaaacaaaaccatttttaagaagataatcctagttgggtgtggaaaataggacaaaggcagataagattggtaggtagccatttaggaagctattgcaggagccccaaagaaaagatgatgagaatcatagtttgatgtgtttaaaggatttaacagtaatgccaatgtttttcctagaagtacaggatatgttttagaacagtcagtaaattgatttcatatccctcttctattcctggaaggcatttggcaaaggctttcctggacccatatgcagggatctcatttataaacttctgccaaatccttgtgggtctgctgtgaagacacagctcattttagagcttagagtagaggggcacgtcaattgcgttgtcctggtgaccagtaaccacagagtcacatgactcccccttcctctcaagaagacagcagcagttttgagaagttggccccgcctagagcctgctgtctcatccctattatttatgttcccctccgcctgggtgatgatggtcataatcgtcatcacccgccattgtcatcactgttctcattgctgacatttactgagtactgtatgtaccatttgccaggaaatgtattaaatgttttacctacattatcaaatttaatccttatacgccctatgaaataaattactgttattatcttccattacagatgaggaaactaaagttcagaggggtttaagtaacttgcccaaggtcacatagcttgataaatggcagagccagaaattgaaactaaattctgtctgactggagtctgggctcctaactgttatgtagttattacttaatacaattcagtagcaaatatgacttctctttaaatttgctcttttatgtagcatcatccacccagtgaaagttcacttaatcaaacactgtgtttgttacctaccctccatgcccatcctataacaggcataaaacacaagtttaaagtatctattaaaacattaagtgtaggaaaaactttgtaggggaggggaggtggatgtgggtggcagaatagggaagctatttaaatttctagcttttttcaaggcagaatattcatgtatgccttctctattttttttctaccttcacagtttttttaaagacagggtcttgctttgttgcccaggctggaatgcagtggcatgatcacagctcactgcagcctcaaatctcccaggcttaagcgatccttccacctcagcctcccaagtagctaggactacaggtgcacaccagcatgcccagctaatttttaataaatttttgtagagacagtctcactatgttgcccagactggtcttgaactcctggcctcaagtgatccaacccccttggcctcccaaaatgctgggattacaggcatgagccaacatgcctggcctgccttcactattttgtgtgaagtatagagatttcggaaagaggagagacacttacttttaaaaattgagatacaattcacataccataaaattcaccttttaaaagtatataattcagtggtttttagtatatccacaaagttgtacacccattcaccactaattccagagcattttcattacccccaaaagaaacttcatacccagtagcagtcagtgctcattttccattcctgagacattcattttcaaacatattaaataccagaatacatcccaatgctatgaaaaaggttttgggagtgtctatctacaattcctctctctttaatgcagataatgataatagctgacactggtgtaatgcttactatttgtgaggtactattttcagtgctttacatatattaatttcattacaaccctatgagcaggttttatttttatttttatgttgaatctttatttttatttttatgttgagtcagggtcttgctctgtagcccagattagagggtgcaatcaccactcactgcagccttgacctcctgggctcaagtgatcctcccacctcagcctcctgactagctggggctacagttgcacaccaccatgcccagctaattttttgtattttttgtagagaccagatttcaccatgttgcccagtctggtcttaaaactcctagactcggccggatgcggtgtcttatgcctgtaatcccagcactttgggaggcccaggcgagtagatcacgaggtcatgagatcgagaccatcctggctaacacggtgaaaccccatctctactaaaaacacaaaaaattagccgggcttagtggcgggcgcctatagtcccagctactcgggaggctaaggcaggagaatggcgtgaacccaggaggtggagcttgcagtgagccgagatcacgccaccgcactccagcctgggtgacagagccagactccgtctcaaaaaaaaaaaaaaaaaactcctagattcaggcaatctacctgcctcagcctcccagagtgctgggattacaggcgtgagccactttacccagccaggttctattattaaacccattttacagataagaaagttaagacacagagaattaacttgctccaaagaagcaagtaagtaattaagtaattgttttaataaaaagttaagtaattgctgtaataagggatggagctgccatatagatctaggtagtctggctctatagtctgtgctcttaactattacattttgttttgttttgtttttgagacgggatcttgctctgtcacccaggctggagtgcagtggtgtgatctcagctcactgcagcctcaacatcctggactcaagcagtcctcccactttagcctcccaagtagctgggacaataggcacatgccacctcacccgcccaatttttggattttttgttttagagatggggtctcactatgttgcccaggctggtcttgaactcctgagctcaagccatctgcccccttggcctcctaaagtggtgagattacaggcatgtgctactgctcccagcttaacttacatacgctctaagctgatcatatttctttttttttttttttttgaggtggagtctcgctctgtcacccaggtaggagtgcagtggtgcaatctcggctcactgcaaacttcgcctcctgggttcacaccattctcctgcctcagcctcccgagtagctgggactacaggcgcctgccaccacgcctggctaactttttgtatttttagtagagatggggtttcaccatgttagccaggatggtctcgatctcctgaccttgtgatccgcctgccttggcctcccagagtatatggggtcttttgtgattggcttcttagcacaatgttttcaaggtcttcatgatgaagctgatcatatttctattttaaaatgatatgaagaccttgaaaacattgtactaggaagccaatcacaaaagaccacatattacatgatttcatttatatgaaatgtcccaaataggcaaatctatatatagagaaagtagattagtgtttgcctagggctggagaggagaggggatgttgtggggaaatgggaagtgactgctagtgagtataaaatttctcagaccggccgcggtggctcacgcctgtaatcccagcactttgggaggccgaggtgggcagatcacgaggtcaggagtttgagaccaccctggctgacatagtgaaactctgtctctactaaaaatacaaacatcagccgggcatggtggcacgtgcctgtagtcccagctactcaggaggctgaggcaggagaatcgattgaacccgggaggcagaggttgcagtgagccgagatcacgccactgcactctagcttgggcaagagagtgagacttcatctcaaaaaaaaaaaaaaattctttatgaggttttgaagttctaaaattgatagtgataatggtcacacaactctgaatatgctaaaaactcattgtacactttaaatgggtgaattgtatagtatgtgaattatgtctcaataaacctgtttttaaaaaatgagatgaagagaaacaaccagaataatgatgttgcttagaatatctttgccttcacctggaaaaagctatatatatatatatatatgtgtgtgtgtgtgtgtatatgtatatgtgtatatatatatatgtgtatatatgtgtgtatatatgtgtgtatatatgtgtatatatgtgtatatatgtgtatatacatgtgcatatatatgtatatttgtgtgtatatgtgtgtatatatgtgtgtgtatatatatgtgtgtatatatgtatatgtgtgtatatatatacacttatacacacactgtctttcttgtccttttttttttttttattcattaatttggggtgtttagtcatttgcaaccaatcctattttttatttttttttttgagacaggatctggctttgtcacccaggccggagtgcagtggtgtatctcagctcactgcaacctctgcctcctgggtggaagccatcctcccacctcagcctcccgagtagctgggactatggttgcacgccaccatgcccagctaatttttgtattttcagtagagatgagtttcaccatgttgcccagactggtctcaaactcctgagctcaagccatctgcccaccttagcctctcaaagtgctgggattacaggcatgagccaccacgcctagccagccaatcctaattttaaccattgtatctgcctactaaaaaatcttcaggtgccgctaattgcccaaaaaacaaaacccaaccttcctaacctggaaataagtcctgtgaaacctcatgtacctctgtgggaaagaatagtgtgatcactgggaatgtgaatgtacgttttgatgtataaattaagacagttcagtatgttaaaccattcatcatgcaaatatttacggagggcttactgtgtatcaggcagaactctaggtgcttgattgacatcagtgaataaaatagacaaaaagaatccctgccctgtaggacatacaggaaacagggatggatccaaaagagaatagttaactcagatggtaagagttatgtatgggtttaatagaagagggggcagtttaatagaagagggggtacatagcagtttaatagaagagggggtacatagcagtttaatagaagagggggtacatagcagtttagctgatctgagctagactaggttgaatcctatagtcttccatttgggttcaagtctgttttttcttttttttgagacagagtttcgctcttgttgcccaggctggagtgcgatggcgcgatctcggctcactgcaacctccgcctcccaggttcaagtgattctcctgtctcagtgtcccaaatagctgggatcacaggtgcccaccaccacacctggctaatttttgtatttttagtagagatggggcttcaccttcttggctaggctggtctcgaattcttgacctcagatgatccacctgcctcagcctcccaaagtgctgggattacaggcgtgagccactgcgcctggcctcaagtctgttttttcttgtcttcattctggggcccaggctaaagagccaggggctttcagggcatgctcttctaatggcagattacaggagcaccagaggacaggccaaaccataaaataatggctgaaagcctgtgcttatgccatctccactccactccaagtcctaccaaaatgtgacagggaaacatactctgcctgtagtgggaggcactgcatgattacacagtaaagggtatggatatgcaattctatatttgtatactattaatgatatacataatgatatacattattatacacatataattacacatcttgtaaggatatataattcctacaagagggtgaggattattgaatagcagttctgtctactagcgtatatattataagaataagaagtagctgaaaaagtttgaatatagaggtgaatggacatgggtatagaaagggctaaaagttggctgggtgcagtggctcacgcccataatctcagcacttttgggaggccgaggcagacaaatcacttgagatcaggagtttgagaccagcctggccaacatggtaaaaccccatctctactaaaaatacaaaaattagccgggtatggtggttcatgcctgtagtcccagctcctcgggaggctgaggcaggagagtcacttgaacccaggaggcagaggttgcagtgagccaagattgaaccactgcactccagcctgggtgacagagcaagactccgtctcaaataaataaataaataaataaaaataaaaataaaattgtcagagatatcaagatattgctagaggagtggggacaaattgtgaattatggtggttaaatgatgcactgatctttgtctcgtttcagtgttgctagtatgaattctaattcataacactatggtgtaaagacattagatatttacttatctaatctcattttacctattctaagctcccctctacctggctattggaaaacttaattttaggtatcattggagcccttcttcctttcctgtacccagtgggccaggcacgaacagagcaagactaacccttatatgcaaatctgacaaggacatttaaagaaaagggagttatagactaataacccttgagagcacaggtgtaaaaatctgtaacaaaaaagtaccaaattgaaaattgaagtctctaaagaggataatacatcataagcaagtagaatttatcccaggaatgcaaggttgatttaacatttaaacttatgacatcagaataaagggggaaaatggtcatctcattggacgcaggaaaagcatttgataaaattcaacaactattcatgatttttttttttattaagcaaaatgaaacactgcagaactggtgtgaagttgtgaactatttcccccgcctgcctctgagcaggaatcccaatgatcagacatgctaactgcctagatggccccgcaaaagtctgtggagtctctaggacatagttaattaatcgacctgtgatcatatgcatttgctaattgttaggaagttagtagtccagtttatatcaactaccacatgctactgttagtttctgtatcaattttgtaatattattaaaatatcctttttgttctctctcatagcagtctgtaatataaatctcccacctgtttctttctcctttcatctttttttttttttgacatggggtcttactctgttgccaaggcaggagtgcagtggcatgatctcagctcactgcaacctccacctcccctgggttcaagtgatcctcctgcctcagctcccaagtagctgggactacaggtgcacaccatcatgcccagctaatttttatatttttagtagagacagggttttgccatgttggccatgttggtctcgaactcctgacctcaggtgatccacctgccttggactcccaaagtgctaggattacaggcgtgaaccactgcacccagcctctcccttatcccagctactcttatcttatcccagctactcttcgtaatgttttatccccagattcatgggttttcatgtggatatattattttctttttcttatttatttgttgtggagatgagatctcactatgttgcccaggctggtttctagctcctagcctcaagtgatcctagcctcggcctcccagaatgctcggattacaagcatgagccaccctgcctggtcttattttctttacatgtcatgttagtgcccccatctcctgttagagatttctttttttttttttttgagatggagtcttgctctgtcgcccaggctagagtgcagtggcgcgatctcagctcactgaaagctccacctcccgggttcatgccattctcccgcctcagcctcccgagtagctgggactacaggtgcccgccaccacacccggctaatttttttgtatttttagtagagacggggtttcaccgtgttagccaggatggtctcgatctcctgacctcgtgatccgcccgcctcggcctcccaaagtgctgggattataggtgtgagccacgtgcccggccttagagatttcttttacatgaagtgaaccttcccactgttgaattttgggatgagttctaacatacctcaagagtcatagactgtttttactttgttgtattataatttcagcctcactttgttgctcatactctgggccttgatatactgtatggatgtcctaacctctgattgtttcaagctcacttgcgtttgttgtccgttttcttcattaaatattatcctgcatattatcctgccttgcaggtttttttttttttttttttttttttttttttgagacggagtcttgctctgtctcccaggctggagtacagtggcacgatctcagctcacgccttgcagttttatatctggggctttgtactttttcttttctctttttcaaaattcagcttaaagtaattggaatcattttggcacatttcccaccaaataaattctcccttgcttttgtgaagggcagccgtcctttaccagaacatatcatggaaatactgttagtctctgaactaaatttttttttccagagatggggtctcactatgttgcccaggctggacatgaactcctggcctcaagcaaccctcccaccttggcctcccaaagaactggaattatagggacacaccactgcatctggctaagaactaacattttaaatcagaactttaataaattaatgtgggtcaagattttccatgaaatagcattaactttactcatgaacattcccctttgctttcttgaatggataagaaagatgtatatcctctgtgacttagagagggaaaaaaggcttgaacatctaggacattgagaggccaggcaccgtggctcacacctgtaattccagcacttcaagagggcgaggcaggcggattgcttgagctcaggagtttgagaccagcctggccaacatgatgaaacccgtctctacaaaaaatataaaaaattagccaggcatagtggtgcatgcctgtggtcccagctacatgggaggctgaggcaggaggatcacttgagtgcaggaggcagaggttgcagtgagctgagattgcgtcactgcactccagacttcactttctgacacctctcatcctttcatacaaagagaagaaattattcatttagccttcgtgttgtcttgtatgagctcttgtattgtcaaggacaagagaaatgtgcagttgcttttaaggttagatattccttctcattgctgggacttgagattttttaaatggattctcattcccaaaaggtaatgttaactggagagttcagttccaagacataaggatgctcgtggaagcatattcttttgaaggaacctccacctgacagcccctacaaaaagggaacccctttcccagctcttcccaggtaggtactctcccctgggtggctgagcgagaccctgactcaaaaaaagaaggacactgagttcttttgacaccatctaaagaatcagccattcattgggtttgccgtgttgtggcatattctctggttcatcttgaaattatatatacattttattttcaagtatagtggctgtagtttctataaaaggcaagcagtactgcagtttttgttgttgtttgtgtaaagctgctcgtccctggttttccatggtgctcaaatgttggtactccttaaaatgatctaaaatcacctaccctgctaatgatcttagctatttttaactccaattggacagtttgtttcctcccaatttttcttcctcagaatcttcagttttctaaattcttttcctgatttttcttccaaaatatcaagaatattttataccttaaaataggttgaggccaggcacagtggctcatgcttgtaatcccagcacttttgagaagctgaggctggaggattgcttgaactcacgagttcaagaccagcctgggcaacatgatgaaatcctgtctgtacacaaaaaagggaaaaatttgtaaattcattatctgggtgtgggggcacatgcctgtagttccaactacttgtgaggctaaggtgggagaatcactttagcctgggaggtcaaggctgcagtgagccgtgatcatcactgcactctagcctgggcaacagagtgagaccctgtgtcaaaaaaaataggttgaaaggtagagaaattcctcatgtctttttaaatcttctgtagcagaaacacaagtttgtgcttgaaacagataagaaaaagaaacaagatgcctgccttgcagatctcactaacatttgtcctcacaacttggaacactgggttaataaattttcttagtgtcttctggaaactgtcttaaaaactgcgtgtttttacacgtttattgtgttctttgttatctatagccacaccctaaagtttcactttatagtttcacttaatctgcacgtctgtaactgctgtcatgtgtattacatctgcaacatagtggagctgttaattttaatatgttgctcagctacttagctctgacatgtccagtttatttagttatgagtcagtggttcttaaatttccacccataattgagattcatgcattatttaagaaatgtgagtctgagaggatacttaggaactcctaggttaacccatttgaaaatatttcttgaatgtaaatttcctcaaactttgtaggtcctgaaatattaatcttgggacctccctccaccagtgcagtttcattaaaaagacaaaactgatgtggagatatagaagtaattttttaaaaaaagagctaaaaatggaaggaaaacagcagtttaatatgggtggcgtagacgctgtaaattagttaaaactactgtactgtgagagtcaatcctgaagctttcttattttaaattctgtctttcgtaaaacaaaaaaaatttatagaagtgttcgggtggtttagataagggttgctcagtttaaatcctgagaaggactgaggcggccttccacgattggtggaaactctgacatgtatcctgttccatctggagttgttgccttccaacttgggccaagtttgaaatcagcaaagtgttgcaatataagtagtttcagacggtataggacagcagattcctttactttcctaccctagtttctctggtcagctcacctaagccagcgcagggttttcatttgttcttccagttcgacattctgtaccctgtggaaccagagtccgtgtggtgagtcagtgctgcggtcctgggggcacgcagggtaggaggccgctgttgaagagcagatggcccaggccgtgcttctcagccatgtggggatgctgcggccaagaggggtcctgcttttccctcatctgttgctagttatctgaagaatctctgaggaacctggctgtgactgctgaccttctgtccagagtgaactccagcgacataaaccataggaggaagtgctgttttcctagcttctctcatttccttccttcctgaagcagatttagacttcattttctgacacctctcgtcctttcatgcgaagggaaaaaattactcatttagccttcgtgttgtcttgtatgagctcttgtattgtcaaggacaagagaaatgtgcagttgcttttaaggttagatattccttctcattgctgggacctgagattttttaaatggattctcgttcccaaaaggtaatgttttctggaaagcagttccaaaacataaggatgctcatggaagcatattcttttgaaggaacctccgctggactgcccctacagaaagggaatctctttcccagctcttcccaggtaggcagtctctcctggtagagtaagcaagaaaggagagacagctgttttttgtctttcagttaaggaaaccccttcagaagttttgttctgggaccccagaatttgaatttttttttttttggcagggtctcgctctgttgcacaggctggagtgcagtagtgcgatcagcttgctgcaacctccacttcccaggttcaagcaatgccacctcagagctgctcccccatacccccgccctgagtagctggaaccacaggtgttcaccaccacgtccagctaatttttatatttttgtagagacagggttttgccatgttgcccagtctggactcgaactcctgggcccaagggatctgcctgtcttggcctcccaaagtgctgggattacaggcgtgagccaccgtgcccagcctcaccagtgctttttgaaagaatatactgactaatttaggggagtacagggaacccaggcattaatatttttctaaattttttttaaaccttcaaaatgtatgtctccagtgcttacctctcacctggatttagaatggtggatttagggaactatttttatagttttccatatactttgctcaattctttattttattttattatttatttatttatttattttttgagacagggtctcgctctgttgcccaggctggattgcagtagcacgatctaggctcactgcagcctccacttcctgggctcaagttatcctcccacctcagcctccccagtagctgggactacaggcgtgcactaccacgcccagctaatttttgtgtttttatagagacaggatttcaccatgttgcccaggctggtctcgagctcctgggctcaagcaatccaccctcctctgcctcccaaagtgctgggattataggtgtgagccactgcgcctagccatccccattcttttcatgtgttgttctcataaatccaagtcatccttttgggcgtgtatcactcaggggcccagcagaaaacagaaggcacactcaaattgggtaattggaagaggtccaacttaaagcagaatggagaagtttagggaaaataacaaaggattgtaccatatgtcacggctagctggagagccaccctgctcctgaagaggtgggggatggaatggttacctgatgcaagagaaagctgttttgaggaggtcttcatatggtagctgtggtgtttaatagagcaacgcagccaactcacaacccagcagggagagagccaggggagtaaatatcacaatctcactgtccctctgccttcagacctcctgccagtgccatccattggctgaacccaactgaaagccagagatgggggaggccttgttcagttctggtgggccagcctccgggaacacagggtaggctggggcagacctgaaagggcagattttcggtatcctcaatctgtgccaagttcagactttgattccaaaggccacattagaaattacttattaaactgtttgatatcggtgtctatcagggtaaaagtttatagtttgtgatctcaggagattttttaatgaagtatgtccagacttgaagatatgttgcttaataaaaattactggccaggcacagtggctcatacctgtaatcccagctctttgagaggccaaggcgggcagatcacttgaggccaggagtttgagacaagcctggccaacaaggtgaaaccccatctctactagaaatacaaaaattagctgggtgtggtggtgcatacctgtaatcccagctactcaggaggctgaggcacgagagttacttgagcccaggaggtgaaggttgcagtgagctgagattgagccactgcactccagtctgggcaacagagctagactccgtctcaaaaaataaaataaacattactgagtcctccaggccttctttcacattcacgttttatgacataccttaaaatttttttttattgtggtaagtgtacataacataaaatttaccattttaaccatttttaagtttacagttttgtggcattaagtaattcacattgcttttcaaccattactaccattcatctccagaactttttttatcttcctaaactgaaatgctgtacccattacatactaactccctatctcctcttctcgcccctaccccctggcaaccaccattcagcttttaatctcttatgaatttgacccctctgtgtacctcattcatgcagtatttgtccttttgtgtctggcagatttcacttagcttaatatctttttttttaagacagggtctcactctgtggctcaggctggaatgagtggcacaaacactgttcatggcagcctcaatctcctgggctcaagcaaccctcccacctcagcttcctgaatagctgagactataggcacctgccactgcgcccagctatttttttttttttaattctaattttttgtagagttgggttctcactatgttgcccttctgggctcaagtgatcctctcctcttggtctcccagagtgctaagattacaggcattagccactgaggccagccttagcttaatgtcttcaaggttcatctgtgttgtagcactttacagtgatacatattgtaactttttttttttttttttgagacggagtcttactctgttgcccaggctggagtgcagtggcccaatcttggctcactgcaacctctgccttctgggttcaaacgattctcctgcctcagcctcttgagtagctgggattgtaggcatgcatcaccacacttggctaatttttttgtatttttagtagagatagggtttcgccacgttggccaggcttgtcttgaactcctgacctcggatgatccgcctgcctcagcctcccaaagtgctgagattacaggcctgagccaccgcacccagctctacattgtaaattttatttctgaatatgttttctctgatacatttactctcatggcttttaacttttacatgtccagtccaatgtctcacaaatctgcaagatggttgatataagagcaagggctgcaggacttaagacatggcaaatgagtggacctgagcaggagaggtggcatcatttgggggaagtactccaggtgtggaaagtgtttaaatatgtgggactgaccatggaggaaataaacagcagtaaaccaaaaaacaagttctgagcggacagtgccttatgggagctgagacatttcgtttggatgggactgccctgaatattatttatgaatgacaagtggagtgggacaaggttacacaaatctgaagtggggcctgaaaacggcgtgctgtggccagacaagtttagaaatgccagattgaaaaggattcttgccaaattgtttcagtctttaatatgctaattttaaaatgctcctctaagaaggaaatatggtttatagccttcctggagtttatcatgatcatggagctcttgtgtcttggagcacaaagattagcgtcctcagaacatgttttgggaattggtggggactaaactaagcttcttgggtgcagggactataacttatctcccacacaacaccaggaaggttcctggacacatcattggagcaaagctggattaataggtaactgccaaaggctttagtccatagaaagtattaaaatatccttgaggcacaaaaaaagtcactgcagatttgagtccttccccgacccccacattgaatgggtaagactgagtgagtgtctccttttgagattagtgctcgggctttatttttttcccagttgggtagatacttggtgataggagttgaattgcttaggacaatagaggagactctaaacgctactgtccgccaccaacaggattagagaataaatacctagaatgttgggtgaagggtcatcaaatgattagcttacccagtcaagccagatttttagtttgcatagggctttggttgatgccatttggcttgataaatattcattgaatgtatgaattatagaaaataggaggacctgtaaattctcatccaactgtgttatatatataaattgacattttagaaagattaatcagatttactgccattttagtggggaaaacagaactgcaattctgttaaaatccagaatttgtaattccttggccagtagggagaggaaaaaggtactttaaaaaaacaaaaataaaaaaaaactgctggccaggcgtggtggctcacgcctgtaatcccagcaatttgggaggccgaggagggcagagcacctgagttgaggagttcaagaccaccagcctgggcaacatggcaaaacctcacctctgtaaataaattagccaggtgtggtggtacacacctgtgatcgcagatattcaggaggctgaggtgggatgatcacctgagtctgggaggcagaggttagagtaagccaagatcacgccactgcactgtagcctaggtgacagagaccctgtctcaaaaaagaaaacaacaacaacaaaaaccgtaaacaaatattggactctagttaagatatatatgtcagagtttggtgggaaatgtttatgatttattttgaagtgcatcaaaataaaaaatatatatatttgaaatgcatccaaaaaataacacaaattgataaacgaataaagggatagataatatgtgataaagtaactgcagtaagatgttaatgctagaatctaggtggtgggtgtaaaattctttcaacctcactgtttgaaaattttcatagttaaatgttggagaaacagaaaaatggaagtctagaggatgttgaaggaagaaccaatgaagtttaagaaaagtgatgtttgccataaaaagaacgtgggcatgggaatcaaacaggcctgaattcgggttctggtttagctatttgtcagctaaagagattgagtaaattgctcagtggtggtgctgggattggaatgcaggcaccctggctttggagacttgctgtctaccttgcggagtcgtgaggatttaagctcctagatcagtgtctgacacttggtagataatcatacaatagctgttgttcttagtgtaccgtctgccatagaggatgaagaagtccaagacattaatgcttgacctggaagatttctatgacattgctatggcactgttgccagtgccatacatagatagacaagctggaaggtaaaactatttttggggaagagatggttaatttagttttaggtaagtaaaacttgagattttgatatgaatagtttcatatattgtgacaggttggattattggaaaaaaatttttaaaagataagaataaaaaaagagtttcatatattttcccaaacttcaacaaatcgtttgttcatcaaaaatctgaaaatattttatgtgccaggcactgctgtagaccagtgaatgaaataaatctcttccttcacagagtttacattctaaaagggtttgaagaattttctttccaaatatatctatatttcaaatgcagaatgactccctaaaggtggaaagataggcgttcaccagcaagggaagaagatggtgttttcatagcaaatttttctgctgtccctgaaatcatgccatataagcagtaatttcctcggtgttctctcaagcccatctgtgttctgatttcctctgcagttctttttacttctatctggagttggtggaacagcttatagaagccatttatgattgtttcaaaatatatgctcaggcttctaaaatggccctggcatgaataagagtagctgcttttcatagggtatacagggcagagaagacagatgagattcgtcatattatacatacttttgggtctcacacatgaatcatgtaatttagcgaggccgtgacttcagtacccttctagggtgtgtgctcctcagtgattatgcactcattccaatggagtaggaggtcagtcagtaaaagtatttattgagccagattctcctctgcttctgagtcattttctggtagagtgaaaaggttctctgggagaagctttaactctttcagattacaagcattactccctttgtgtaatggggtagttctctaagtaattatatggggtttatgctaattctttacttgatattttagataattagatatatctagtctgatagatgaaatctgagaaaatgtagtataagaagaaaaatagtatctaatttggccgaaggttaaggaatagttttaataacataaacatctagatggctaagaagtttgcaggacattatgtgtggtgtttttttttttaagaaaatacttaggacaccacccttatgtggaaatctgacatctggcaacttcagtcctctggaagacagccagaaagtaagaaaggggcctcagtgcacatgaaaataactgttgaaaaactctaccacgaacatgtgtcctttcccaccacagtagagtttgttagcctcgcatttagagcttgtttacttttatttatctaggaactttacataattttggtagtatgcgtgtggtctcccctccatagcagatcataaacagcaatatagcaagggcgtggaaaagttgacagaggagagcagagggtaggctgacgttgaaagagaaaggcctaaaagatagacagtgctggtattgtgtatcacagcttaatacagtaatgtgtagtcttaataatgaacttggacccatcagccaaagagtaagtcatgttcaaggtcttctaataaagaagtcagggaagtctggagtgtgtctatttttaaacaatcaaagttaaccaggttttgacatgttgaaatggtaagctccgtagagtttatatgtttgaaatagcacattctctgatgatgctatatcagtgacacaaatttgagcttgcagttgattatggaaatgatgctttgtaataatgactaatgtttattgagcagctactataccagccctgacctaggtgctttcacactgttagcatactggttaaggctttggagacagacagatttgggttcccattacacctctgacttactatgtgaccttggacagctatcatctctctgatcccgtgtccccacctgccaaatgggaaccaataacatatgatagggtccttgcgaggactcagggaagtacatggtaaatgcatgtacctaggaagtactcaatgaatgttaggcactgttataactataatagtcttgatggttattatgaaagtatgattatctccatttttctggatgaggaaactgaagcccagagagtttaagtaagatgtccaaggtgaaatcgctaataaatagtggagctggcctgtggacctgggtctctctgactacagaagcctagtgctttacattcatatatgctgcctctgcagcatgtaattataattagattttttttggtaatacttagagaaaatgtgttagtagcatctgtgggaaatacccacttaccacttctcttttccactgtggactcaagtcgtcttattatagacaaaaagtctataataagtaacacaaagataacctacttttgcttgacagtacaaattaaataggtaatgtttgtgtagcatgatttattaacatcttctaggtactccatattaatatactaaatgatttattatatgcctaatatgtttatccacatcagtgttttcttggatataattttttttttttttgagacatagttttgctcttgttgcccaggctggagtgcaatggtgcgattttggctcactgcaactccgcctcctgggttgaagtgattctcctgcctcagcctcctgagtagctgggattacaggcatgcaccaccacgcctggctaattttgtaattttaatagagacggggtttctccatgttggtcaggctggtctcgagctccctgacctcaggtgatccacccgcctcagcctcccaaagtgctgggattacaggcatgagccaccgtgcctggctggattataaattaacagaggtcaggtatggtggcttctccctgtaaccccctggcactttgggaggccaaggtgggtggcccaggagtttgagaccagcctgggcaacatagtaaaaccctgtctctacaaaaaggtacaaaaaaaattagctgggcatggttatgcatacctgtagccatatgtacccaggaggctgaggtgggaagattgcttgagccctggatatcgaggctacggtgagccactgctctccagcctgggcctcagaataggaccctgtctcataaataaataaaattaacagagctaccactaccttttctttttttgtaattaggcacttcatgctttttgatgtgatgatggttgtatgtgagatggaaggtagagtcctcattcatctctaccaagaccaaataagtacttgagatggttgaaaatagacttgtacttgggaggctgaggcaggaggatcacttgagcccaggagttcaaggctgcagtgagctatttttgcactccagcctgggcaacagagcaagaccccatctctaaaaagaaaagaaaagaaaaacagatttcaggcctggatactctggtgatcttcagctgctcctttaagagacctagggagaaatgtagctgtcatcaaggctgattgtctacagagggatggatgtccactacttatgtcctctctttctgctgcttcaatacatacgtaggttccccagccacatgcatcaaggtaatggacacatcgtcttattacagcacagacaccgtaacagtacaaggatactccccggggttgggccactgacttctgtgaaccaaaaacatatacttgatctggcataggatgctaaatcttgtctggaggtgccatctacatagtcctttcttcctttcttacagatttttacttttctaacttttttttttataaaatagaggtgaagtcgtgctgtgttgcccacgttggtcttgaactcctgactgcaattgatcctctagccttagtctcccgaagtgctaggattataggcatgagccattcaatagattttccctttccttttcctttttccttttctgagtctcactccgtcacccaggctggaatgcaatgaatggcatgatctcggctcactgcaacctcggcctcccaggttcaagtgattctcctgcctcagcctcccaagtagctgggattacaggcacccgccactgtgcctgactgatttttgtgtttttagtagagacggggtttcaccatgttgcccaggctggcctcaaaactcctcacctcaggtgatctgcccgccttggcctcgcaaagtgctgggattacaggtgcgagccaccgcgccagtccccaacaggttttccatctaggcctttgaggcatagttctgctgctgttcttcaggttgtggtacatttgtttgcagatagtctcagtaggtaggaaccagaatgccctcagtttgagttctggccctgctgctgtgagcactgtgatcttggacaaataatgttttctaactatactgagccttagtatcctaatctttaagatctatagggaataaaatgccatatttaaaatctctactttttaaagtattgtattttaaaattaccatgttgtctggtgttttaaaaatgttaatttcattactgccctcttcaggcattctgaaaagcctacatttgctgacacttgaatcttttctatcactgagaggtctagggtttttgttttgttttgttttgttttgttcctgaattcctttgcggtccaaatgaaaaatatatgaagaaattattatttttaaattagaccaggtgcggtggctcatgcctggaatcccaacactttgggaggccaaagcaggaggatcactgaagccaggagttcaacactagcctgggtaacgaagtgagatctcatctctacaaataaataaataaataaataaataaataaatgccgcaggcagtggctcacgcctgtaatcccagcactttgggaggctgaggtgggcagatcacttgaggccaggagtttgagatgagcctggccaatgtggcaaaaccctgtctctactaaaaatacaaaaattagttgggcatggtggtgcatgcctgtagtcctacctacttgggaggctgagccttgagaatcacttgggaggctgagccaggaggcagaggtggcagtgagccaagattgtgccactgcactccagtgtggaacacacagcgagatttcatctcaaaaaataaaaataaaaagtcaggcacagtggtgtgcgcctgtagttccagctactcagaaagctgaggtaggaggatcacttgagcccaggagctggaggctgcagtgagctatgatcacaccactgcactccagcctgggtgataaagcgagacctgtttcccccggcccccaaaaagggaaaaagaaatgagaaataactttgatattttaaaatatgaggccaggtacagtggagcatgcctgtaatcccagcactttgggaggccagggtaggcagattgcttcagcccaggagtttgagaccagcctgggcaacatggtgaaaccctgcctctagtaaaaatacaaaaaattagctggacatggtggcacatgcctgtagcccaagtttcttgggagactgagctgggagaatcacctgagcccaggaagtcgaggctacagtgagccatgattgctccactgcactccagcctgggcgatgggagtgagaccctgtctcaaaaataaaataggaagtactaacttatttgcttagctttggcttcattttaagtatatttgtatcttaagctttatcattccaagaaatagatctatattgcagtgtcttaaatattgatgttttctatttctcttgatctatctttccaggttataaaacatggaggctggctcagtggttcgagccatttttgacttctgccctagcgtatcagaagaactgccgctctttgtgggagatattattgaggtgctggcagtggtggatgaattttggcttctaggaaagaaggaggatgttacaggtaagtaagagactcatagtggaccacaggccctgacttctttccatattaaaaataaaggctggcactgcactccagcctgggcaacagagtgagaccctgtcttaaaaaaaaaaaaagaaagaaagaaagaaagaaagaaaattattcctagctgggcacagtggctcatgcctataatcccagcactttgggaggctgaggtgggtggatcccctgaagtcaggagttcaagaccagcctggccaacatggtgagatggtgagaccctgtctctactaaaaatacaaaatttgctgggtgtggtggcgcgtgcctgtaatcccagctactcaggaggcaaggctggagaattgcttgaacccaggaggtgaagattgcagtgagttgagattgtgccattgcattccagcctgggcgacaagagtgaaactctgtctctaaataagtaaataaataataaaaataaaaataaaggctgggcatggtgggtcatgcttataatcccagcactttgggaggctgagatgggaggattgcttgaggccaagagttcatgaccagcctggtcaacatagcaagacaccatctcaataaataaataagaaaggatgggaggtagggagggaggaagagaaagaaaagaaagaaaggaaggaaggaaggaaagaaaagaaagctagctaaatgggaagcccaagtcaataaatttcagaatccttttgtgtttacctactgtattcatatgtggtctctaccagttaggggaagatttctgttaccattccatctctgtgttgattccttcaagaggttgcaccactagacaccagctgccccagcccaggtttctatccaagtctttgtctttcacccgctttcccttcccaggtctttatcctttgtgttcagtgctattattcctcttctcaaaacatgttattcctttcttcataaccctgttgtttactactgctttcctttttttttttttttttttttttttttgagacggagtcttgctctgttgcccaggctggagtgcagtggcatgatctcggctcactgcaagctctacctcccaggttcatgccattctcctgcctcagcctccggagtagctgggactacaggcacatgccaccacgcctggctaattttttgtatttttagtagagacggggtttcaccatgttagccaggatggtctcaatctcctgacgtcatgatccgcctgcctcggcctcccaaagtgctgggattacaggtgtgagccaccgcacccggcactactgcttttcataaccagctttatgatttgtggaacacaaggtgctctccaccttgtttcctctggctgtcttctttgaacattttctaccctttctttcattcttcacttgatcttaggcaaaaggctgagaagtgatctttctttcattttcttcaaaggagcatgattcatcctgttcactccttcttggatccatggctggcccaaatttattaaagttatcccttaccctacatggtacctaccacccacattccacgcacctggttagctttcttcaattctgtaagatatatgttcacatcgatttctttcattaataagcctagggaagggtggaagcttttcccacaccacatgcatctgtgttaatccaatccttaacttgcatgtactcatatttatgtaagtctgggttggagtccttcgagcacactctgttgacacttaacccacatttgggagataaattatttcccagtagaaatggtatctcagctgagacaaaaatgatgagaaggagttagcaaggaaagatggtaggcagagaggattgcttgttgaaggtccctggaatgtgagaacacaggggacctagagaagtttagtagggcatgaggtgtgagtggttgagggagaaaggtgggctggagagatgagcaaaagctggatcatgggagacagagtatgccatggtaaggagtgaagaaaatgggaaaccctgaaagtgctttgaacatgatcagatttgaattttagaaaactcactgctgcagacttaagaatgatagaaagggacaaaactgaaggcagggaagcatttggaaggtcgctgcagtaatccaggtgagggatggtgatggcatggaccaaggtggtgggtctggagataaatatacccagagacagaaggtagaatcaatcagactttctgatactttccaactggcaggccctgtctttctcccaccacctattaaaaccttgtccaccgtcagattcaaatgctattgttttcataaagttttttatgttcttcctgacctattacctaccttttctgaacttccgtaacaatttgtgtacttacgttatgataccagatttcaggattgaattattatttatgtctgaattcgactttttgtctgaactaggtttttagatctttgaaaaccaaaactgtcttatgttttcctctgcagcgtgctttgcctatagcagcccccagtaaatgcgtaccaaattgaattgcattctgtctgtcctgcatgcatctagttttgtgcactatacttcttctccaacagattctccaattatgagtattccctgagttttcaagttacggtctatacatggactcagaagaaaagtttttgtccttgtacacagacgggaaaagaaatctcagtattaaaatttaatatgtttgcttttattttcaggacaattccccagcagttttgtggaaattgtgaccattcccagtctaaaagagggagagaggctgtttgtgtgcatttgtgaattcacatcccaagagttggataatcttcccctccatcgaggtaagctgctcatcaaatagtagactatttgaaattagatttttggagtctgcccgtttcgacaaccagatcctttttgaatttgtgaagtggcttaacctctagagagtcctcggcaataccaaatagcgtggacgtaatgatgccttatagtttagtaccattttaaaatttccaaggtattttctcacaaatatattctcatttgatcctcagcacagacctgggaggtaggaaagtggggattattaactgtattttataaataatgagagcaaaattcaaagactgttggccgaaggtgggaagtcttggcctcagaatatgaactgatcatattctaagtccagtgttatctttccaatgcccccatgctatagccacacttcaggctcatgctctctctctctttttttttttttttttgagacagtagtctcactctgttgcccaggctggagttcagtggtgcgatctcagctcactgcaacctctgcctcccaggctcaagcagtcctcccacctcagcttcatgagtagctgggaccgcaggcacgtgctaccacgctgggctaatttttagtatttttggtagagatggggttttgccatattgcccaggctggtctcgaactcctaggctcaaacaatctgcctgcctcggcctcccaaagtgctgggattacaggcatgagtcactgcgcctgaccaacttcaggctttatttctctttttttcttttaaaaactgatacggggcgtgggcggagggagaaaaaaataactgggtacggctttgctaacaatattaccatttattaatgtataatagtagagcaggaattttgatgtggaaattaagagataggtgcaaaacatccgcattttactactgtcttatcagagccagtttaaaaggaagtgatttaaaacagatagtcatacttagccaggcatggtggtatgcacctatagtcctaacaactcaggaggctgcagcaagaggatcgcttgagttggaagcgtcagtgagctatgatcacatcactgcactccagcctgggtgacagagcgagaccctgtctcaaataaataatacataaatatataaatataaattaaaacaggtagtcatagctatctctcagtgattttccaagtatttctcccttcttgcactctgattagatgaacaaactataaaccatttcaacaagtatccttaagtccattctgcataaacagagaaaccagtagtgtctaaaagacagaagcttctgatcaatccaattttgtgatgactcagtcatcaaaacagtagaacttattaggtgtgttattaatatcattacttgctctttggcatatggcacaaaagggacaggcttcatttcttaaatcatgtacacacatacccacacacacacacacacacacacacacacacccagaaaaacctatcaaacttctctaacccttagtgataagaatggaataatggattttgaccttaatcctcaaaatctattttgagaatttctttatttttagattttgttttattttgtttatttatttatttgtttgttttttgagacggagtctcattctgtcgaggctggagtgcagtggcatgatctcggctcactgcaacctccgcctcccaggttcaagcgattctccttcctcagcctcctgagtagctgggactacaggcacctgccaccacacccagctaatttttgtatttttagtagagatggggtttcaccatcttggtcaggctggtcttgaactcctgatcttgtgatctgcccaccttggcctcccaaagtgctgcgattatttattttttattatacaaattttattttattttttaagacacagggtctcacgttgttgcccaggctggtctgaaactcctagcctcaagtgatgctaccacctcagtctcccgagtagctgggattacagaccttacttaactttaagaagtatcattaggattgataagaggctgggtatagtggctcatgcctgtaatcctagcattttgggaggccaaaggcaagagtatcccttgagcccaagagtttgagatcagcctgggcaacatggcaggacgctgtctctacaaaaaaaaaaaaaaaaattaaattagccaggcatggtggtgcataccagtggtatatgcctgtggtcccagctactcaggaaactgaggcaggagcctgagcccaggaggttgaggctgcagtgagctgtgtttacgccactacactccagcttgggcaacagaacaagaccttgtttcaaaaaaaaaacaaaacgtattaacgagagaaaacgccaccacgctctgttgttttgagagtttcttacacttcactttatactcagtctctacttcagctctatgctttcttgttaatcagtgttgggaaggtagacagaaatagattaagagattatagcagggaccttatctgtccttactcatagctctcccagtggagtctgtagtccatatctgatggaatggagaaaggacaagagtacagtggcttccgctgagctgttcagaggatgtgggtagcatgaacttttcttaggaagcatgccatccgagagattctcagaaagaatctggcatcgtgagtcacctgtctgaagactgactcaaggtcaggccaggacctggaatctagattttatcttgactaccttttaaccagttaagcctaataagcttaaagatgtaagtggaatccaaaggaagaggatgtgggcagggggatacactgggaaagagagactagaatgagatgtactaattatccatggttttatcttgttctcctctctgtgataatctactgccagtaaacacactgaccagtcagctttccttctatgcctttcacgttttttttttagctctgtcttttaatttggaaacacaaggcttggaggatggagaagttagttatacctatgcaatttgcctttttctgggaaacttagcttgtgcacaaatgattttaatttctctttttgtatacgtgacaagtcacatcaacaggtatttactggtgggaaacaaaatcactaaaaaatgaaagtattgttttatgccagatatgcaagtttatcagacttgcatctaggtttcctgttttttaagtctagtgcttgggatggcgcttcaacttcctagactgaaaatcactttttccattagatcagtgtgtctgtaaatgaaatgttgatgatggaataggtcaggaggggatttggaaaccttaagagtatgtggggccaggcatggtagctcaagcctgtaatcccagcactttgggaggcctaggcgggtggatcacctgaggtaaggagttcgagaccagcctggccaacatggtgaaaccccatctttactaaaaatacaaaattagctgggcatgatggtgcatacctgtaattgcagctacttgggaggctgaggcaggagaattgcttgaacccgggaggtggaggttgcagagagccaagattgcgccactgcagtccagcctgggcaacaagagcgaaactccatctcaaaaaaaaaaaaaaaaaagtatgtgagataatgtttgagatctgttgtgttttaccacgtgcctttttagttcactgttacttacttacctttaagaagtatcattaggattaataagagaaaaaatatatgtgtaatttatagatgtctatatgtatttagagcaggcagtatagcttaggggataagaattctgacaggcctaagtttaaatccaagtccaccacttaatagctgtgaccttggactagttacttaagtctctcagcctcagttttcttatctacaaaatgaggataataatataatacctacctcagggtgattgtgaggattagatgaggttgtacatggaaagcatgtggtagtaggtaagcgctcagtaaatgctagctattcttattagtcttaacctgggcgcctgggcttcattgatgtgctttgggtatcttgtttctgggataagtctgtgaagttttgtgtgtctgttctcagagagattctatgtgaaatcagaaccactgatctttgttccagcagatgtcacccttcttccttttcctgaagctatgtaattgttttggactattcctactgttttgagttaaaatatatatatatatatatattttttttttttccttgggctggagtctcacactgtcgcccaggcgggagtgcagtggcgcaatttctgctcactgccacttccgcctcgttggttcaagtgatattcatgccttagcctcccgaatagctgggattacaggtgtgtgccaccacacccaactaatttttgtatttttagtagagacagggtttcaccattttggccaagctggtctcgaactcctgacttcaagcaatccgcctgcctcgacctgccaaagtgctgggattacaggcatgagccaccacgcctggcctcgagttatatttaaactgagaaacaagtctgtctcttagaagaagaatcaaaacaggtggccagtgcccctgactatcctaaaaaaaaaacaaaaacaggagaaaagaaaggtggggggtggaggggagtaaagaacaaagccaaaataagagattagtgcaaggaggctgggcgcagtggctcacgcctgtaatcccagcactttgggaggctgaggcgggtggatcacgaggtcaggagtttgagatcaacctggccaagatggtgaaaccccatcactaccagcatggtggcaggcacctgtaatcccagctcctcgggaggctgaggcaggagaaattgctcgaacccggaaagcagaggttgcagcgagccgagatcgcaccactgcactgcagcctgggcgacagagcaagtctctgtctccaaaaaaaaaaaaaaaaaaaaaaaagagagagaataggacaaggaaaagacagagaggagagaaacaagttagtgcatattatgacaagtgataaaatatcactaataattgcctcacgtaagacagaatcctcatcccttgcctataacctgccccctcaaacaacaggccaataaaaaataaattgaccagtggtattcatcagtcaaagcacatgtgttataaatttgtgatgccatgaatgtgaactctcaggaaagaagttctgacatggctcgtatggaaacctgaataaaatactctacgtggtcaggctgcataaagcacatagttcccctggcatttagagacagcccaaaaggagtccgtgaggaacccaggactgcagtcagactgctcatatccgattctaagaagacctgcactcctttttaccattttattcctaatgcatttcctgttcaaataaaaaatccaaccagaggaaacaagcagtgtggctgggattaattgtgcatgagtcaaaggctcaggctgaccctaagggtcaccacacttcctatttttctgttctcaaaatctggtcttgctcgtgcaggagttcctcatattggcatttcagaagtctgggaatgaccactagttattctggagataccaatctaatggaaaaagtgatccgttcctaaggaatcacctaggaccccaggggaatagcttgtatgactctttctgatgaaaaacagagacttacggttcagtaacagggctataaaacaggggcattgaggcagaatatggtgacccacacctttaatctcagcagtttaggaggcctaggtgggaggatcacttgagcccaggagtttgaggccagcttgggcaacaaatgagaccccatctccacaataacaaaaaaaaaaattagctgggcacagtggcacacacctgtagtcccagctactcaggaggctgaggcaggaggattgcttgagcctgggaggtcaaggctacaatgagcagtgattgagccactgccctccagcctgggtaacagactgagaccctgtctcaaaaaataataataatcaaatgaattttaaaataaaaagggtattgaactaaataatctctaaagtactttccaggttctaaattgtgtatgtttttcaagattcacctttactgtgtagaaataaccaataaaatagcagtccatcaggtaataaagcttatcaaaacagttatcctgttgaaaatagataggaaaacaagccttattatatgggttcagggggatctgacaaaacaaggaaaatagcataattctacagctttaagaaagccagttgatttcaaagccagcagagtgggagttatggcacgcttttattcttccccttcaccaagaggcccattgtgtctgaacagcagtcagtcaccagtgcattccctctgtgttctcgatggatggccttagggccagagggggaaaaattacttgtggttttttgtttgtttttttttttgagacggagtctcgctctatcgcccaggctggagtgcagtggcacaatctcggctcactgcaagctccgcctcccaggttcacaccgttctcctgcctcagcctccctggtagctgggactacaggcgcccgccaccacacccggctaacgttttgtaattttagtagagacagggtttcaccgtgttagccaggatggtctcaatctcctgacctcgtgatccccctgcctcggcgtcccaaagtgctgggattacaggcgtgagccactgcgcccagccttgtgattttttaggaccccaacttctgaccaagggatagggaatcataagttaaaggaatgtagaaatacaggaccaagaccctatttttggggaacactgaaaccaaataatatcaaatttgtgaaaatattttgggcaactctctctaagtgtaaaatcttatgttaggtgctgtatagtatataaaaatacaagtgtcagaattcatgatatagacaataatttcttttctaggctatagacagccaagatgaatgtgagcttctaaggttttttagagaagcaagcctaggtttcagatggagagacagtgtaactggagtaaggctttggggttaataatgatgcggcttcataacaataaaaacctccttgtgtggaatagggtctcatatcataggtgagataatattggatagttggagaaggggaaagttgtgactggataatcatgaatgtaagtttgctttggggtgaaagcataagtcttttggtagctcagtaaacctctacagagagtgtccagagcaaatttattttttatatattttgggtaataagaataggattactgaggaagaagccattagcagtaggctccttgtgcttcatggtaaaagtttggcccggggagggagatggtaaaactggtgcatttgtaatcttgatttgtcatgaatcaattggtagacttgaagaaataatgcgtggggacaagatttcaaagggtgagatggtgggaattggaccagggtcgtagcatagagcaattagtagaaggaagaggccgggcacagtggctcatacctgaaatcccagcactgtgggagactcaggcgggtggatcacttgagtccaggagttcgagaccagcctgggcaacatagtgagaccctgtcaaaataaaaattaggtatggtggcgcatgcctgtagtctcagctacttaggaggctgaggtgggacaatcagttgagcccgggtggtcaaggctgcagtaagccatgattgcaccactgcactcagccttggtgatagggtgagaccctgtctccacaaaaaaaaaaaaaaaaaaaaaaagaaaaagggaagaaatattttgaaagaaggaattagaagaaaaaaggaaatgagcagcagaagtcagtttggaaagcagaatgtaatgaatttatttgggagttggagttgaagaataatcatcattagcaaatgaacatcaagtgcttgccatgcaaaaggcatcataccagactcttgagataccaaagagaaggtggtacctaccattaaggaactgtaacctacttgggaatataagacagacttagtttttttttttcttatttatttattttattttattttttagagacagggcctctctttgtcacccaggctggagtgcagtggtccgatcatagttcactgtagccttgaactgttgggctcaagcagtcttccacctcagcctcacgagtagctgagactacaggcaatagccaccttgcctgagtagacttaaattttttgttgttgttgagatggagttttgctctcgtcacacaggctggagtgcaatggtgcagcctcagctcactgcaacctctgcctcccaggttcaagccatttttctgcctcagcctctcgagtagctggggttataggcgtgcacccccccacctggctaattttgtatttttagtagacacagggtttcaccatgttggccaggctagtcttgaactcctgacctgaggtgatcctgcgcacctcggcctcccgaagtgctgggattacaggcgtgagccaccgcacctggcctaatttttttttaaatcaagagcatgtaaaaatcaagagcataaaagataacccagttttccaatgtgcttgactataaaatgactcataggattttgccaggtgctttgctacccagatcttattttacctaggccaggtgcattccttgagcacctctgacttgggtactgagtgagaaagaaattttaactataaaagtataggtaagattaactttaatcttaactgtaagattaaaatagataatctacaagtgaatagcttataatcagataatcaagagtttgttataaaacagttgataaaattagagtaattttttcaaaattaaatcataaatcatatagaactgaattttaatttcatttttccagaaacatatactgtgctcttatcctttctttacctcaacttcttctacaataagacagatgctaactgttcagcttacgttttgtgaggataacctgaaaattggttattttcaaaaacaaaagtggtgattattggtaccttcttttaagatctcattataatatattttcaggatagggacagttcaagaaggcctctggagaacatgattgaacattcattgtccatacccttcatctccaacaaagaaccctttactaaagatttgttttttttttgttttttttttttgagacacggtctcactctgttgcccgggccggagtgcagtggtgccatcatagctcactgcaggctcaaattcctgggctgaagcgatcctcctgcctcaggttcccaagtagctgggactatagcgctcaccaccacaccggctaatttttttttaaattttaaatagagacgcggtctcactatgttgcccaggctgatcttgaactcttctgctccagcaatccttctacctcagcctcccaaagtgctggaattacaggtgtgagccactgcacctggcctccctgtatactcttaaaagttattgagaccccaaagagcttttttgtttttttgggtggtttttttgttttgtttttgtttttgagacagtgtctttctctgtcgcccaggctggagtgcaagtagcacagccatggctcactgcagccttgacttcccaggttcaagtgactctcccgcctcagccttccaagtatctgtgaccacaggtgggcaccaccacacctggctaattattgtatttttcccaaagagcttttgtttatgtgggctgtgtctgttgatatttatcatattagctattacaactgggaatttttaaaacttgtttatcagtctattaaaaacccattacatatttacgtaaataacatatttttatgaaaaataagtatagctttccaaacaaaaaaaaattaatgaggaatgacattgctttacatgttcgtaaatatttttaatgttcaacttactaaaagaaaaccagattctatttgcatctgtattcaatctgttgcaatgtgttgttttcatggaattatgtgaagaaaatccagccttacacaaatatgcaatgggagacaggaaaaggtattttaatagtcttttcaaataattgcaaatattcatcgttgacactgcaccaaaattcaacgattggtaatttcttacgagttaattgcagtgtgggatctgaaactacgtcggtgaactttcataatattacactaaaattcattaatctatcttgcttttggagtgtgaatcttttagccatgaatgattttataccagcatgcatttgtcatttaggaaatattgattcaattagctactcagttattccaaatgttgaccatttcaacatacaatgtgaaaaaatcatatttgttactatctcatcagaagaatctttaagtatgggaaagctgccaagcccatggtagtagatacaagttttccaaaattctcattttctcttggaagttggaattttatcattggcaacaaatactgtcatttgttctccttgatgtttcagactcactttcattttggaggaaacatctgccagatatctaagtctgaataaacatagttgtctgttattcattcttgcacataaaatggtgttatgtgaaaataaacagacggttcaggcatataactcagttactcgtgcttctcctcagcagtaaaagtgctttatgtgtaattcctatattgtcacacagaatattacaaaagaattgttcttaagggttgagatttagcacagtgcataatttgtattgcttcttaactgaaaatggcttttttaaaaactgtgagtacatggttgtgaagaatacgatgaccatacagtgactattcatgtaatttgtggctactgcctttgcttatgaattgccagcagtttttaattaatttattatttttttgagatggagtcttgctctgttgcccaagctggagtgcagtggtgcgatctcggctcactgcgacctctgcctcctgagtttaatttctgcctcagcctcctgaatagctgggactacaggcacgtgccaccatgctcagctaatttttgtatttttagtagagatggtgtttcaccatgttgaccaggctgctctcgaactcctgacctcaagtgatccgcctgccttggcctcccaaagtgctgggatcacaggcatgagccatcgcgcccagccattttatttttatttttgagacaagtgttgctctgtcacccagactggagcgtagtggtgaaatcacagcttactgcagccttgacctcctgggttcaagctatcctcccacctcagcctcctgaatagctgggactacaggcatgagccacagtgcacagctaatttttaaatttattgtagagacaaggtcttgacatgttgcccaggctggttttgaactcctggtctcaagcgatcctcctgccttggcctcccaaagtgctcggatttctggtgtaagccacagcacctagctggccagcagttttaatcaccattgctttttcacagagattacaaaagtcagcagagtaaaatatgtagataaagtcttagtgttattatgagaatggttttgacctcacagattctctgctaggatcttggagacccacctgtagggttccatggaacactctgaaaactacaggtttatagaactgctccaattcaataaattgtcaaaattgttcatgctcctaaagctctaggtgtatttccttgaatttggtagctgtttaaaatgagaggttgcactattagtcgtgataatgttctgctgggtgatgactgaggtcaccatctctgctcctcttttctttaggtgacctggtgattctcgatggcattcccactgcaggctggctgcagggccgaagctgctggggcgcacggggcttcttcccatcttcatgtgtccgcgagctctgcctctcctcacagagccggcagtggcactcccagagcgccctgtttcagattccggaatattccatgggacaagcccgggccctaatggggctttctgctcagctggatgaagagctggacttcagggaaggggatgtgatcaccattattggagttcctgaaccaggctggtttgaaggggagttagagggccgaagaggcatttttccagaaggttttgtagagctgttggggcccctgaggactgtggatgagtcagtaagttctggaaatcaagatgactgcattgttaatggtgaagtagatacccctgtaggagaagaagagatagggccggatgaggatgaggaggagccagggacctatggggtcgccctgtacagattccaagccctggagccaaatgagctggatttcgaggtcggggataaaatccgaattctggcgaccttggaagatggctggctggaaggatccctgaagggcaggacaggcatctttccttaccggtttgtgaaattatgtcctgacacacgggtggaggaaaccatggctctgccccaggaaggcagccttgccaggatcccggaaacttctttggattgtttggagaacaccttaggagtagaggaacaaagacatgaaaccagtgaccatgaggccgaggagcctgactgcattatttctgaagcacccacttctcccctcggtcatctgacttcagagtatgacacagacagaaactcttatcaggacgaggacaccgcaggagggcccccgagaagcccaggcgtggagtgggaaatgcctcttgccacagactctcccacatctgaccctacagaagtagtcaatggtatttcctcccaacctcaggtcccttttcatcccaacttgcagaaaagccagtattattctacagtgggagggagccacccgcactcagaacagtaccccgaccttcttcccctagaagcaaggactagagactatgccagcctacctcccaaaagaatgtattcccagctaaaaactcttcagaagccagtgctccctctttacaggggctcttctgtttcagcttcaagggtagtcaaacccagacaatcaagtcctcagctccacaacctagcaagttatactaaaaagcaccacacgtccagtgtttactccatctcagagagattggagatgaagcctggtccgcaagcccaagggcttgttatggaagcagcaacacattcacagggagacggcagcactgacctggactcgaagctgacacaacagctgatcgagtttgagaagagcttggcagggcccggcacagagccagataaaattttacgccacttttcaatcatggactttaactctgagaaggatattgtccgaggttcctcaaagttaatcaccgagcaggagctgccggaaaggagaaaggccctaaggccaccgccacctcgtccctgtactccggtatccacttctccccatttgctggttgaccagaacctaaaacctgcaccacccttggtggtgcgaccctctcgcccagctcccctgcctccctcagcacagcagagaacgaatgcggtatcccccaagctcctatctcgacaccgtcctacctgtgagaccttagaaaaggagggccctggtcatatgggaaggagtctggaccagacctccccatgccccttagtgctggtgaggattgaggaaatggagcgggacttggatatgtacagtagagctcaagaagagctaaacctcatgctggaggagaagcaggatgaatcatcaagagcagagaccctcgaggatctcaagttctgtgaaagtaacattgaaagtttgaatatggaactccagcaactaagaggtaagtgacgaggaaataatatgtaattgtttcttgacactcacaagtcccagaaacagcctacccaggctttttagggatatgttaccatcctcgatggacaaaaaatgatttacattttcattacctaatttcttttctttttttttttttccttttttttgagacagtctcgctctgttgcccaggctggagtgcagtggcatgaacttggctcactgcagcctccacctcctgggctcaagtgattctcctgcctcagcctcccaaatggctgggattgcagacatgcgccatcaccacacctggctaatttttgtatttttagtagagacagtgttttgccatgttgccaggctggtcttgaactcctggccttgggtgatccacctgcctcggcctcccaaagtgttgggattacaggcatgagccaccacgcccggcctcttttttttttttttttttttttgagacagagtttcgctcttgttgcccaggctggagtgcaatggcgcgaccttggcttaccacaacctctgcctcccaggttcaagcgattctcctgcctcagcctcctgagtagctgggattacaggcaagcgccaccatgcctggctaattttgtatttttagtagagatgggaattctccatgttggtcaggctggtctcgaactcctgacctcaggtgatccgcccaccttgacctcccaaagtgctgggattacaggcatgagccaccgcacccagcctcactacctaatttcttatttcatcaccctagataggctgtcttgagcctctgactctgttttgagcctatgactgctgtagcctcctgacttcatttgctgctcagataaagaatctcaaaccttgccgggtgcggtggctcacacctgtgatcccagcacttcggaaggctgcggtgggtggattgcttgagcccaggagtttgagaccagcctgggcaacagggccaaaccctgcttctacaaaaaaatacaaaaaataattagccaggagtggtggtatatcccagtagtcccagctactcgggaggctgaggtgggaggattgcttgaacctgggaggcagaggttgctgtgagcaatgatcatgccactgctctccagcttgggcaacagagtgagaccctgtctccaaaaaaaaaaagaatctcatacctcggagacacatatacctctgggacatttatgtctcttattctgctatggcatccatagcagtggtgcagatgggaagtccctaagtagaactttctttaatcaggctccattaagcactaaagacttccaggttaagaaagactcatgagaaaactccatcttgtatctttgctgtccagagagtagatttcttttttttctttttttttttgagacagagtcttactctgtcacccaggctgtagtggtgagatcttggctcactgcaacctgtgcctcccgggttcaagtgatctcatgcctcagcctcctgaatagctgagattacaggtgcatgccaccacgcctggctaatttttctatttttagcagagatggggttttgtcacattgcccaggctggtctcaaactcctgacctcgagtgatccacccaccttggcctcccaaagtgctgggataccatgcctggccaagggagtagattttaataatagtaatagctaacatttattaccatattagtaagcatgtgttagaatttgcctacaggaagaatgttcacagctaccctaaaggtacaatgataattcatatggctactctatagatgaggaaactaagacatagatattgagtaggctcaagcctgtaataccagcactttgggaggccgacgtaggaggatcactagagcccaggagttcaagagcagcctgggcaacatagagagacctgtctcttaaaaaaaaaaaaagttttaaattaaatttgaaaagagattaagtgacttgccaagggagttgggatttaagcttatgtttctaacaactatagttcaccgcttcctatactggcacactgaaaattcaaattatttcccttaatttgggaatgataagcctctggagacttcattcatattcaccagactcacaggagaaaaaatttataaataggaagagtacaagaggtaggcaaccaacagcaattggtctagggcccaagaacgtgaatacatgtcacttttggcttgtgtaccagagatttgaacttatgtgtcatcaggaaagtcaataatagaaagcaacccagggggtctaggaatagcaggatactaataagagataaaagcagaatggtgatccagagatcctggatcaagatggcagactgagcacatatagctacctccctccctttctactttaggtctataaaagtgaatggaaataatagaataaaaaaattccaataaaaaagagtattattggaaatcaagtaatcttctgaaagatgatatagcagaaagagagggaaacctctattcaaaatattcttaggaaaggactattatgcatgtgggcagagttctaagggaactgcagactaagagatggtgcggtaggaggggtcctagagcacattcagtgtaattgattaggggatagctagggagccaggccgctgggttgcttgtactgaacagcaggagcatttaccctcaagctacagcatgaagtagatgcttagacaagtcctcaaaaaggtgttcatttaatatgagtacttgagctctcaggggaatgccagataccttgatttcagagtccctgaaaaagaattctgagggaaccttggctgagtgttacattcccaaagccctagcaaactccagattctccatcactttctatacctacaagtttcaagataaacctgtaaacaattcttgcattagatattgtattagtccattttcacactgctgatgaagataccagatactgggcaatttacaaaatgaagaggtttaatggacttacaattccacatggttggggaggcctcacaatcatggtggaaggcaaggaggagcaagtcacgtcttacatggatgatagcaggcaaagagagagtttgtgtagggagactcccatttttcaaaaccatcagatctcatgagacttactcactctcacgagagcagcacaggaaagacctgcccccatgattcaattatctcccaccggctccctcccacaacacataggaattcaagatgagtttggagtggggacacagccaaaccatatcattctgcctggatcctcccaaatctcatgtcgtcacatttcaaaactaatcatgccttcccaacagtcccccaaagtcttaactcatttcagcattaactcaaaagtccacagttcgacgtctcatctgagacaaggcaagtcccttctgcctatgagcctgtaaaatcaaaagcaagttagttacttcctagaaacaatggggatacaggcattgggtaaatacagccattccaaatgggagaaattggccaaaacaaaggggctacaggccccacgcaagtctgaaatccagtggggcagtcaaatcttaaagctccaaaatgatctcctttgactccatgtctcacaacgaggtcacaccgatgcaagaggtgggttcccatggtgttgggcggctctgcccctgtggctctccagggtacagcctccctcctggctgctttcacgggctgatgttgagtgtctacagcttttccaggcacacggtgcaagctgttggtggatctaccattctggggtctggaagattttggccctcttctcacagctccactaggtggtgccccagtagggactctgtgtagaggctctgaccccacattttccttctgcactgccccagcagaggttctccatgagagccctgcacctgcagcaaacttctgcctggacatccaggcatttccatacatcctctgaaatcgaggcagaggttcccaaacctcagttcttctgtgcacccgcaggctcaacaccacatggaagctgccaaggcttggggcttgcaccctctgaagccatggcctgagttctacattggcccctttcagccatggctggagcagctgggacacagggcaccaagtccctaggctgcacacagcatagtgatcctgggcacagcccaggaaatcactctttcctcctaggcctttgggcctgtgatgggtgcagttgccgtgaagacctctgacatgccctggagacattttccccattgtcttggggattaacatttggctgctcattacttacgcaaatttctgcagctggtttttctcttcaggaaatgggattttcttttctatcacattgtcaggctgcacatttttggaacttctgttctgtacatcccttataaaactgaatgcctttaacagcacccaagtcacctcttgcatgctttgctgcttagaaattttttctgccagataccctaaatcatctctctcaagttcaaagttccacaaatctctagggaagaggcaaaatgctaccagtctctttgctaaaatataacaagagtcacttttggtccagttcccaacaagttcctcatctccttctgagaccacctcagcctggatttcattgtccatatctttatcagcattttggtcaaagtcattcaacaagtctctagggagttccaaacttttccacattttcctgtcttcttctgagccctccaaattgttccagcctccgcctgttacccagttccaaagtcagttccacatttccgggtatcttttaagcagtgccccgctttactggtaccattttcctgtattagtccatgttcacactgctgataaagacatacccaagaccgggcaatttacaaaagaaagaggtttaatggacttatcgttccacatgttggggaggcctcacaatcatggtggaaggcaaggaggagcaagtcacatcttacgtggatggcagctggcaaagagagagcttgtgcgggaagactcccgtttttcaaaacaccatcttttgtgagacttattcagtcacgagaacagcacaggaaagacctgccccccatgattcaattacctcctaccaggtccctcccacaacacgtaggaattcaagatgggatttgggtggggacacagccaaaccatgtcaaatatataggtgggagaataaaagactcccaaatttcaggtagcaggaatttcccagtaatggtactttttagaattaatagtgttccatggaaaatgttatgtcttctgtgcttaagaacactgcagtgtttttatttttattttttgtgtgtgcagtgtttttaaatgggtaaatggactggtactacataaaactggtgttcttttttattcaccagaccttcattttcagaattagtttattcagcaagtgttctgactttttaaaaaaattgctgtttagtgctgtgaaagacttaatgtgggtgtagtctatttcgggaagactttgtaaaatttgaatccaccaaatacagtattgggtatgttaatgttgatttgattgatttctcaaaaggtgttttgataatatctattgctaatatgataaaattacttattccttgcagtaacagccaatttctcataaggtcatttttttctgtcttcataaaaggtgtatccaacaatataagctatccctcaagaggtggaaattaaccagtttgagcaccaggcattacttctctaatctggttctgtataagttataattttaaaatttaaggcctaagatttaaagaactttcaatataacatttatctaattctgatcaatattatatttagttgttaatatgcttactgagaagacaggttttatctattattcagtgtgtcatttcccacacacctggtatgatgttctatacatagtagggactcaaatacctaatgaagggagttgagtttaactgaattgatttgaattgaattgcctgctctacctcccagagttttcagagatctcctacttctgttgttactttgaactggtctacttgggacctgggaatcagtgcagagatggcaggccccttgtcagaccagtgctgtgccagacccacagtgaggtttttagtgtagctactgcctcttcttaaaactctgcatttatttatttatttatttatttatttatttatttatttatttatttttgagatggagtctcactcttgttgcccagactgcagtgcaatggcgtgatcttggctcactgcaacttctgcctcccgggttcaagtgattcttctgccttagcctcccgagtagctggaattacaggtgcccgccaccacacctggctaatttttgtatttttagtagagatggggtttcaccatgttggtcagcctggtctcgaactcctagcctcaagtgatccgcctgccttggcctcccaaagtgctgggattacagatgtgagccatcatgcccagctttggtttttattttctttccatatggtaagcatagctgttttatagtctgtgtatgattccaagatattcagtgttagtgggactgtttttgatgtcacatgggttctcatttttgtggtctaggctctttgtgtgtctgattatcttactgtgtgctggtcatagtatttggaaaatcttaagagttgaggtgaagacacctgaactctagaaagaatttgcatttgtttctgtcagttgtttgtagtcaactaatgtttccaaattcctgaaggataataatatttgagattcaggagtaagaagttggaattcctgggagttcctaaattataaccttgtattttaaaaaacttttacttacacattcttgaatagtagtagagatcataatcaaagatgacaagttttcctgtgctagtattacactaacattttcagaggttttatatttgtgtatgataaatgcacggtttgttgttgtgagccacaatgtcgtgatatgattatatattttaataacatgtaaaaatattctctacctgataatagacttttttaaaggacttgttttttgtaagagctgttttagattaacagcaacattgaaaggaaggtacagagatttcccatatcccgtgcccccacacatacatagcttcccctatcatcaacatcgtaaaaacattcttaaatttcatttttaaataattttagatttatagaaagctgcaaaaataagagcttccatatacttcgctcagcttctcctaaccttaatatcttacacacctatagaagatctataaaatcagaaaattaatgtgataatgtaaaacattaaaagagcattagtacaagataaatgtcaaaaactatttaaaaattgaaagaaataccacaaatatttagtattttaaattactcttaaaatagaattttattttaacttttaaatgttagattcagggagtacatatgcagatttgttacaagggtatattgtgtaatgctgaggtttgggcttcaattgatcccatcacctgtgtaagagaacatagtacctaataggcagtttttcaacctttgcctccctccctccctccctccctccattgtcctgtagtccccagtgtctgttgttcctatctttatgtccatgtgtacccagtgtgtagctcccacttataagtgaaaacatgcaatatttggttttctgcttcagccttaattttcttaggatactggcctccagctgcatccatgttgctgcaaaggacatgatttcattctattttgtggctacatactattttatggtgtatatataccaggatttctttatccagtccactgttgataggcacctaagttgatttcatgtctttgctgtagtgaatagtgctggagtcagctgagtgcaggtgtgtttttggtagaagaattttcctttgggcatatacccaatactgggattgctaagtcgaatgatagttctacttttagccccttaagaaatctccaaactgctttccacaggggctgaactaatttacattcccactaacagtgtataagtgttcccttttctctacaaccatgccaacatatctgttatttttttactttaatacccattctgactggtgtaagatggtttctcatttggttttgatttgcacttctctgatgattagcgatgttaagcatttttttcatatatttgttggccacttgtatgtcttcttttgagaagtgtcagttcatgtcctgtgcccagtgtttaggggggttgttttttttcttgttaagttccttataaattctagatgttaggcctttgttggatgcatagtttacatatagtttttcccagtctgtaggttgtctgtttactctgttgatagtttgttttgctgtacagaagctctttagtttaattgggttccagttgtcagtttttgtttttgttgcaggttgcctaagccaatgtctagaagagtgttaactaggttttattcaaggatttgtgtagtttgagacctcacatgtaagtctttaatccatcttgagttaatttttgtatatggtgagagatggaagtccagtttcattcttctgcatatggttagtttttccagtaccatttattgtatagagaattctttccccattgcttattttggtcaactttgttgaagattacttggttgtaggtgtgcagctctatttctggattttctgttctgttccattggtttacatgcctttaaatagtattttaaatacacagagcattagttgctctatctgatagtgttgatctttgttttgtgactaatatttcatacatcaaaaaaaggttttcattttatgttgatgttggtggaattgttaagtgtgtattcaaaagcatttctggagctgggctcagtggctcatgcctgtaatcccagcactctgggaggccgaggcggatggatgacttgaggtcaggaatttgagaccagcctggccaacatggtgaaaccctgtctctactaaaaatacaaaaaattagcagggcatagtggtgtgcacctgtaatctcagctacttgggagactgaggcaggagaatggcttgaacccagtaggcagaggttgcagtgagccaagatcgtgccactgcactacagcctgggcaacagagcgagactccgtctcaattaaaaaaagaaaaaaaagcatttctgggtagggctgttcggttgcatgttgtctcatgaaagctcattttctttttaatgttgaaaacattttttctgcttcttctgattttggctttgccattgaaattgatattgcttgtgctaattcagattttagatatgttcctgattttgtgtagggatatttcacagcaatattcacatctcttttgtatttcttctgttaaaacatttataaagaactatatagcaaatattaagcagtggaaaacactggacaaacattactgggtggttttcaaataatggaacatttgcctctctgagcaagatttagcactgtacagaatcatgtgtcagaattgctaaggacttactttgtttgcaaaactttatttcttagactacccttataagatctgtataaagcatactatacaagtaagcttattaatctttattttatttgcaagaatgactcactgttggcaacacacggggccatgagcacacactcttctaaacacatgtattacatagcaacaactatgagcaaagctaactgattagaccctggccctcctacccactcttgtcctcattcccagaaatgtcaccttgtaacattttactccgcgtgccagtattctctgctcttgcgtcaacttgacattggtggatttctttaaactcttaatgtctctgcatttattgttaggctttattctctcaggagaatcctagtaccttctcttgtttcctagagtcctcagctgattttttttgttttttttgtttttgatttagaaagacatataaatttcctaagaaatgctgagaaggaatttccacatggaaacaaacactagtcattctcagcccaggtccaacttaaaccaatttcaaggctcagtgtaccttgtaccttggatgaccaaggtatcggaactcagctgtaatttagcaagagggctggcccaattctgatttaccctcgggagttctttaggatcttagcttattacagaaaaggtctccttttagatttctattttaaagattttttttttctatgagagactgatccaaataatgtagacttcaattattggaaataaaaagtccagtattagttttagataagccagtctttggctgtaactgagaattaggagttttaaatttggaattatcatctagagtcagggtagaatactagacagtatttatgattgctgtgtgttggggaatgaaacatcattttgtgggcttccgtgtggtattcaggtcaatcactcattcatccaggaaatactcaatttatttttaccatgtgccaggcactgtgctaagggctgggtacatagcgatgaacattatagatgtgctcgctggtctcaaggagcttccagtcaaatgagttgctaattaacaagttaaggttcagatctcaagcacactaccttcaagtctgaacaggttgacttgcaaagcagtagaaacattaagaggtagttctcagactttcaggtttcccagtacatattatttttagaagctctgatcaggactacctagtgctaccctatctcttggtgaggttcacacacctgaatttgaaaagagggtgtgcattcatttctttattcagtgtatatttcttgagcacacatgatgagccaggcactagctacacgttgattaatttaaaaaaacatagtcatattatcattcatatttatgtgtgtttgaaaccccagtgatcatattgatattgacctctacagctaattatgctctttcctgctgccttggaatcatgaccaatggctactttcggtgtgggtcagttccggaaccccattgttctaaatcagtgcaatggatgccaaactacagagtgagtcaggaaccttgctcctcaactttcctctttttggcctttaagataatgtcaaaggaaggttgaccagagactctacaagtaattttcagtgatgtctgttgcaaattaaatcagaacatgtttttcaggaaaataatatttccccagtctactgggtagcatctaagatgcactaaagacagccagtagattaacaagctggagaatgactgatatggaacaataacgtctttatactaaagtgatacgtaatattctagacagatttttaaaattttaaagtgtaactgttttatatgcagaagcaatttgtcattctgcagcctccttggaatcccttaggtataagaattatttctcagccgggcatggtggctcatacctgtgtgtggtagttcatgcctcccagccctttgggagaccaaggtaggaggattgctttaagaccagcccaggcaacatggtgagaccccgttcctaaaagaaatacaaaaatagctggatatggtggtgtacacctgtagttccagctactagggagactgaggtgggaggattgggtgagcccaggaggccgaggctgcagtgagctgtcatcatatcattgcactccacactccaacctgggtgacagagtgaaactgtctcaaaaaaacaaacaaacaaacaaacaaacaaacaaaaaaccacacacaagaattccttctcaaactagtaacagataatagaattaaatagccaaatcattctgtgttttttttttttgttggttttttttgagacagagtctcactcttgtcacctaggctggagtgtagtggtgcaatctcggctaactgtaacctctgcctcccgggttcaagcgattcttctgcctcagcctcctaagtaactgagattacaggtgcccgccaccatgcccagctaatttttgtatttttagtagagactgggctttgccatgttggccaggctagtctcgaacgcctgacctcaggtgatccgcccccccctcagcctcccaaagtgctgggattacaggtgtaagccaccacacctggcccattctgtggtctttcaagataatgaaagtttatgtaaaggaaataataatctttctttctagtttgtcagtatgtaggaaaaaagcaagtatcttcaacttgtgtaacatctggttgaggcttttggctcagtaaaaatgagctcagagttacttctaaaggattttatcctagtataagacagcagccatcatcagaacccgttaataggctatgttaagtcaggagagaaactagtttctgattttaggatggatggttgaatgtatgtcaagaaatgtagcttagaatggtgaactgaggtataattgacctgtgagtcactgttcttagcagtttgtaggatggccttgtgaacattttcgcactctcagctcgaggcacagggtgaagaagctggaatgcattgaggtacttaagtattggtttcagatttcactgaggctttgcagcatggtacaggaaaataattcatcttcagatagcctgagacccttagttgcgagtgttcccaccatcacacccctacctgagctgcttgctgccttttactgttcactttaccagatgtaataagacccaaaagacaggacagtcatcagtcaaccagtatgattgagctcccactgtattccaggcagtgatctcgagtcacagtagcaatcaatctctgccttcatgggaaaagacaagcaataagtaagtaaaactctaagtatatttttttgcctttttgtcagaagggaaaacaatctatggagaaaagaaatcagagaaaaccttctgaaaaataatgtttgagtaagattgttgggggccagccaaaccatttctgggggtgggaggcatcgttccagacagataagacagcaagaatgagagtatgttagatgtttgaggaaaagcaaggagactggttcagctagagcaacggcacagttgtagttcatcatttagggtaagaagagaagttactggaaggttttgagcaggggaataatatgacctgacctacaatttaacagaagagaatagacagaagagacacagggcagaggctgagagaccagttaggaggctactgcagtgacccaggcaagggatggatgccagcaccttggaccaggatggcagcagtagggatgagaggtgctcagctctcagcatattttgagttagagccagtaggacttgctggtggattagatgtgaggtataagagactgagaagaggccaggcgtggtggctcatgcctgtaatcccagcactttgggaggccaaggcgggcggatcacctgaggtcaggagttcaagaccagcctgaccaacatggagaaaccccgtctctactaaaaatacaaaattagccgggcatggtggcacatgcctgtaatcccagctactagggaggctgaggcaggagaaccgcttgaatctgggaggtggaggttgcggtgagccgagatcgtgccattgcactccagtctgggcaacaagagtgaaactccatctcaaaaaaaaaaaaaaattgagaagagtcaagggtaaccctgaggggtaaccctgaggttaggcaactggaaggattagagttgcaagtagcaaccacatttctggtcatatcaatacttcttgaattcctgctgtgtgccagttaattgggcgtataggagaatatgatctagaacttagccctggggcattccaatctttaggaatatggaagacaagggagatgggccagcaaagaagaagcaaccagccaaggagaaggaaagccaaatggaaaaacggtttcacgaaggggcaagtgacgccaggtgcggtggctcacgcctgtaatcccagcactttgggaagccgaggcgggcggagcacttgaggtcaggagtttgcgaccatccggaccaacatggtgaaaccccgtcactactaaaaacacaaaaattagccaagtgtggtggcgggtgcctgtaatcccagccactcgggaggctgaggcaggagaatcacttgaacatgggaggtggaggttgcaatgagccaagatcgcgccaccgtactccagcctgggtgaaaaagttagactctgtctcaaaaaaagaaagggcaagtgacaggatcagaagctgccgagaggccaagtaaggtgaagtctccaaaatgactgtgggatttggtgaccttgtcaagagcagtttcactgaagggatgatattgggatgcaagccctattggagtggattaaagagaaaatgagaggtaaggaagagaggcattgagcatttagtgtgctcaaaagtctttcgaagagttttgctataaaagaaagcaaaaaaatagggtagtggcagcaggggacgttggattgaggtgccagcggaagtcgtttgtaagatgagaaacattagtacgcgttcataagtttacgggactgatccactagaatgggcacattgaagaagcagggagaggaggcctcactgctattagatagtgagtggtcaggaggggaggggtctggcaagccaacggagagattggcctgggatcagagcagggacccttcctccattgttaaaggtgggaggcagagtgtttgggttcacaggcaggtagcagggtaggtttgatggtgaaaaggtgaagaaacaagcctagagagattaaataacctccccaagattatacagctattaagtggcaaagtcaggatttaagtccagggctatcaaagcctgtgcacttaacctctaagctagattgccctctacctagcatctagcatgtgccaaataaatgctacatgcattgattcattaaacatttaaatacctactgtgtaccccattgtaatcacccaatgggttcttcctgcccactgcacaaacaaaaccaattcactgaggccattgcatgaagaaagagtgattgacatgcagctggccactccatgtgggagatggagttactactcaaatcagtctaaaaaatgcagaggtttttccagggcagtttagtggccagggggctaggggaatgggtgctgctgattggttgcggatgcaaccatagggatgtggacagtggtcctcctgtaccaagtccctttctgggtgggaccacaggactggttggcaggtccaggtggagccatcagtcctcagaaatgcaaaagcctgaaaagacatctcaaaagattaatcttaggttctacagtaatggcgttatctgcaggggtgattgcggaagttgcaaatcttgttaccttctaaataatggctagtaatcctttatgtctatatcttagcagaattaggctcctctcatccttctgacttggtgacctttcattagttttacaaaagtggtttagttttagaaagtggaagggctatttccatttcaactgtaaactaaatttctcccacagttggcttaggccaagcccaggagtgatcaaggacagtttggaggttaaagacaagatgagggttgtttagatccaatctctttcattgttgtaattttctcactgttataattttctcagtgttataatttttgcaaagaggttttaccatctacagagctgtgctagagataggaagacaagttagaccatcctagccctcaaggaactttcagtataataaaaggaggtaagcaagtataatgaagtaacagcataggttagccaagagagatatttgcaaggttctctggaaaatagcaagaactgtaggaatcagaatgtcactgggcagagtcctagagagtgaggagttgttgaccctcagtggagcaacaacatgggcagtcacagaggaatccacaaaagtttagggagttacatattcttgctctttttttttttggcacacttttctcccttttttcctttacccttcttctaccttctctgtctcttctctctccttccaaatcctacttctccatcctcacttctagaataggtggcagtctatccactctgggcatcacacagatagtcatgatggcccacccactaggagcaaatagcaaacatcacggtgaggtggtgcttcaggactgctgaaaagagccagtggagtgtgactgttgtgtaaagtgagagggggtgctgaaggagggatggttgtctacagggttctatttcaccagcagtcctaccattgagaaaagtagaaaagtcatcctccctctttcctcggccactttctctgtacacagatttattactcaaaaatggcaacccattcacagcttttgtttagatctgagtcatagtagtgtggagataaagctgagggagtttacctctttatgcaaactgcttatctttaaagtcctaaaggcaatcggacttagaaagggtgggggaagcccccttttgtaaccaactgttcactctccacttgcccaactataatttcttttttttattttttgagatggagtctcactgtgtcaccgaggctggaatgcagtggcacccatcttggctcactgcaacctccgcctcccaggctcaagcgattctcctgcctcagcctcctgagtagctgggattacagatcctgccaccacacccagctaattttttgtatttttagtagagatggggttacaccatgttggccaggctggtttggaacttctgacctcaagtgatccgcccaccttggcctcccaaagtgctgggattacaggcctgagccaccacacctggtcaataatttctttttataactaggatccttacctacaatttagtcctctctttttatctcttctcttggttgattaggtgtatttttcttatcttgctagctttatcaaagatatcaagttgctagtgaactttgttttccataacagagaaagtttaatcttttaattggattagaaataagcaagatcatagaattgtagacttaaagtggcagagaaatcattaatgtccacatttcctacataggaaagtgacagccaaagagggtaatcatacctgaaaactggttattagcagaaattgaacttctagaaggcaggtgtcatttcctcatttggtctccagtgctctctctgttacactgttgctctgttttaacttgtggtgaaagctgtcctcccgaataatgttgacttcctattggtttggtgaaccaagtcacaatctttgttgggtttaggtgataggttgtaatgactgagtcactcagtgctgggctgtcttgtgtgtcactgccattctgtgtgctcatggtggttggctggtgaggcccagctgagggcagggttggtcggccaggactggaaacaaagagagaatggtggtgttggggtgtacatggcttgcctcggtagtggtccacttttgaattaggccaggatactttctatttgtttgttcacttggtttgagggaaattaagatttactgtgttttgagatattcttcttagtctagtgccatgaaatcaaacagatctgggttcaaactgtggccctgccatgtactagtttatgtgatcttggacaggttattcacactcgcagattgtttctttatctgtggtaaaacaagtataataaataccctccttggagggtagtgaaaatggaaaacctctaccatcttcctagtgctgatcgtagcccatagtacacactgaaaacatggtagctgcctgggctgttgctgctgctgctgttggttgaggaggtacaagggaccagaacaagtggacatcagaagttttgacaatatagaggttcgtttgggtctggtgcacctgtagtcccagcactttgggaggccaaggtgggcggatcacttgaggagtgatcaggtcaggagttcaggagttcaagaccagcctggccaacatggtgaaaccccgtctctactgaaaaatataaaaattagctgggcgtggtggcgggcacctgtaatctcagctacttgggaggctgaggcaggacaatctcttgaaccctggagatgtagaggttgcagtgagccaagatcatgccactgcactccagcctgggtgacagagtaacactctgtctcaaagaataagaaataaaagaaggtttgacaatctagagtttcattttggctgggcatggtgacaaatgcctgtagtcccagctactagggaggctgaggtgggaggctcccttgagcccaggagttcaaagcttcagtgagcttagatcataccacttcacttcagcctgggcaacagagcaagaccctaactccagtaaataaataaaggcttattcagtaagtcagtaaagaatccaaaaggcacgtaatagcacatcaagtatttgaggaaagcaaaaataagttgtgagggaaaatagaaacatggattgtttgagcctgcagtgagctgtgatggcaccactgcactccggcctgggcaacagagtgagaccgtgtctcaaaaaaaaaaaaaaaaagaaaaaagaaatcttcagtaaagggttctttgttggagatgaagggtatgggcaatgaatgttcaatcatgttctccagaggccttcttgaactgtccctatcctgaaaatatattataatgagatcttaaaagaaggtaccaataatcaccacttttgtttttgaaaataaccaattttcaggttatcctcacaaaatgtaagctgaacagttagcatctgtcttattgtagaagaagttgaggtaaagaaaggataagagcacagtatatgtttctggaaaaatgaaattaaaattcagttctatatgatttatgatttaattttgaaaaaattactctaattttatcatcaattgttttataacaaactcttgattatctgattataagctattcacttgtagattattttaatcttacagttagattaaagttaatcttacctatacttttatagttaaaatttccttctcactcagtacccaagtcagaggtgttcaaggaatgcacctggcctaggtaaaataagatctgggtagcaaagcacctggcaaaatcctatgggtcattttatagtcaagcacattggaaaaccgggttatcttttatgctcttgatttttatatgctcttgatttaaaaaaaaattaggccaggtgcggtggctcacgcctgcaatcccagcacttcgggaggccgaggtgcgcaggatcacctcaggtcaggagttcaagactagcctggccaacatggtgaaaccctgtgtctactaagaatacaaaattagccgggcggcagggtgtatgcctataaccccagctactcgagaggctgaggcagaaaaatggcttgaacctgggaggcagaggttgcagtgagctgaggttgcaccattgcactccagcctgtgtgacgagagcaaaactccatctcaacaacaacaacaacaaaaaatttaagtctactcaggcaaggtggctattgcctgtagtctcagctactcgtgaggctgaggtgggaagactgcttgagcccaacagttcaaggctacagtgaactatgatcggaccactgcactccaacctgggtgacaaagagaggccctgtctctaaaaagtaaaataaagtaaataagaaaaaaaaaactaagtctgtcttatattcccaagtaggttacagttccttaatggtaggtaccaccttctctttggtatctcaagagtctggtatgatgccttttgcatggcaagcacttgatgttcatttgctaatgatgatgattcttcaactccaactcccaaataaattcattacattctgctttccaaactgacttctgctgctcatttccttttttcttctaattccttctttcaaaatatttcttccctttttcttttcttttttttttttttttttttttttttgtggagacagggtctcaccctatcaccaaggctgagtgcagtggtgcaatcatggcttactgcagccttgaccacccgggctcaactgattgtcccacctcagcctcctaagtagctgagactacaggcatgcgccaccatacctaatttttattttgacagggtctcactatgttgcccaggctggtctcgaactcctggactcaagtgatccacccgcctgagtctcccacagtgctgggatttcaggtatgagccactgtgcccggcctcttccttctactaattgctctatgctacgaccctggtccaattcccaccatctcaccctttgaaatcttgtccccacgcattatttcctcacgtctaccaaatgattcctgacaaatcaagattacaaatgtaccagttttaccatctccctccccgggccaaacttttaccatgaagcacaaggagcctactgctaatggcttcttcctcagtaatcctattcttattacccaaaatatataaaaaataaatttgctctggacactctctgtagaggtttactgagctaccaaaagacttatgctttcaccccaaagcaaacttacattcatgattatccagtcacaactttccccttctccaactatccaatattatctcacctatgatatgagaccctattccacacaaggaggtttttattgttatgaagccgcatcattattaaccccaaagccttactccagttacactgtctctccatctgaaacctaggcttgcttctctaaaaaaccttagaagctcacattcatcttggctgtctatagcctagaaaagaaattattgtctacatcatgaattctgacactggtatttttatatactatacagcacctaagattttagacttagagagaggtgcccaacattttcacaaatttgatattatttggtttcagtgttccccaaaaatagggtcttggtcctgtatttctgcattcctttaacttatgattccctatcccttggtcagaagttggggtcctaaaaaatcacaaggctgggcgcagtggctcacgcctgtaatcccaacactttgggacgccgaggcagggggatcatgaggtcaggagattgagaccatcctggctaacacggtgaaaccctgtctctactaaaattacaaaactttagccgggcatggtggcgggcgcctgtagtcccagctgctgcggaggctgaggcaggagaatggtgtgaacctgggaggcggagcttgcagtgagccaagatcgcgccactgcactccagcctgagtgatagagcgagactccgtctcaaaaaaaaacaaaaaaacaaaaacaacaacaagtgatttttccccctctggccctaaggccatccatcgagaacacagagggaatgcactggtgactgactgctgttcagacacaatgggcctcttggtgaaggggaagaataaaagcgtgccataactcccactctgctggctttgaaatcaactggctttcttaaagctgtagaattatgctattttccttttttgccagatccccctgaacccatataataaagcttgttttcctgtctattttcaacagggtaactgttttgataagctttattacctgatggattgctattttattggttatttctacacagtaaaggtgaatcttcaaaaacatacacaacttagaacctggaaagtactttagagattatttagttcaataccccttttattttaaaattcatttgattattattattttttgagacagggtctcagtctgttacccaggctggagggcagtggctcaatcactgctcattgtagccttgacctcccaggctcaagcaatcctcctgcctcagcctcctgagtagctgggactacaggtgtgtgccactgtgcccagctaattttttttttgttattgtggagatggggtctcatttgttgcccaagctggcctcaaactcctgggctcaagtgatcctcccacctaggcctcctaaactgctgagattaaaggtgtgggtcaccatattctgcctcaatgcccctgttttatagccctgttactgaaccgtaagtctctgtttttcatcagaaagagtcatacaagctattcccctgggatcctaggtgattccttaggaacggatcactttttccattagattggtatctccagaataactagtggtcattcccagacttctgaaatgccaatatgaggaactcctgcacgagcaagaccagattttgagaacagaaaaataggaagtgtggtgacccttagggtcagcctgagcctttgactcatgcacaattaatcccagccacactgcttgtttcctctggttggattttttatttgaacaggaaatgcattaggaataaaatggtaaaaaggagtgcaggtcttcttagaatcggatatgagcagtctgactgcagtcctgggttcctcacggactccttttgggctgtctctaaatgccaggggaactatgtgctttatgcagcctgaccacgtagagtattttattcaggtttccatacgagccatgtcagaacttctttcctgagagctcacattcatggcatcacaaatttacaacacatgtgctttgactgatgaataccactggtcaatttgttttttattggccttttgtttgagggggcaggtgatctagaaacatgctgggggaatccgaggagtcattgtggccaactgcctcattttattgatgggtagattgagttccagagagaattagtagttacccaagagtaaacatgtaattattaacaaagcatataaggcagttttcctcagggttctggatattatttcacaaataaggattaaagttcaaggaatcattcctagatatctaagaaatgaccagacagctaaaagagtaatcttattaaggcctgtctcttagcatgtgtttcccctgctcaaaaacctcatgactctttgctttccattgaataaaataaatgtcattgacatcctctggggtccaccccaacctatctcttcagcctcctctcttattttccacgtattatatccttcagatgattccccatttcttagtgctccatatgtgaagtctgcagagatcctgcttctcctagaagtcactgttcacatccaaccgcttccctgaagcctccacttgccatgccagggactttgctttggtgctgttgctgtttgtctttgctccatagcacttatcacattagatctttctttaagcgtgttgcttctgcattgtaagaggcagggactaatttgtttgtctttttctgttccacaatgcctcctctatgataggtaaccatctaatatttgttgatttaaatagccatttacctgcctttttgatttctggcctcattttcgacttcttaaatatgttgtatgaattaactagaaaagaggtttaagaaatgaatgtttttgatgcttccctggcatgacaagtatctgggaaaatgtgaaagcatacctaactccattctgggaagaatgtttacgctataaaatcacctactcaccagatcaaagtaaaaggaagtactttttcttccttcagtcgtatgactaactgtctgcaggtgggagcttcagcagcttgcgattggagtgtacactaactggtgacttcaattccagaaaagcaaagcagtcagaagagtcctgactctaagttaagggatgaagtcctgaaaggtttcagatgttcaaggattagaaaggtggacttggaggatggggaatggaggtgcagcttgagaaggaaagcacttgtttatacccctggtggcttactaaaggattaaagaggcgggggagactgatatatgacctgacctggacttctaaaggggtgctgtttctctttcacacgacttttcctgcaaaacctttggagtagcagaatgcctctatcttcagcaagtaaagcagccaagccagtttgaccagcttgagggaaacaccaaacaaagctggcaactccaatcacatgcatactagttactcattatcttctggcctctggagaaagatagagtagctcgctgattggatcctgaggttgaaataactccacatctcactgcgctccgactagagcaacgagaagagtgtctggaatggttgggagacattttaagcaggacaaatccagccttaggctagactgcacctgtccacagcccagcccaggcccatggaaaagaatagtaaaacctttgtctttaagcacatagaatatgtgtgaaacccagaaggctagaaaagaaagggaagtggaggagaaaaggcactgggactccagctgggagtatgaagactacgggagtgtacggaaaaggaaccttacagtgctggatggactctacagagaaaatgacttggatcccaggtactgggccaagggacagcatcagccctacagaaaaagggattgtggatactgggattttgaacagagtgaaccaagctatatggactgtggggaagcacatgaaagtggaaagggctgtgtgtaccacggaggtcatgatggttataggagtccagaaaatgtagattatgagagtctcagccctgggacgaaggataattcacctacgagaagcccagatgtgacctcgaaagctggtggatacggggaggcaaatggctactcagactgtaagaatctgaattataatcctgaggactctaaaaaagctgaacagttgactgactgtaggggtttggatgattcttcagcgaatttaggtcaacctcagttgtggtatatagaccatgagaatgttaaccataatcttgaggattgttgggcaactaatttttattgtagagaacacagcaatttatatcatgttcctgggagttatcctgatggtcagcctgtgagcttttcagattcgaatggtgtcaatgaagataaggaatttatcaaataccatgaaggggacaggaatgttcatcaaaatgacaacatgtatcccaaagcaaagactcatattatggatcagggtgattttgatacagaaaataaaggctatgatgctttatttgcaaactgtgcatataaatctcgtaattccagagggacagattctctccatcaaatggagaatttggagtataatggcactgacataccaagaacaaaggcacatgggggcagcaggatccttctggatggtctgcagactcagtgtaccaggggagaacaaggaggacatcatttggggattcctcagagctcgtcattagagaagaacatctggcatttagaggaagagaaaaaattaaatggcccagagacttggagaaggaatagttgcctccgccgcacagcacccagcaccctgaggcgctcagagttcgtgcaaaacagcaagaaaacccaaggtatgaactcagccagccttcttaagataaagcataaagatagatttaaagggtagttataccaggtactaggagcacttgtgttcttaaggagcccgggccctgaacttcttatcaagtgcaccttgagtgagaacaaccttagagatttaattactttggaaggcattgtacagagcaagagtatatatacagtgctaaaaatatgcaacattcggatagcgctctcatgggaacttttatttacgcttcctggttttttcagatgtctctaatctcaagtatctttcctttcttactttcatgtttttgttcatcttgtcgaggcagcaagtttattatcagggcatcaagctaaaattcattttcctggcatgtttttttttttttctctcagtctctacacttctttggacattaatggaaaagaagacttgactttatttttatttatttatttttttgaaacaagatctcattctgtccccctggctggagaacagtggcacggtcatggctcactgcagcctcaaactcctgggctcaagagatcctcccactttagcctcctgagtagctgggactatgggtacatgccaccatgcccggctacttttttatttttttgtaggggcagggtttcaccatgttgcccaggctgatcttgaactcctgggcttgagcgaaccacccacctctgcttcccaaagtactgggattacaagtgtaagccaccattgccaggccttcattttaattttttttttttaccgctcctttcagagcagggctaccccataggcagtgtgcccagagtagccctgatttgttttatagattgttcactccttgacattcaggaatcttaagtgaatgatgagtactgacactcttgtggattccagaagattatttctagctttcaaatcacttcatctcactgagccttaactacgttgtctgtgaaatgagaatattaggagtcttttatcatgtagaggttctttctttcttgccattatatcttttcttcagttctcataagtgagctttatttctactgtgttatttttataattactgaactctctgttaaacctttcgtgtgtgtgtatgctgtatgttgtcttcatgccaaacggcctttctggttctggccaattttggggtccaggctgtgaccagaggataaaggttagtcagagaatgtgaatgatctgaaaaatccatctcatgccctccccttaagtagaaagtttctcgtctaggtctccttcagaatgggctggctggttagatttgtactaggggccaccacagactgaaaagataagcctgctatggtcctgggatggccggtggtttacctggtggtcttccaacatgggcttgacttaacttgaatttctggggcaccattttggacctaacaggctcttaacctgcacctataaagacaaaaatgaaaccaaacccagctttagttgggaggctgaggtttttagcagctagtcattttttcctaggtgcattttctctctgaaatgatagggactggataacttctaaattccttccagctaaaaaagaaaaaagtctgattctgtgattctttatattggtttttgtattgttcctcttcccttccccccgcatctgttcctttggtgaactttgtttcctatgtttagttccttattgtattaagcctcccaactgtaatcaaagtgtgtttattctgtttgacttaacaggagtgaaacccttctctctgcagtgttgtaatgtgccctctgatctccctgaaaccagctcggttccacccaatatcatttccatttctacaactctctttatctttgaggacttaacttttgaaagtatattcatatttagttcacccctttttgtacccctaatatccttcttgacctataacaaattctgtctttactagaaatctttcagcattctaacgttctttgttagctctctcacgccattgcccttcctgaatattacaagggaacactgtgtaattacacaaaggaacaagcatcagagttggtctgccctgagttcaaatctcagctccaccatttactaaatggccttaacttgacaaaaattacttaacctcttggagcttcggattctcaatttgtaaagtgaagataatacctctctcataatgagatagaaaaataaaacagtcacatatccggaacatagtaggtgctcataaatggccatttctttgtgttttatctgcccacctcccttcccctttataagttgcgccacccacctgtcactccatggtttcgtctctgagttccagattgatagtccctgctccctgttggacatctaccctagaccgtaaacacttcaagtttgattgtctaagtggaatgtcctgtcccttcctcttctcccgtcttccccttgccacccctcctccatctgagacagagctctgttcagtggctgctctccagcctctcccccaggcaggaagccaagttttcccccaggctttcctttctcaccggcctgatcagtcattctcctgaggcctccatctgaggtttttttagggcaggtctgttaggggtttgctcttagtcctagggtgtggacctctagttctgagaggtgggccttattcctaaggtgtggcccttcggaggtttcaacagaaaactggaagtgtttattgaacctcctaacttggagggactcaaatttcaaactgtgtcttcccagagccagacagttggtgaagatctatctgctgggctcttctggcctccagctttccacggggttccttggagtctcatcacctgcatgcacagttgaaggattgagaggcatttctgcacagattttggggctctcctctctgtggcttactgttttccaggatttcccccttaatagctaatgtcttcagagcccccagactggaacctttggctgctcagcccagtaagattgccccatgtgggctttcttcttttgctttatttcccggcgtcctaaaagactagggagtgccctgaggggaggactggagacaggtgcatcttacctagtttgcttcccttgttttgagtcatatcccctccaaattctgcctgcttttgattgcttttcagtgcctgcatatagttattttttaaaatatctgtcagaaggctgaggtgggaggatcacttgagcctggcaggtcgaggctatagtgagctatgatgatgccactatactgcagcctgggtgacagagtgagaccacatctctagaaaaataaaagtaaataaaagttaaaaaaataaatcttgtaaagtgtttttggtagttataagtagggagattagtacaatgtgagctactctaccattactagaccaagtgtgggcactagggttttgcacttgctaataacatacatggttatgatgagaaggggacctggtgtttcaaattccacgttacctgttttgcatgtaaataatattaggatatctaaatgaagagctcttacagagaaaactatgaaactagagagggctctaaacaaaactagagagggctaaaggttcagggttggaaggctacaaaataggagcctcttatgttattactggaaggaagcttatatagccacaatcccatgtttttgtaaataatgggtagccactcatgactgggtcttgaagtctgtttgggggttgcaatcagcagttctgaaaaataaaagtaaatagaaaaaactttcatactacattctatgtagtaaaagtaagcatgtaatactttgtgtatgtgtatgtgtatagacataaatgtattatgtaaatgtgagttacagcctaaagtgtgggtcaggccaggcacagtggctcacgcctgaaataccagcactttgggaggccgaggtgggcagatcacttgaggtcaggagtttgagaccagccttgccaacatggtgaaaccccctgtgtacaaaaatacaaaaattagctgggcatgttggtgggcgcctgtagtcccagctactccggaggctgaggcgggagaatcgcttgaacccaggaggtggaggttgcagtgagctgagattgtgccactgcactccagcctgggcgacagagtgaaactgtgtctcaaaaaaataaaataaaaaataaagtgtgggtcacagtaaaaaatgtttgaaaaacacttaaatacaacccatttattttataaatgaagagatagagctcagagaaattgaaatgtgtttccaaggtaactgggtcaaggattagggcaggaatagaatctggctctcttgacacctagaatgcttttccagcattaccacatttgaaggcagaagcacagccgtagattgagtctgcaaagatgaatttagaatatcagaaaagtgttaggtatttctctgcagagtgcacagaaaaaaaaagtgttaggaaagtcagagggaggctgccaacagaggttgcaactatattatagacagcagaggtgcaaaggtgcaagagaggatatggactcgggaaagacctttgcatttggtaggttggtggagggtaggagcaggggcacagagcatatgacagggagtttaggagggcagtggtgataaggatatgaaagcagtcccttaaaagttgggacagtaattgctgtggagcaggaaaatcttctgttttgtctttctcccaagataagaaaaacctgcattgatttgaaggcacttttgcgaagtagtacacagacagctcaaagtttttaggactctggtattcaagatttcttttcattgcaaacatgtgaacatgatatctgttccaacagtctgtattcaagcttattattaatataccagcacatagatcccatatctcctttaattgcagtccaccaggtgtttattaactaatgtctgtacttggcattgtaccaagcattgaaggtatccagagaaggcaactatactcttaaacacctgccatgcaggagcttgcagatcagttgaagagacaaaatacaaaagaagtatgtatagcatagacagtaaatgctatggacagttggaaggtagaccaggttttttgttttcttttttgttttttgtttttgttatttttgagacggagtctcgctctgtcgcccgggctggagtgcagtggtgcgatctcagttcactgcaagctctgcttcctgggtccatgccattctcctgcctcagcctcccgagtagctgggactacaggtgcccgccaccacgcctggctaattttttttttttgtatttttagtagagacggggtttcaccgtgttagccaggatggtctcgatctcctgacctcgtgatccacccgcctcggcctcccaaagtactgggattacaggtgtgagctaccgccaccgcacccggcctggagccttactctgttgcccaggctggagtgcagtggcacaatctcagctcactgcaacctctgcctcccaggttcaagcgattctcctgtctcagcctcccgagtagctgggattacaggtatgcaccaccatgcctggctaatttttgtatttttttgtagggacggggtttcaccatgttggccaggctggtttcaaactcctggcttcaggtgatccacccatctcggcccccgaagtgctgggattacagacgtgagccactatgcccagccgaaagaccagtttttgcttgagctattagaaaagactgtagggaaatgtttgaacttggctgaaacttaaagaaataatggagttgggataggcagagagaagcaaggagaacagttctggttggggaaactatgagaaagacatagggttgtggtgacaaagacgtggggaaggtggtgaggaacacagtggaggaaagaactagagtactgaaatcttagacgccagtaggagtttgggttggagctcaaggaagaaatcagagctgggcctgtatggaggtgagccacctccatagctgtatcactgagatacagctcaggtacagagggaaggaacagctggggagaggagcaggtgcctgagaactgagcctcagagatgcccacagttacagtgcaggaggaggaaggcagtaagagagatggggcaagaatattggaagaggtcaggaggaaatcagaattttattattattttttttggagacggactctcactcttttgaccaggctgcagtacagtggtgtgatctcagcgcactgcagcctccgactctggtgttcaagtgattctgcctcagcctcccgagtagctgagattacaggcatgtgccaccacacctggctaatttttgtatttttagtagagacgggatttcaccatgttgtctaggctggagtcgaactcctgacctcctgatccgcccacctcggcctcccaaagtgctaggattacaggtgtgagccaccacacctggccctaatttttgtatttttagtagagacagggtcttgccaagttggccaggctggtgctgaactcctgacctcaggtgatctgcctgactcggcctcccaaactgctgggattacaggagatgtcaatgtctgaagctatttggtatgcaacaagatcctcaaagtgtcaagaaaaagaaaaggagaaaatgtttgaagataaatggggtagttaagaggcaaaggagagggaaaaaataaatatgtggaggcaagaggaaatgaatgcagggccatatttcttcaagagttgggagataactgaagctttcgagtaaattaggcactcctcttccaagattggaatgctccaatttggccaactctcatccagccttgcttcctgggatcatgagttgtattctcaagaagctagacaaacaaaattagcagggtatggtggtgcgtgcctgtggtcccagcagttcaggaggctgaggtggttaagattgcttgagcccgggaagttgaggctgcagtgagctatgattgcaccactgcactccagcctgggcaagagagtgagatcttttttttttttttaagaaaaaaaaaaaaaaaaaaaaaacagcagcagctaggttatgtgttttcttcccaagccattacctatgttatttttacataacattccatcaacaatgaaggaatgttggtctggggagaccccaggcctctgtaaaagcgagagatatcaaggaaaggcaagataatgagttaggatgggaagatgtactcttctagggtatcttctttcatatggacctgagggtgttaaggggtacagtgggaagggggagtgaatcaaagcaactaacttgcaatatcatggcatgctcaggtgggacctcagatctctgactcattcgccctgataccacagttttccaatttgatatttcctgagaaaccaggaagtgcccgtggctgtacataaataccaggccaacaggctacaggggtgtgacagtgctggtagtcatatttgggaggaagatccatgtttgtattcatagctgcacagcagacctggttccacagtgtcagacacccctttcttctcatcataaactgaaaggaaacaaatcaatgaaatatattgcatttcattgaatccaaaacatcacaatcatagcagagtgatgcttagggcactctgctaagtaatactagttgctgcttttttttttttttttttttttttttcagatggaatctcactctgttgcccaggctggagtgcagtggcgtgatcttggcacactgcagcccccacctcccaggttcaagcgattctcatgcttcagccacctgagtagctgggactataggcatgtaccatcacacccagctacgtttttgtattttttttttttttcagtagagacagagttttgccatgttggccaggctgatctcaatctcctggcctcaagtgatccacctgcctcagcctcccgaagtgctgagactacaggcatgggccaccacacctggtctcaattgctgccatttattaaatgccatttgctgtgctaagtactgtaggttgagtgcatacagagtacacaggtcagtccagtagagtctaagctccatgatagcagtggatgaagatggtatttccagaatctaacatagtacttggcatataatagatgctcaataaatattctactttgggtcccagaatgtgtgtatcagaagttaaatagcaagggttattacctgttgccgaagaggtgaatttcgaggaaagagcaatccaaggactagagaaagtgtcatggagaagctgggatttgagctttaaaagacagtaggtgagcagaaaggatggaaaaggcccagagacaagctaggcttgtcctgttcaaggactaatagggaaacagaccattaaactttgttgttacaggtttcataatagtggcaggtgcccagttctctgggctcgctgagaggaaatgactaactggatgattagaaagaggcctcccatagtaagtgatgttccttgcggaactggttagaagttggtgtactcatacccaactgagaggagtaaatgaagtaaaagagtgggaagtcggctgggcatggtggctcacacctgtaatcctagcactttgggaggctgaagcaggaagattccttgagctcacgagttggagcccagcctgagcaacatagtgagaccccatctctacaaaagattaaaaaaataactgggcgtggtggcttgtgcctgtggttccagctacttgggaggattgcttgagcccaggaggttgaggctacagtgagctttgagtgtgccgctgcattctagcctgggcaacagcgagactctgtctcaaaaacaaaacaaaaaagactgagaagtcgcgtcagagttcagagctgaaagtgacaaacaggcccaacccctttgttacacacacagaagcaacagcccagaaaggttgtataacatgtccaaggtcacacaggtaggagggaggcagggtgaggccttctgaattattgtctgagtgctttattcaccacacctgctgctctcccaagatctaggagcagctccacatatatccccaaaagtcgaagtctgggaagagataggggaatgaagtgactttaccccacccatatcctaggtttaatcagattttaccatcaaaatattggaaatatagggctgggcgcggtggctcacacctgtagtcccagcactttgggaggccgaggcgagtggatcacctgaggttgggagtttgaggccactgtgaccaacatggagaaaccccttctctactaaaaatacaaaattagccaggcgtggtggcgcgtgcctgtaatcccagctactcgggaggctgaggcaggagaattgcttgaacccaggaggcggaggttgcggtgaggcgagatcacatcattgcactccagcctgggcaataagagcaaaactctgtctcaaaaaaaaaaaaatggaaatatagtaatccttattttgagagattaggttcacccttttaaataaataaaacctaaacacttactacctaagtttattctattttgtcttattcttttgtttcatgaatttatatcttgcctgttagactagattcattcactcaaatggaactaactttaaagaccatctagtttaactccagttattttgctattcctgaagttccaacagatgaaacaacttgactgaaactacagaatgctttagaggacatttcagctttccatatccttgccccagctcccagatggagtcttcctctgtcgcccaagctgtagtgccgtggcaccatcttggctcactgtagcctccgcttcccaggttcaagcgattctcctgcctcagcctcccaagtagctggtggcgcacgccaccacatccggctaattcttgtatttttagtaaagacggggttttaccatgttggccaggctggtctcaaactccttacctcaggtgatcaacctgccttggcctcccaaagtgctgggattacaggcgtgagtcacagcacccagcctataattaaaactttaaacgattataatttagatcaactgatttttggggaggaaggtgggatagttgtaaaagatatataaaatgttatgagagcaagtggaaggaataaaagtaaaccgcctaattaatataaactgaagaaagtgatttttatagagtaggagagaaaaatagagggttatgtagttgagcaaattttgaaccatcactgtagtgttaatggaaatataatgcaggaaatggccatgcttttatggataagacacaaaatccagaacgggccttgacgtttaatggagagcactggcttgggaggccagttttgaatatgctgctttatgagctgtttggtcttaaacaagtcattttattcctctttgcctgtttcctcatttgtaaaacgtgagcactattaccttgcctcaagagccttggtaaaatagaacatcggattctgtgtgtatgtgtgtagaaaatagagcttttcatgtaaagttttattgactgacataaaaatttgcttattaaacagtgataactttaattttacaaaaattatctttgctgtgtcgattattttacttatgctgcctaaagattaaaaaataataatcccacagttttaagattatcagcataccatgctaggatttatgtgtatttggtgagtgttcagaaatggtgtttgagttactcctagtattaaactcactatcctgcagcataagaagttgcagaccatggtgaaaccttgtctctactaaaagaacaaaaattagctgggtgtagtggcaggtgcctgtaatcccagctactcgggaggctaaggcaggataattgtttgaacctgggaggcggaggttgcagtgagcccagattgtgccactgcactctagcctgggcgacagtgagactccttttcaaaaaaaaaaaagaagttgcagactcctgtaatttgggcacttgatcctcatttgttgtcctgtttgcctagattgggacctggatatgaaaaggggaaagggaggctttgagctgggtctccgaggtggaatttctcccagcagggattttacttcaggctacttgccaaaatagaccgacattacagagcaaaagccaccaggaacgtttttcctcttgctgttgagatttaggacctaactgtaatagatttacctctgaagtttggtgatccaggaagtctgctatgagccctgcagctctggaagttttacacagagcaggataaaatttctccaagtagaagtaaagtaggtgctagaggaaaagcagtgggggttgggtgggctggccagagtgttgtggtaacacggaaaaccagggtttgtgattcctccaggcagggctggggagaagatgagcacgtgtacagacaaatcgcctcctctcagggtttgctgcagaaagactgcttctagatgcgttgctaggcaggcagttgtgtttttgctttctattttgcatattatttcaacaatgttttcctttcttttcttttttttttttttttttttttgagacagagtcttactccatcgctcaggctggagtgcagtggcacgatcttggctcaatgcaacctctgcttcctgggtttaagggattctcctgcctcagcctcctgagtagctgggactacactacaggtgggcaccactgcgcccagctaatttttgtattttttttagagacggggtttcaccatgttggccaggctggtctcgaactcctgacctcgtgatccacccgcctcggcctcccaaagtgctgggattgcaggcatgagccaccgcgcccagcccctattttcttcatccatttatagggattgataggtcaggaaagaaacctcagattattaaaatgtaaagaacgtttgaaatggactaacggtagttgggggctgactgttagaacattctcgttttacagcaaatgttcttttttctactttattattctttgtcatagcaatattatatattcatcatagaaatactagaaatgggaataagtgaaaagaaaggaaaaactcggtttctgtcacctttaacactcttttcaaatatgtgcatttaaaatatttttccctttttaacaaaactacaattctttcataaacttttttcagcaattcacgttagatgtcacccaggctggagtacattggcacaacctcagctcactgcaacctccatctcccaggttcaggtgattctcctgtctcagcctccagagtagctgggattataggcgcgtgccaccacaaccaactaatttttgtatttttagtggagacgggttttcgccatgttagccaggctggtcttgaactcctgacctcgggtgatccactgccttggcctcccaaagttctggaattataggtgtgagccactgcgcctggccttataagagtattttattatatgggcatgccatagtttatttacctgggcccttttgctcttttggttttttattgagacagagtctcactctgtcaccaaggctggagtacagtggcgtgatctcgctcactgcaccctccgcctcctggaattaagcaattcttctgcctcagcctcctgagtagctggcactacaggcacactccactgctctctacccagacccttttgaggaaattttagttctttctgtttaggttgcttctaagctttttaaaacattgaccatccctgaatgaacatatttgtgcccttgtccaattatttagtagaataaattcctaaaagcaggcttctgggctataaggtttgattttttttaaagtagataaagtattgaggttcgatttttttttttaagtagaaaaaatattaaagttttaatttactcccctatccctctttgccctcgattttaacttttaaaatgaaaagacttaataaaattggcctttcccttcatttcacataatttctgccataaattacctggaataccgttgcatattttctgtgtatgacacaactaggttagattctgtctgagggatttacttatttatttttttattttgagacagagtctcgctctgtcgcccaggctggaggcgcagcctctgcctcccaggttccagcgattctcctgcctcagcctcctgggtagctgggattacaggcacacgccaccacgcccaactaatttttgtaatgttagtagagacagagtttcaccatgttggccaggctggtctcaaactcctcacctcaggtgatccgcctgccttggcttccaaaagtgctaggattacaggcatgagccactgtgcccagcctgtctaggtaatttatgttatattgggtggcattttataaatgcaatcatattaatatgtgcaaatatgcttaaatgtatcattgttcacagtcttattgtgggcaaactgtggctctaattatcaggttaaattgtgctctagaattgcaccactttgctattagctaccagatggctaccaaaacccaaaagtggaattccaggttagaatgcatatggtttgccttcctgggaaaaaaagagacagaatagctattggtaaagagcacagactctggagccaaggtaggttgaaatctcagctcttctacttactggggcagttacttaatttttcttccttcctcatcagtaaaatggggacaataatagggtgttttgaagctaaattaatatttgtaaaatacctagaacagtgcatgacacacatagtgccatataaatatttgttttcttttctttttgacacagggtctcactctgttgtccaggctggtgtgcagtggagctatcacagatcactgcaacctcaacctcgaaggcccaggtgatcctcccacttcagccttcggagtagctgggactacaggcacgtgctaccacgcccagctaattttgtttgttgtttgttttgtagagactgagggtctcactatgttgcccaggctggtctcgaactcctggtttcaagtgatcctcccgcctctatctcccaaaatgctggaattatagtcatgagccactgtgctcagccagtatgacttttttttttttaattattttgttcctgtgaggttaaaaagtactggttaagtttgagtccccattgatctcaacttctcccccaaatcctaggtccttccctgagacaaactctgggatgaatttcgtgtgttttccttccagacctttctctctacacttacataattttatatatatgcgtgtgtgtgtgtgtgtgtgtatgtatatatgtatatgtgtgtatatgtgtgtagatgtatatatgtgtatatgtgtatatatatgtatatatatgtgtgtgtgtgtatatatatatatatatatatttttttttttttttgagacagagtttcacacttgttgcccaggctggagtgcaatggtacgatctcggctcactgcagcctctacctcccaggttcaagcgattttcctgcctcagcctcccaagtagctgggattacaagtgtgtgccaccacaccaggctaatttttttgtattattagtatagatggggtttcaccatgttgaccaggctggtcttaaactcctgacctcaggtgatccacccatctcggcctcccagggtgctgggattacaggcctcacgtgagccactgcgcccagcctatatgtttatatagaaatatgtatgggtttttgcagattttcctttctttcgtctcttttccccgttctccattttcttacaaaattgtgcattttcttaaaaaattgtggcatattgttgtgtgcctttcttctccctggttcatttaagtgtaaatgtttggaagatgtgagcgggactcccagttcctgtgaatcactcctgccatccctgttcttgctgtcctgggactacccagctgaaatctgctctgtgatggctttagggttcattgcctaaaggagggggaggtttggggtcccttggctaagctgtgggtgaaagactgcataaagaggctcaggagcagactaaacaggcaactgctgcccacttcacagttttgcctctcatcacaagagatggctgggcctttggaattctttcctcaaaagggcattccccatttcccacgcaaaacaacaacaaaaaggcttagcatggggtagaaaaggaagagataataatcttagattcaaactccagaggtggaatttcgagggttttaggactaggaaagaacaccaaatagaaaggaaggtgttgatccaggtactgctgggcccgctggtgcacttctcagtccagtacgcttagggttccagctccatcctttaggacaagccctgctgtgatagcccgggtgacttgcgcgattcatatgtaaatgtgggaagcctgggggaaatgccgaccctattcaaaggagtttggggggttgtggagcattccagagctctgggaagattctgtcccgcctgcttaccctcaggcccacacctccacacacagccagctctgggcactgcaggtaggtcctggggtgtgggagccagcacagaaggaagtggaacaggcagcctcttcgtccctgttcaagggcacctgggatctggccgggagctcaaaattttccccattagagatagatccagctttctgaggcaagggaagggcgcatggctctgctctttaactctgaagtgtgtgtgatggagttgtgggaagccgtgggctaatgactcccttccttcgaactttaggaagtgagcctggtgataatgtactaaccggaaagggctgggggtgtcttgagaaggaatggaatcaggacttggggtggggggtaagccacaatcactgaaggaaccccacaactaattgttttatcacaggaagtaaatttgtgcaacagtcccagctcctttaacacctgccgggctatcctaggaagaaagtaagagctcgtctgcacattttattgttctcatagaaaagtggaattttagagtctgcacagggcacttttctgcttggtacattttaccaagtgtatttaccatctatcaggtgcagatggcatattcgggcccattgtgggaaaaggacttatgtttgttgggttattaccttgtttaactccctcaactactctgcaaagcaagtattattatcctcattttatagattgggaaattgaggccaagagataaaagtggacatttccaaggctccccagctacatagtggggaagtgcaagattcaaagcttctttttccaccacagctggctgggggtgaaggccgccttctcccgctttgttgtccgggatactaaaaatttaatttttttagagacgggtgtctcactatattgcccaggctggtcttgaactcctgggctccagcagtcttcccacctcagactcccaaagcgctaggattacaggcatgagccaccacgcatggcccagatactaaaattttagagcagatatttttattagaatatatgtggcataaaggaaaaagtttttatacttacagtcatttcaagccagactttaaaatttgacttaatctttgaaaactctctttgagtgttaataaatgtttgtggcacctgaaggtcacctgtgtcttcagaaataccttgggttgccaggagcagtgacacatgcctatagtcccagctacttgggaggctgaggtgggaggatcgcttgagagccccaggagtttgaaactagtctgggtaacaaccccctcctttaaagagagaggaagagaaagaggagggaaggaaacacctagggttttattaaaattgcggataccccggtcccacccaggtttgctgaatctgaatcccagggatggtgtccaggaaactgcaatatagtgaaaacatcccacaggggtttttaatcacaccaaagtgtttgggtttttaaaggctgctcaagagtttataaaccccattttcggggggtgggggcacaggggaaggcacgctggtagtttaaaagaattgttattgtttttctccattttaaagaaataaaaatctaatacataggctggctggcttctgattgatgagtaagtgcttgctggtactttgtgttttcaactactataattagtagaattttgattctcaggagagtacacagtggtttccagggagtttttaagatttgaagcaaataagcccctgaccttttctcattgagattccaggccagggaaaccaaatggtgcaggattaagtgcacaggatttggatttaaatatatttaggttctaaatccacaactgccatttactcactatataacctcagacaagtttgtcagcctctccaagcctggattttcttacctattaaatgggagtaataatacctacttaaaaattctgatgtgagtattaaatgagttcagggatataatctgtaaagtacctggcatgtgataggaattcagtaaatgttctccctctccagagctttttagtcttgtatttaaaatgagtttctattctcaacttggcactaatgagaccatatttgggattgaaagtctgttgctttgagatcacaaagaaaatttaaaacaagcctattagaaataaattttatatgtaacacaatgaatttagaatcataatcgaacactgatgaaatcagggttatgcttcaagttttgccattcattctaccaaaaagttcgagaaagagctttttctgttatgtcttaagttttattttgaataataccaaatatacagaaaattgcaatagtacaatgaaaactcctgtatacattttatacaaattcacccatatttaacattttgctgtttttatctcattctctgtcaatccccactctccacatgcagtttttttttctttaatgaactaagagtacattgcatatattgtgccccttagtaagcttcagtgtgtattttgtatgaacatggatttttttttgagatggagtcttgctctgttctcccaggctggagtgcagtggtgcaatcttggctcactgcaacctctgcctcagcctcctgaatagctggaattacaggcaaaatacaaatttttgtatttttagtagagatggggtttcaccatgttggtcaggctggtctcgaacttctgacctcaggtgatctgtccgcctcagcctcagactcccaaagtgcggggatgacaggcgtgagccactgcacctggccagattttttttttactcaggctggagtgcagtggcataatctcagcttactgcaacctctgccacccaggctcaagccatcctcccacctcagcctcctgagtagctgggactataggtgtgtgccagtccatgtgctgctaatttttgtattttttgtagaggtgaggtttcaccatgttgcccaggctggtcttgaactccaagctcaagtgatctacccacctcggcctcccaaagtgctgggattataggcatgagccaccacacttggcctaaaatggtgatttgctgactccattatttcttctcttatttatcagctgacattctaccataacaaagagttttctcttctcccccatttatttatgtacttacatattatcaatatgtacttacaggttcttattcagtggaataatccattgtgctttttcatttatactcaaattgtgccagattggccagtgggagccccttcaagctggcctctgtgccctttgacctatccccaccatgttgttgagtacttcttcactttctcccacatttcaggctcagctataccttctctgccccagccctggaattagccatttcttcaaagaaccctgcctccttttagtggagaatggcatctagaaaccagaatttgggttgtattctaaaacactggaattacttttttgagacagggtctttctctgtcacccagtctggagtgcaataatggcactatctcgtgtcgctgcaacctctgcctcctgggttcaagtgattctcatgactcagcctcccaagtacctgggatcacaggtgtgtgccactatgcttagcatttttgtatttttagtagagatggaagcttgccatgttggccaggctggtctcgaactcctgacctcaagtgatctgccagccttggcctcccaaagtgctgggatcatgggcgtgagccactgcacccgtcccagaattcctaacttctgagagaaagcagtgtggaaagtgttttggagaataaaatctgctgtgaaggccgactttccttaagtagtttgaacacttgtgtttttgcttcttaaacctgggttaaaatagtcctgtaattgtactcagacttactagtatatttacataccaaatttgtagttgtttaattggatcataaagaatttgatagactaagcagaggctgattgtttcactgctgttcttttcctttgcttattaccatgtttaatgctcatttcagatgaacaaacgctgttccatgtttatagataactctctcatcctgtgtatctaagtaatagtcagataattgtaaaagctaatgacaggatacatatttgttttttagaataatgcagtttagttcttagagattcttatacttgaaaataccattgataagcttcatgtttatagtaagtttgtatctactaggacatttgagtaacaaaacctgcttgtgagttttggttaaggttttcatagggaaaatctaaacaattttttttacctatttcattatatgctagtgttgacctaccattacagtgactggaaaatgataggtcctataattatccagatctcagatggataatttcttattttttattttacccttagttggcattgttctgtgttccccataatattctgtttaatgtgctacatctgtattttgaacttccagcttgttatttctggtgctttgatcatggaccatgttttatatctgattaagtgaaagcaagtcttataaggtcagacccctctaacctcttttgcaaggagcttgtagacatgctttgttcactcaaagtgggctagctacttcttttcaggacacattctcaaaatggtattgcacaggttggagttctctctgcagtgatggctttctaagcgcttcagctgtccctgtttacaactgacatgtgcgatctgatttcctgagggttgacaatagtgagacctttggttctcaggaaatgggttctgtttgcctcaaactgtggaagggtgctgcttttacacccagagctgctaaccagttctcttttcccttctagaaatgacgctcctctcctcccagtcttcatcactggtggccccttctgggtctgtgtctgccgaaaatccagagcagaggatgctggagaagagagccaaggtcatagaagaacttcttcagacagaaagagactacattcgggatctggaaatgtgtattgagcggatcatggtacccatgcagcaggcacaggtgggaactgggagacagagttagtttgaccttgaatatggtcctccaggccagaagcattaggatataggagctttcgccacagatttattggatttgaaatagaaactgtgactgtgagtgctgctgctcttaatcaagggcctcaacatacgtgtgtcatcagctaagccttcagcatcctttcacttgtcaagtctactgttaacctaccagacactgcagtcactcctaggacacttcctgtttctgtggctcctgaaagcagttccagggagtctgaatcgtggccctgctagaaggctgagtgatgatgtaacaaaacctgggggtgagcagttacatgactctagtacctgttcatatagagtttatccaggaaacccttactaacatgtgagtaggctagggacttttctagatgctggaggtagtaagaaaagggtaacaatgtcctggggtttatagtccttgttgcttgtaacttgaccagctgggctgggcttgggtttacacccttggagcattcactcccaagtacttctgcagcaggtaggcagtgctacgggatgttggttgcgggtgggaatttgtatcccagtgcatttgtaggccaaattggttccattatcactttactaaagtgctggttggggtggcagagaatagttggatcaaggacaaaggatgacactaaagataatgttggatatttctagtctggaaacttcatgaaagtgagtgaagaaagtgaccttgagcaatttttctacaattcttgaagagctgttcctaagatgattgaaatgccattaagctcatttccgtgcatttttatgttttgtttccttttctcaggtaccaaacattgattttgagggactttttggaaatatgcagatggtgattaaggtctcgaagcaattattggctgctctggaaatcagcgatgctgtaggtatgagctcctgtgttgtttcagaagcagctttttaaaaaaacttcatgggcaggagtaagtggccttcctgatactgagtaactatgcctccgggaagatacaggtgtaggtacttagtccagaggttacttgtcctctgctttccttctgtctcagcctactttggggtaataataggatgttagcaatagaagtagttttggatgtcatacagtacaatgtttttccacactcatggttgcagcccattactgggtcatgagatcaacttatttttcaagaaaataccagaatgcggccaggcacagtggctcacacctgtaatcccagcactttgggaggccatggcaagaggatcacctgaggtcaggagtttgagatcagcctggccaacatggtgaaaccctgtctgtactaaaaatagagctgggcgtggtcatgggctcctgtaatcccagctacttgggagaccaaggttggaggattgcttgagtctaggaggttgaggctgcagtgagctgaaatcgcgccacgagccactacaccactgcctggggtacagagcaagacttggtctcaagaaaaaaaaaaacaaaagaaaatatcagaatgcactgtaagtttaactaccaatttttgaaacttatctgttgttttttttttgacacaggatttttacactgtcgcccaggttggagtgcagtggtgcgaattcagctcactgcagcctcaacctcccagcctcaagtcatcctccctaccttggtctcccacatagctgggaatacaggcatgtgccaccacgcccagctaatttttgtaattttttttttgtagagatggagttttgccatgttgcccaggctgtgcccaggctggtttcaaactcctgggcttaagcgatctacccacctcggcctcccacattgctgggattacaggtgtgagccaccacatctggctgaaacttttattttcatttcaaatatatgtgtactgagtcataatttaaaatacatttatgtgggacattgtcaaaatgtttttaaaacattcatctagttcttataaacaagggaacttattggttatccattgctatttaacaatttcactgaaacttagcagctgaaaacattaaacatgtattacctcgctgcttctgtaggtcaggagtctggaggtggctccgctgggtggttctggcccagggtctcatgaggttggagtcagttgttggcctggactgccatcatctggggctcagggatctacttccaagaaagctcactcagttcttcaggcgtcagtttcttgccacgtgagcctctccctgggctttcctcacgacgtggcatgagtcatgagtcacctagagtgacctgtgagagagagcgagagacagaatgagagagagcacgcaagagcaagcacgcctgagacaggagccacagagtcttctataacctgatcttgaacatgacacagcatcacttctgtcatgttctgtgggtcctacagaccagccctggcacagtgtgggaggggacatcctatcattttgctgctttattagaatcctaattacaagaggctaccccagttccagccatgacaccatatacaacaacatccagcagaaggagtgacccctgtgtcgttttaagagtttgcaaaccttttccagagctccctgatcagataccttatttctcgttggccagaagtgggtgacatgcatgcagctaagctgatggctagaaaggggaatgggtcatgacactggcttacactagatggaatttacctgactcacctgggagaaaaacggacacaggaaaaaaatcagggttctgccccctgaagggaggaggaaacagctctgggatgttgtagcatggttaatgtttcctgagtgtttctctcaccacataccctcacaagataggtccagctggatctcagttgttctctacaatagacagccctctgaggtttaggtactgttgtttcttctttttttagacagggtctcacattgttatccagactggactgcagtggcacaatgacagctcacccacagcctcgattacccaggtcaagcaatcttctcacctcagctccctgagcagctggaactataggcatgcaccatcaggcccagctagtttttaaatttttgtagagatggagtctcactatattgcccaggctagtcttggatgcctggcctcaagcgatcttccctcctcagactcccaaaatgctgtgattataggcacgagccgccacacatgtttttgagacaaggtcttgctctgctgcctaggctagaatgcagtggtgtgatcatggctcacctcagccttgacctcccaggctcaagtgatcctcccacctcagcctcccaactagcttttttatttttagtagagatgaggtcttgctctgttgcccaggctggtcttgaattcctgagctcagtcctcccacactgcaagattacaggtgtgacccactctgcagccagtttaggtactctatcctattttacagtgaagaaaccgacacttagagggaaggtaatttgcccaggtcacatggctagtaattgatgggactggcattcaaactcaagtctttctgtcgtgcaggcaaatgccattagcctctatacagaatacaactgtgtcttttgcattttctggaacagttagaaaaactggaacctgaggttcttgcccttagtctaaccagagaggtcagggaagttgaggaaggagatacacacattgagttgggcagaaggaagtcacagtgacccagttttagtgtgatggtgaagcataaacgacagtgtatatgattttttaaggcacttgaaataagtatctctgggtcatttatttgtattaagaaagaaatgagataaagttggctgctatctaaaagagcttaattttaaattaagcagttactcatttttcttccagtttattacctgttgtcgttcctggggctctcaggtggttggagttaaccagcttctgcaaggcgccttctccccttaggtctgattcaaatcagaaatgagagtcttagcatctgtgtctatagtgtactataccttagattatgacaataaactgagaaatgaaagcaaatatccatagccccacctccataagatagcacctgcatttattttttcttcttcccttcgcttcttgtccaaagtcaaacaaggagttgggtagcaggcttcgatgtgttgaagacacacagaggtggcagagaggcctcaacactgaaaggctgagacctaggcgcaaggactaatttttagaggagggatggtgggtggtggggcttgagggagccaagactgagagtaccatgccggtggctctaacggaaggccaggcgtgcgttcagtgggggattcacaaagaacaaatgaggtctgaaacatccgatgagggaaggctccgagaagaccatgaagggcaagttaaagccttatggagccacgggcaaagggcaggtggctgagatagagaatgatcaagcagcactgggagactctgggtacatggtcataggtggaaagtactcgctttacctgattttaaacacatcccgccgagagctatgttgttcataatgacccaggatgtgtgtttctgtgtatgtctgtgcttagttttaccatgtccagtgttttcctttttttttcgagacagtctcacgctatttcccaagctggggtgtagcagtgtgatcacagctcactgcagcctctaccttctgggctcaagcgatcctcccacctcagcctccctagtagctgggactacagatgcgtaccaccacacccagctaatttttatgtccgatgttttctgatattttcttttctatttgatcagccgggcgtgttggctcacaccagtaatcccaacactttgggaggccgaggcaaggtgggcagatcatgtgagcccaggagttctggaccagcctgggcaacatgggaaaaccccgtctctacagaaaaaaaaaaaaaatccattctatttcatcaaaacagtgctgactgtgacccattaagtatatttcgtgacccagagtttgaaagagattataggtgtagctttgctagtttgtaattgatatagaacagtgactatcagggaagttgaagaacggcgaattgaatgtaaatcatgtctggatggtgaagattctaagaatgcaactagggaaagggctgcaaaaagaaggtggcagactaatgtagaatggtgcaaccagatgaagacatgggtggctttaggaattccaaagtggccgtgaaggccaggcacggtggcccacgcctgtaatcctagcactttgggaggccaaggtgggtggattgctgagctcgggagttcgagaccagcctgaccaaccaggtgaaacaccatccctacaaaacatacaaaaattagccaggtatggtggggcacacttgtagttccagctatttggggggctgagggcagagaattgcttgagctcaggaggtcaaggctgcagtgagctggttcatgacagtgcactccaatctgggtgacagagcaaggccccatctcttaaaaaaaaacaaaacaaaaaaaaagtggccgtgaagatgaaaaaggagccagccccacccccactgttgtgactggtaggttgcaggagtagacagaagggaagcttctggccaggtgctgtggctcctgcctgtaatttcagtagtttgggaggccaaggcgggaggattgcttgaggccaggagttcaagcccagcctgggcaacatagtgagacctcgtttctacaaaaaaaaaaaaaaaaaaaattgcccaggtgtggtagcacatacctgtagtcccaggttcttgagaggctgaggcaggaggattggttgagcccaggtgttggaggctgcagttggcaatggtcacaacactgcactccagtctaggatgtggagtgagaccttgtctcaaaacaattttttttttttttttttaaagacagaatcttgctctctgcccaggctggagtgcagtggcacgacctctgctcactacaacctctgcctcctgggttcaaacgattctcctgcctcagtctcccgagtagctgggattacaggcgcctgccaccatgcctggctaatttttgtatttttagtagagacggggttttgccatgttggccaggctggtctcgaactgctgacctcaggggatccgcccaccttggcctcccaaattgctgggattacaggcttgagccactacgtccagccaacaatttttttttttttttttttttaaagggaggcagccgggtgcggtgtttcacaccggtaatcccagcactttgggaggctgagacgggcggatcacctgagatcaggagtttgagaccatcctggccaacatggtgtaaccctgtctctactaaaaatacaaaaatgagccaggcgtggtggcgcatgcctgtgatcccagctactcaggagactgaggcaggagaatcacttgaactcaggaggcagaggttgcagtgagttgagatcatgccactgcactccagcctgggtgacacagcgagactccatctcaaaaaaaaaaaaaaaaaaaaaaaagaagggaggcttccagtgagaaagggcagtgtgaggtgatatgaaaaaagttaagtttctcttacagaaaggagttatacattaaggaaaataatttaaatagaaactttttaggccaggcatggtgactcacgcccgttatcccagcactttggaagggccgaggcaggtggatcacttgagcccaagagtttgtgaccagcctgaccaacgtgccgaaaccccgtctaccaaaaaatgcaaaaattagcaggtgtggtggtgtcccagctactcaggaggctgaggtcggaggatcacttgagcccaggaggtggcgggtgcagtgagccaagattgtgccactgcactccagcctgggcaacgcaggagaccctgtcttaaaaaaaggaaaaaaaaaagttctgcacaagaacagggacttccatgggacacaacagtgagagaacagaggtgagtccacagaagcagcgataggctccctgaggggaggggtcgtgcctggacagctggtagggatggttggttgtagggaagcagtaaatagtatcatattggagggaggagaacaaggatgagagctcttttttgtggaacatggagctgaagaagggagcaccaaatacactgagaggaggaaagaagggcaagaggaagagtcatcatagtaagccagggacccgcacgttcaggccacagctctgaaggcaattgttctgtagaagtttgcttaggaactgttcctatgcctaactgactttagatgaggggtctggggatagggaaaaaaatgacctctttattttttttactagtttttaactgaaatatagcatttatttaaagtatgaatgtagggaataagtcacatagtagtagctgtgactttgtcaccaacagaagtcacatgtttctgtcagattaggtcgttgcaaatgtcttgaaatttcagtaaccctcaaccagaggcagccaatgttaccagtgtgtgtcactcctcaagctgtgacagtatggggattgttagactcagtgctacatttggttatttaataccttataaagaagtacatatggctggggctcacacctgtaatcccagcactttgggaggcccaggcaggtggattgcttgagcccaggagtttgagaccagcctggccaacatggcaaaaccctgtctctactaaaattacaaaaattaaccaggtgtggcagcgcacatctgtagtcccagctgctcaggaggcagaggtgggaggatcacttgagcctgggaggtggaggttgcagtgagccaagatcgtaccactgcagtggagcctgggcaacagtgagaccctgcctcaaaaaaactaaagtagtatataggttactatatcataagttggggatttatcattataggtattttaatgtaatatactttatccagtcttatttatgcacaaaaatgttagaaactgctgctgtagaagaactccgtctctactaaaaatacaaaaattagctgggtatggtggtgtgtacctgtaatcccagctacttgggaggttgaggcagaggactcacttgaaccagggaggcggatgttgcagtgagccgagatgtgccactgcactccagcctgggcgacaagagactccgtctcaggaaaaaaaaataagaaactgagggggtcctccttatggggttctcattacatccctacatggagaacgctctcagatgtctgacttggctcgactgcaaagggactggaggctctgtttcagaggccagtcacattgtgtgtgtgtgtgtttgttctaaaacaaatacatgagcctgggcaacatggcgaaaccccctctctaccaaaaatacaaaaaattagctgggcatggtggcatgcacacgtggtcccagctactagggaccgacctgagtctgggaggtcgagtctgcagtgggctgagattgtgccactgcactccagcctgggtgacagagaccctgtctcaaaaaaaaatgaatacatacatatacggatgacatggctttctaaattttcctttaaatgattacaactttaagctgttagatggaagtttcttactatttgatggatagtcttagtatcatttcttgtaataggtaggatttagctggtactaaagtttggctgtgtaccttacatttagtatactgagaagaaagtttactaaaaacactgtatgtttgtgtgtattccaaaggacctgtgtttcttggtcaccgggatgagcttgagggaacatacaagatttactgccagaatcatgatgaggccattgcgctgcttgaaatctacgagaaggatgagaagatccagaagcatcttcaggactccttggcagatctgaagtaggagttttgaccacttaacttccattacagctctttagttctctaagttatacctgtgtatatgcctggacttgatgatgacatcttattttaaacataagatatccatgatatatatcatttaagtggtttcctgattgtatttttgtccatgtgaataagttttatctgtatagagtattaggttagcgttatcaggttaaaaagcagccaggagaggatggtttggtccaaataagagcataggtgagaagactaaatacagggtttttttttttgagacggagtctcactctcacccaggccagagtgcagtggtgtaatctcagcttattgcccaggtcagcatgcagtggcacaatcttagctcactgcaacctctgcctcccgggttcaagcgattctcccgccttaggctcccaagtagctggaattacaggcacacaccaccatacctggctaatttttgtatttttagtggagatggggtttcaccgtgttggccaccttggtctcaaactcctgacctcaagtgatccgcctgcctcggcctcccaaagtgctgggattataggtgtgagccaccatgcccagctaaggtattctagacatcaggtgagattgtcctggtcttagggaagcaaggtataaagatatatggataagtagatcaaagagaagttaggggctaacttttttattttttattatttttttattttttggagagacagagtctcactctgtcgtccaggctggaatgcagtggtgctctcagctcactgcaacctccacctcccgggttcaagcgatcccctgcctcagccccccagtagctgggattacaggcacgtgccaccatgcctagctaatttttatgtttttagtatagacggggtttcaccaggttggccaggcaggtcttgaactcctgacctcaggtgatccacccgcctcggcctcccaaagtgctgggattacaggcgtgagccaccatgcctggccggggctaacattttttagtagactaaatatgttaccataaacattcataattttttgtcccacatgatttatgttctgagaaaaatgtgaaactcaagattctctctctaataaactgtctcttttcttttcatgcccactgccttgcaggagcctatacaacgaatggtaagttccattgctgcttgatgtatgcgctcatttcttctgtggatttttcctaactaactcttaagcaactgtattttcttcctttatagacaaacctagaagtagactcaccttgctgggttttctttcgtagcacttatccccaagggaacactttacttatctgtttattgcctatcttctcctaccaggacagggacttttggggttactattaaatccccagcacctagaacagtacctggtgtttattagatgaatacatgttgaatgactgaaattggaaagtagggtaaaagaatagagagcaatatttaggaacaaatcctgcccataggtgtacattattattatgttaaaaaaaagttttttttaaggtggggtctcacgatgttcccaggctgggcgctatattattgatagcttactaaagtcttttttccttctcttacaggggatgcacaaattatattaacctgggctccttcctcatcaaaccagtacagagagtaatgcgttacccgctgttgctaatggagttgctgaattccaccccagaatcccacccagataaagtgcctttaaccaatgcagtccttgcggtcaaggaaatcaacgttaacattaatgaatataaacggcgaaaggacctgggtaagaacagcataattgctgaaaaggaggtatgccctttgagaatgcttttcttctcaaaacaattcattacttcgctagagttggacaaggcaggtggtaggtataatagggctgtgatgaagaaatggtagaatttgggggaaatatgatattttattattattttttttgagacagagtcttgctctgtcccccaggctggagtgcagtggtgctatctcagctcactgcaacctccacctcccatgttcaagcaattctcccacttcagcctcccaagtagttggaattacaggcatgtggcaccatgcccagctaatttttgtatttttagtagagacagggtttcaccatgttggccaagctggtctggaactctcagcctcccaaagtgctgtgattataggcgtgagccactgcacccggcccaaaatgtggtatttattaaaggcagaagtaacgataaaaagcggaagtatggtatattggaaataaggcatctgtaataaaatatatagcaataagagcctttctcaagagatatgaagacagtggagactaggtgatgggaagttttattcgagcacgggcagtttcctcctcacctcatttatggagctcctctggagtccatgcatagacttttttctaagtgtctaattggatgtcttactacctctactaaagctaggacttcttgtcttttagaaaaccccaatctgctcacctttcttgtcctgtcttcactgcccatgcccagtgacctctctgggttgagtccctcacctcccctcctaaaacagtcagttgcccacccacccactccttcttcataacactgaatgcactcatcaggtctcttgaggccctaacttgagcattcagtgagtatatatagcacagtgactgtgctgagctcatttattattcatatcaagatataatacagtgtaacctttttgtctttccattcttctccacactttaaagttatctaaaatcatttctctgccttctacttcaactgtgtcacccgcattaggatgggatgttgactgtggcttctaaagctctctggtcatccagccctttcccttggttcaaatctcctaatgcgatgtagtctccaacttctacaaccaggtatacctttttgctgcctcccagtcttccccttgccacccttctacttttatctctacacttttctgtaggttgtgcctaatgtttaacatggtaattaaattactgctgtatagcattttactatgggagacgattggatatcaatatctcatttgtgtatggcaccatttaagatggccttacaagtattgctttctgcattttattgaagaggaaaatgagactcaaggtaaaatgactgatttaatgccataccttaagtggcagacccaggcattgacttcagatttccttaagttctttcccttaacaccctctgctgttttcctccttgtctctggcccctctcctggctgcccattgtctctctgctgtgcttcagatatcatgtctgtccataaatcattatttggattaatattttgttataagctcattgaagacaaggactagctcccgtttgggtgttcatctcattttatggctcattttgtagtatgcccatgctgaggaaagtgcttttctgacttactccctagtcctcaagtaccgtaagggtgatgaagatagccttatggagaaaatttccaaactgaacatccactccatcatcaagaaatccaaccgagttagcagtcacctgaagcatctcactggctttgctcctcaggtgagatccccatcctggaaggcttagcgcatctttgacagcttttcagggctccatgagacagcctgcctggcgtcaattggcgtggttcccttcctcagacgtcctccggttttacgagctggtggagacagggccctccagctgctggttacaaaggcaaattagagggtcagatcagttgacatgtaataattatggtagttttcaccacctctaaggagcttataattgatttggtgggacaaaactatagttgtagacttactaagctagcaggaatttaagagatcacctagttggatacatgatgttacaaagaaggaaacgttaagtgtaagagattgaatggattgaaaaacagtttatcggcgatgctgaaagttgacctgaagtctgcagacatcattctgctatactatatatattaaggtacaattcatggaaaatataagccagaaaatagtccattgttaggttttgtattttgttctccaaatgctgtagtattttagaaaaacagttcagtgagagcaagagtcatgttgacctgagccttataggaagggggcaggcatgccacagggagggagaagacctgccaggcaggggaacctcatgaggaacagtcctaggttcagcagacatggcagtgctggggtgaagagggcagcctggccagagcagagggcttgcaaagaaggtttaaaggagggcctgtgtgtattttggaggtcttttgaaaccacatgcaggtgtttaaatcaattcactatgattcaggaaaacattaaaggtttaaaatttgaacaaaagatgtttttaaggaagctacttttggctgggcgtggtggctcatgcctataatcccagcactctgggaggccaaggcggggtggatcacctgagatcaggagttcgagactagtctggccaacatggtgaaaccccatctctactagtaatacaaaaatgagctgggcgtggtgatgcaagcctgtaatctcagctatgcgagaggctgacgcaggagaattgcttgaatccaggaggcggaggttgcagtgagccaagatcatgccattgcactccaacctggacgacaagagcaaaactccgtctccacaaaaaaaaaaaaaaaaaagcaagctacttttgccagtaagattaaaggagtgtccagatttgctaacagcacttgtttatttttgaacagataaaagatgaagtatttgaagaaacagaaaaaaacttccgaatgcaagaaagattgattaagtcttttatccgagacctgtctctctacctccagcacatccgggtgagcatcaacatcactgtagttagattaacatacgatgtaattctgtcccctttcctgttcatcagtcatattgtttaatgaatgctgagtaatctggactcaaattactattatgccccatcatactttttgttgagatgccagtaggttatttaacagtaatagcatttagatcaatgttgtcacattcatttcaaagcagcccaactttttccaccctctttttggtcttcatcacccttcatcccacacacaccttatttttcttttacttattacagttcattttatcaaaaccagtttgaaaatcaaatattgaatgcaaaagctaggaagctgtaaacaggaaacgtaaacgagaaagaacaagcagtgaatacgagtaagagaatgttcctatgtggtatgctttctgatcacttcagctcccaatttattaatattcagttgctataataaggcctctaaaggtattagagccataaacagctttgagatctagagaagccaaggagatcaggtgagcctaggtctttccttgcctcaagcaatgcttcctccctgaggtcagaaccagcaccaccatcctttctattcttgtctctaatttctctattgatttaatataggatgctgtgagtgtactggatactcctgtccctctgatcttttagagacagagtctctttctctcacccagactggagtgcaatagtgccatcatagctcagtgcagtctccaagtcctgggctcaagcaatcctcccacctcagtggctgggaccacaggtgcacaccaccacacctggctaatttttttaagcagagatgaggtcttactatgttgcccaggctggtcttaaactggcctcccgaagtgctgggattacaggcatgagccaccatgtccagcctgaatatctgatcttataaaagaatttccttaaaagggatccttaacttttttaaaaaaaaagtttttaaactgaataaaatggtataaaatttaaaggtaccaaagggctaagtaaaaataattattcctcctaccttgtcaccttctgtagagacagtcaccatccattaagttcttccctcctatcagagatttcatgtgtgtgtaggtgggagatacactagcatcttgggtttcacacttaatcaaatttcagaagtgatgtagccatacacacagaggcccattgttcttttttcctttgagacagagtctcactctcgccaggctagagtgcagtggcagaatctcagctcactgcaacctccgcctcctgggttcaagtggttctcctgcctcagcctcccaagtagctgaggcgtacaccaccacgcccagctaatttttgtatttttaatagagacggggtgtcatcatgttggccaggatggtgtcgatctcttgacttcatgatccacccaccttggtcttccaaagtgttggaattacaggcgtgagccaccgcgcctggccttggtccattgttctttacaattgcgtagtatatcactgtggacaagtcataatatatttaactagtcccctgttggcagatatttaaatcgcttgtagttggaaaagattagaactagtcatacaaggaatatccttgtggatacatcattttctgatctatgtgagtctgtctgaaggccagtgtacttctgagccaaatcttgtggcagtataaattttgacaactaccgttaaatgtcagagatgttgtaaaggtgaaaagttccacaagcaatatcccttgctaactcagtgttatcaaaaccagtgggttttatctttgcctgcaagagaggtaaaaaatatttcaatatagtttaaattgtcatttcttatattaggaatggagttgagaatattcttatatgtctatatcattatatttttctgtgacttacctatattctggcatctttatcagtttgttgatctctgtatctattggaggatatagtcctttgtctgagatggtttgcagatgtcctccccctacctcagtttattgacttctgagtttgcttaaagtgttttctccgcttaagagtttaaacttgcattttatggcttcttagttttgtgtcatatgtagaaaggactttgctgttccaacatttaaaaattctcgtgttttagtatttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcgcagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggcgcccctcacctcccggacggggcggctggccgggcagggggctgacccccccacctccctcctggacggggcggctggccgggcagaggggctcttcacgtcccagtaggggcggccgggcagaggcgcccctcacctcccagatggggtggctggccgggcggggagctgacccccccacctccctcccggacggggcggctggccgggcagaggggctcctcacttcccagtaggggcggccgggcagaggcgcccctcacctcccggacggggcggctggccgggcagggggctgacccccccacctccctcccggacggggcggcagagacgctcctcacctcccagacggggtcgtggccgggcagaggcgctcctcacatcccagatggggcggcggggcagaggcgctccccacgtctcagacgatgggcggccgggcagagacgctcctcacttcctagatgtgatggcggccgggaagaggtgctcctcacttcccaggtgggatggcggccgggcagagacgctcctcactttccagactgggcagccaggcagaggggctcctcacatcccagacgatgggcggccaggcagagacactcctcacttcccagacggggtggcggccgggcagaggctgcaatctcggcactttgggagtccaaggcaggcggctgggaggtgtaggttgtagcgagccgagatcacgccactgcactccagcctgggcaccattgagcactgagtgaacgagactccgtctgcaatcccggcacctcgggaggccgaggctggcggatcactcgcggttaggggctggagaccggcctggccaacacagcgaaaccccgtctccaccaaaaccagtcaggcgtggtggcgcgtgcctgcaatcgcaggcactgggcaggctgaggcaggagaatcaggcagggaggttgcagtgagccgagatggcagcagtacagtccagctttggctccgcatgagagggagaccgtggaaagagagggagacggtggggagagggagagggggagggagagggggagagggagagggagttctagtacttttatcattccattttttaagattttaaaatctttttttaagttttaagattaaatcattgctctgtctggactttagtaaatcaggtttgaagcagggattcaactttatttttccagctggttacccagtggcctatcatttattgagtaaatagccaacttccacccttgtgttttaaaaatgtaactagggccgggcacagttgctcatgcctgtaatcccaacactttgggaggccgaggtgggcagatcagctgacgtcaggagtttgagaccaacctggccaacgtggtgaaaccctgtctctactaaaactacaaaaattagctgggcatgatggcaggcacctgtaatcccagctactcaggaggctgaggcaggagaattgcttgacgccgggaggtggaggttgcagtgagctgagatcatgccattgcactccaacctgggtgagagtgagactccatctcaagaaaaataaaacacacaattggggcagctactgagtatgtttctttgtcttgctgcttcataggactttcccctaatatccctctcatgctgatatccctctgttggccattttctccccaggttttctaaagtgtgacactatatacctgagccctcagcccttaaaaggctcacctccatagcagtgactgatacattttgggttgggatatatgtaatgttgaaaaccatctgatggaagtatcaatttagttctgactgctgacagaaattgagagaaaatgttgaatagttttgtcatgccacaaaatgaaaagcctgcccaataataaaattagattgactaacagcgagaaaaccagcaagaacataagctgagggccattggctggataatttggtatctacattggcatatgggctgatatttggggactttataacattcctttaaaagaaaacaagaggacatcacttttcacattagatctcccactcaagaggaattagcaacattccctgggttatcttactgacgaagccctggctttatatatacagatataaatattaaagacaaaaggtctaaaaatgatataaaaataaagcatcaaaccaatgtatgaggcactgatggttttgcttagggactttgcttaggaatgggaaaccaggttgtgatgatcagtagcatggcagggcagttgtctttgagacggtgacagcatgaaccaagacttgaggaaggagaggtaactggtcattatcctaatcctataggaatcatcttggttctaatttgataatttactttttgttaaattaagaatccctattagggacataggggaatgccaaagagatgataaaagccctcaacagttttttaagaattaaaagtcttagacttttctctttttgcccttgaaatagactaatggagtatttagtttgtttgggttacagcccagcattgtagagatggggtctcaccatgctggccaggctggtctcgaaagaaagcctggaaaaccaacctggagttcaaactcagtcactgtcaggaggagttgactatgtgatagtggagtcagcaaacaaaacagacaaaagtctctacctttgtggagctcgcatttttactaggagggtgggtgagggagatcatgacaataagcaagcattagtcaattctaatcatgtgagagagtatttttttgcaaagacaaaaaaaggaagcagcacagcaggagctattgggagtgccagggtcggatgggaaaccaggttttgaggatcagtaacatggcaggacagttgtctttgagatggcgacagcatgaaccaagacttgaggaaggagaggtgactggtcattatcgtaatcctataggaatcatcttggttctaatttgataatttgctttttggtaaattaagaaaccctattagggacataggggaatgctaaagagatgataaaagccctcaacagttttgttaagaattaaaagtcttagcctttctctgtgccccgtaagtcatagtttatgaaaatatgcttatttcaaagctaaaataccagactagttagaaaatttcaaattatggaactcatttttccaagactgctattcagtcttggaatgtatgacaaaagctggaaagttctgtctgttctgacttgtgtctgtcctaactggctccaggagtccgcatgtgtgaaagtggtggctgctgtgagcatgtgggatgtgtgcatggagagaggacaccgggacctggagcagtttgagagggtgcatcgctacatcagtgaccagctcttcacaaactttgtaagtaactttttcttcaaaagttggcccccttcccagggtcatctcaaatacatcagctcatgcaagtcagttccacggacacaggccctgggcaccaggcatattagtcatcctttagctatattcatattggggtttgatattcacaacatgactttcagttagttaaagggagatgtaggacctgtgtctgtacaaacaggttttttaaaaaatagcttgtgattaatttagtttcagaggacaaaggaaaactaggcaatgaactctgatcaaataaaagcaactataggaataataacttgaagagggtccaggcacagtggctcatgcctgtaatcctagcactttgagaggcagaggcaggcagatcccttgaggtcaggagttcaagaccagcctggccaaggtggtgaaaccctgccactactaaaaatacaaaaattagcagggcatggtggtgggcacctgtaatcccaggtactcaggaggccgaggctggagaatagcttgaacccaggaggaggaggttgcaatgaaccaagatagcaccactgtactccagcctgggcaacagagcaagactctgcctcaaaacaaaaacaaacaaacaaacaaaaaaaaaaccttgaagacaaatatttaggaatatagttaatatgttaccaaagagatttgagatggtaaaaactactttaagtccgggcatggtggctcacgcctctaatcccagcattttgggaggccgaggtgggcggatcacctgaggttgggagttgagaccagcctgaccaacatggagaaaccctgtctctactaaaaatacaaaattagccaggtgtggtggcgcacacctgtaatcccagctactcgggaggctgaggcaggagaattgcttgaacctggaaggtggaggtcatggtgagccgagatcatgccattgtactccagcctgggcaacaagagcgaaactctgtctcaaaaaaaaattgcttgaagtactgaagaccaaatttcttgagaaattctaaatccatatatatgggattgtttaatcccttgtagaaaaaactggatggggtttgatagttttgtagggatctataagtggcctgagggtgaaaaagacatgcccacctggggagctgacaggtgttctaattgtacattatttttaataagatgctactaagtactactaagtacctgtttatgttctttatgtattcattgccttacccttaatgtctgtgtgttagaaagaattaaagagaaaaatttataatttttgttttgagatggagtctcactctgtcacccaggctggagtgcagtggcacaatctctgctcactgcaacctctgcctcccaggttcaagcgattctcctgcctcagcctcccaaggagctgggactacaggcatgcaccaccatacctgcctaatttttgtatttttagtagagacggggttttgccaggctggtctcaaacttctgacctcaagtggtctgcccaccttggcctcccaaagtgctgggattatgggcatgagccaccgttcccaaccaagagaaaaattctttggaagataaaaatgggggctgtgtgcggtggctgactcctgtaatcccaacttcttgggaggctgaggctgcagtgagctgagattgcgccactgcactccagcctgggtgacagagcaagactccgtctcaaaaaaaaaaaaatgggtattacctagttatgattaaaggtttatgagtgtatgaaagttattccacctcagatttatgtaacaactaactctggagttaaattcaagctatgtagacatgtacacataataaatgttaccaggtaaacttcacggctggtttctaatgcacacatcatatcagtgtgcagcttagcatttatcacctcaaggaggtcaagtgagattagtgtattttacatactccttgatgtgggaattgaaggtatctagtgagaagtcttgtggagtatttaagtagaggctagtgatgggttagtagaatactgttgtagatctgtatgggtttagcttgtgtactagaaacgaagtaggtggttcaggacacaacaaagtcagccttaagagtgacttggataatcacaaatgtgggatgctgtccagctgagcaatgtgcctttctcgtccctacagaaggagaggacagagcggcttgtcatctcccccttaaatcagttactgagcatgtttacagggccccataagctggtacagaaacgctttgacaagctcctggacttctataactgtacagaacgggcagaaaagctaaaggacaagaagaccctggaggagctgcagtcggcccggaacaactatgaggccctgaatgcacagctgctggatgagctgcccaagttccaccagtacgcccagggcctcttcaccaactgtgtccacggctatgctgaagcccactgtgactttgtgcaccaggctctggagcaattaaagccactgctttcggtgagtttcttacctgttcagtgggatggtcatctatagcctttgcctggtatttttctgggaaaaatggtagcatggtttgaaaaattatctgaattagataaactgaatgtgtcgctagttcatccctcaggaaatcttaatcccttgatggtgtcatgaagcctgtggcttctgaaacatcttttccctcttgagcagttcccagaagagccagccaacctggcccgcaggcagtgccctggagaacttgtgtcttgcatcaggctgctgtgtcggtagctcagagaatgagctgcagctgaactttagcttccagtggttctaaggagactgtcaatccgggatctttcatcatgttttcttcttttctctgggatcttttatcgtgttttcttcttttctctatctctgctcttcccatggaccccagttactcaaagtggctggcagagagggaaaccttattgccatcttccacgaagagcacagcagagttctgcagcaactccaggtttttaccttcttcccggagtctcttccagctaccaagaagccatttgagaggaaaaccattgaccgccagtctgctcgaaagccactcctgggcctggtgagtagggaactgagagcagcagccccgcctcggggtaaagagggggaaccctgcagccaggcccccaggcccagatcccactattggagtttctgtatttcataataaatggagaatagtgttgcattctcacccatcatgggctcatgcattcgccatttttttttttgagacagagtctcatctcattctgttgccaggctggagtgcagtggtgtgatcttggctcactacaacctgcgccttctgggttcaagtgaattctcctgcttcagcctcccaagtagctgggactacaggcacacgccactacgcccagctaatttttctattttttagtagagatggggttttaccatgttggccagggtggtctcgatctcttgaccttgtgatctgtccgcctcagcctcccaaagtgctgggattacaggcatgagccaccatccccaggctttttttgtgggggggaggggattaacccagtattaattcattggttcattaattcaggaaactgatttaagggtatattaattctgccaggcctattttttatgatgtattcataaaagtaatacagctaaacagttaatggttggctgccttttttacctggagttagtcttttttaacctcagttcttccatattttaaaaattagcataaggcacaccagctagaggactgctgatacatctttgcttacaatatttttgccccatatgatcccatagacattaatttatattaccttaaaagggagaattatgattttttgagacagagccttgctctgtcacccaggctggaatgcagtggtctgatcttggctcactgcatcctccaccctcccaggttcaagtgattctcctgcctcagcctcttgagtagctgggattacaggcatgcgttaccatgcctgtattgtatttttagtagagacagggtttcgctatgttgaccagactggtctccaagtcctggcctcaagtgatctgcccaccttggcctcccaaagtgctgggattacaggtgtgagcaaccatgcccagcctgaatttattattaccttttttcttatgacttccttgctttcacaggtggggaagtcaagatagatgaacctaaccgagaatgtccctaacaaaatacaagaagacctactaatatcacttagatattttgattttttttaagtggcattttaatcacgtttgtcacaagaaaacaaatgtaagaataggtgtgtgttaaattttcttaactataaaggcatcaaacattgcctaagggctcttgatttttacctagccacatgggctggcttcatcacaaaaacatctgatgggagtgagatgggcagtgactgactgtccctgcctcatttctgagactggccacatgttgggatgaaatatggctgctggggtagtggccactgagagatttttgttaacgtcttacctttcagccaagttacatgctacagtcagaagaactccgggcctccctcctggccaggtatccccctgaaaaactcttccaggcagaacggaacttcaatgctgctcaagacttggatgtctcacttttggaaggtgacctggtgggtgtgattaagaaaaaagaccccatgggcagccagaaccgctggctgattgacaatggaggtaagaattttaagcagcagaggactgtaactggaaaaaaaaaatagtagttttggctgcacccgaatctggactaggccaggaaaaaaaagcaaaaagtatctttgattaaggggaaaaataacctgaaaaataaccttaaccttctctagagagtgaagatcattactgaaacaaaacctctttttgttttgacaaattccagaggagacaccgttgcttatcatgcaagctcttgccatatcttacagcacttacaggcaggaagtcctgcctcacggaatcctgttccttcttagcctgttcccagtatgccacaaaataagctgccctcttttcaaattttttttttttttttttttttttttttttgtggcagtcttgctctgttatccaggctggagtgcagtggcacaatcatagcttattactcctgggttcaagggatcctcctgtcctagctgggactacaggtatgccatcatgcccagctaattttttaataattttatagatattacgtcttgccatgttgtccaggctggtctccaacttctaggctcaagccgtcctcctgcctggacctcctaaaatgctgggattataggtgtgagccaccgcacccagcacctcttccagtttccatgaatttgtcttgtggaaattaaaaacctgtgggatttcatttgctttcttctccccatgacagttttacctcatgactatttagggaattactttaaaaacagcttacaacttttttggagggagagtgatttacagaatttaagtaagtgtacaagggataatactgatctgtaatccctttttccaaaatccaaaaagctctaaaaacacttttgccaaaacctgaatgaaggtgatgtgagactatttataattgtaacttatccttttggtgtgaatagtcatgtgtatgtatttttcatttttattattttttaagacagggtctagctctgtcacccaggctagagtgcagcagcacgatctcagctcactgcaacctctgccttcaagcgattctcctgcctcagcctcacaagtagcacgcaccaccacacctggctaactgtttgtattttttgtagagacggggtttcaccatgttgaccaggctggtctccaactcctaacctcaggtgttccatcccgccttgaccttccaaagtgccaggattacaagcatgagccacggcacctggccttatttttttttaaatgcttgattgcaatctgattcagccaagaggttgctcacatcatgggtggatgactacatctccaacatgaatgacacaaaaacatcagaactttcctatttgcaattatgtgagatactttaagttttagtttataactgacacatacttgttcatatctatggggtacggtgcgataattttgagatagggtctagctttgtcacccaggctggattgtaggggcacaatcttggctcactgcagcctccacctcccaggctcaagcaatcctcctgtctcggcctcctgagtagctgggaccagaggcatgcgtgaccatgcccagttaattttattttagtagagacagtctccctgtgttgcccaggctataaacttgtcatttctttgcagagatatcattcagaatccttggcttctagccatcttgaaatatacattatcattagctatagtaaccttactgtgcaatagaacaccagagcttatttctcctaactttgtacctgttgagcaacctctccccagactcacctccccttccaccacccccagcctctggtatctagcattctactctcaacctctatgagatcaacttgtctagattccacgtgaatgagattatatggtatttgtctttctgcgcctggctcatttcacttaacgtgtcctccaggttcaaccatgtggccgcaaatgacaggatctcattctgaatattcattaacagaattgattacggggtgctgaccctgctggggggttttacaaaatatgtagtatgggtacttgactaccttcccagaattaaaaagaatctgaattccaaaacatatctggccctaagcattttaggtagggattgtggtccctatctagacagacattatgtattcaccacccagaactgaaaaatgtcacatttcttggtttctttaaaagcatcttgtggattttttttctccccacttctgcttacacagaacgagagattaaaagtgggacacgaaggacagaggatggagcctgttagggtgacatcaggtgacagctactgctggggtcagagacagatggacctaaagtcccaagctgtttaagaaactgctccatccttcagtttttatctactcaaacttgagaagtggtagcaggaagccacagtattcagatcagctgtcaggtacaggaaatgcatcaaagatcaatagagtaatggccattgttctcatggaggctacatactctgggtctgtgccttgacagtgttatgaaaaattgtcacgtggatgctcacgcaatccctaatttatacttgagttttagctgaaagcccccttggtcatcttgggcaatttattaaagtgaaccatgtgcagtacacgttacgtgtatattctaacaaacagtttcctacgttagaacatccttccagtatatccagactctcagagcaaaggattcacgtgtcctggtgggaaagagggcagggaggtctatggaggggcttcttgagctgaggctttttttttgagacggagtttcgttcttgttgcccaggttggagtgcaatggcatggtcttggctcactgcaacatctggctcctgggttcaagcgattctcctgccttagcctcctgagtagctgggattacaggtgcgcaccaccacatccggctaatattttcgtatttttaatagagacggggcttcaccatgttggccaggctggttgtgaactcctgacctctggtgatctgccctcctcagccacccaaagtgcctggattacaggtatgagccactgtacccagtttgttttgttttgtttcaaatagagatgaagtctcgctgtgttgaccagggaactgggctcaagcaatcctctcatctcagcttcccaaagagctaggattacaggcgtgagctcccgtgcgctgccgaggctggttcttaactcggtcttttccacacttgctgtatttgaacataggcttcatcaagccttcctcttaggcatgatctcagtgtcctatgacattctcttcccatgccggttcccagacatggattgttttcattgctgtcttctcagttggccatgggcctcctgagcatgcatctgttgtgaggttgtgaacatgaatgaaccggcaggcagctgcggctcttcatctctacctacacacatcacatcctgggactgagtgttccaagccgctttgtcactaggcattttattttgtgtctctcactattggcctggcttttgagtttttgttttactcttcattttacagatgaataacctagatcagttttttttctctcaatgctccctctgtctgtccagccttctgctaagagttcttgtttatatttcctgtttcctttgtagtcaccaaaggcttcgtgtacagctctttcctaaagccctacaatcctcgccgcagccactccgatgcctccgtgggtagccactcctccacagagtctgagcacggcagctcctcccccaggttcccacgccagaacagcggcagcaccctgaccttcaaccccagcagcatggctgtatcctttacctcggggtcttgccagaagcagcctcaagatgcatctcctccgccaaaagaatgtgaccaaggaactctcagtgcatccctaaatccgagtaattcagagagtagtccttccagatgcccttcagacccagactccacctcccagccaaggtcaggggactctgcagatgtagctagagatgtaaagcaacccactgccacgccgaggagctaccggaacttcaggcatccagaaatagttggctactccgtaccaggacgaaatgggcaaagtcaagacctcgtcaaaggatgtgcaagaacagcccaggctccggaagacagaagtacagagccagatggcagtgaggcagaaggcaaccaggtgagtgcgtaagaggcctgccactgtggcacaggcggcagcagatgtgttgtgggtaccagcgggggtgaggcagaagtggcttgcctgaggcctaggggtgatctgagatgagctcacagacacacctttcaagcacacaaggaatctctgccatcagagccttctgagcaccttcccctgctgatacttcacaggctattcctggacccctctgtgtcactgggtgtttaaaaggtgctataatgacaacttcattattcttccagttcactaattcttcagttgtataacatccatttaatccacttgtttggtttttgattcaagtaaccatactttattttttttttgaggagtttgtcacccaggatggggaatgcatgatctcagctcactgcaacctccacctctcaagttcaagcaattctcatttctcatgcctcagcttcctgagtagctgggattacaggtgtacaccaacacacccagctaatttttgtattttcagtagagacagtcttcaccatgttggccaggctggtctggaactgctggcctcaagtgatccgcccacctcggcctcccaaagtgctgggattacaggcgtgagccattgtgcccagccccagtttttcctattctctttgtaatggcctgttcccgtttatgagtttgattgtaggctttgtatctcaaacgttttgggtttttttttttttttttgagacagagtcttgctctgtcgcccaggctggagtgcagtggcgcaatctcagctcactgcaacctccgcctcccaggttcaagcgattctcctgcctcagcttcctgagtagctgggactactttattagagacagggtttccctatgttggccaggatggtctcgatctcctgacctcgctgcctgccttggcctcccaatttgctgggattacaggcgtgagccacccacagctggccatatcttgaactaacctgtatgctttaaagccattttcagattcacagctgcagagtctttgctgcaccgtttgttgcctttgctcgctcttcagtggagcatcttcctgtgttgactgtcaggtttgtctgcgagctcatctccagaaggatttgccctcatgggaaggcccagtcgtgtcctgggttgtagaggtgctgcctctgccactgtctggattctaagagtccagtttttacccactttctcagttcaggcttcccatagcacattcctcagtgccatagccgagctttgtgcatgctcgtttttctggtgatttctcttactacctacttcccgggtcaaacatccccattctgggcctaccaagcagacagttattatagacacatcaaagggaaaagaaggacctttcttagattgagttcgagcagggaatgtagttgtagtctcagctccagtccctgaccaggtcctaaagctccagcccttggggcacgtgtccctccctctggcccccatgggcctcatggcttctcctcctccctgagctcctcccttccatgggcattagatcatgagatctttgtttgtggcatctaaagatcaacttttctttgaagttggttgtggttttctggtttttctttttcataatttgtgttggaggtatggaagagtatgctcgtcttccaccctttaaagcaattctaaaagactgaaaaggtagtttttttaaaatggagtcttgctctgttgcccaggctggagtgcagtggtgcaacctctgcctgctgggttcaggcaattctcctgccacaacctctggagtagctgggatcacaggtgttcaccatcatgcttatttttcgtgtttttggtagaaatggggtttcacaccatgttgaccagctggtctgaaactcctgacctctagtgatctgccctcagcctcccaaattggtgtttgttccaagacagagtctcactctgtcgcccagggtctggagtccagtggcgcgatcttggctcactgcaacctctgcatcctgggttggagcaattctcctgtctcagcctcgtgagtagctgggattagaagtgtgtgccaccacgcccggctaatttttgtatttttagtagaggtggggtttcaccatgttggccaggctggtcttaaattcccaacttcaggtgatccacccatctcagcctcccagagtgctgggattacaggcatgagccaccgtgcccggccaaattggtgttttcttttaatcatccctattatggtagccatcatccgtatgtacctatttaaatttattttagttaaaattaaataagattaaaaattcagttcctctgtctcactggccatatttcaggggctcagtagccacatgtgggcatgtggatgtggaaccctccccaacaccgcacgaagctgttggatggcattgctcccagcaatttcccattttctctctctccctcacacaggtctattttgctgtctacaccttcaaggcacgaaacccaaatgagctgagcgtgtcagccaatcagaaactcaagatcctcgagtttaaagatgttacaggaaatacagagtggtggttagctgaggttaacgggaagaagggctacgttccctccaattatatccgcaaaaccgagtacacctgagcccacgttgcctgccacccagccttgctgcctttgctttcagtccgccgagggttctggcggcccaccgagagggcgcctgctcctgagacacaggccctgtctgcgttgcttaaccatggcatggtggagcacaccacagatcttgttctcctcgattgggttgtaaaccttgatgctcactagaatctctagaatttgaaatggaccctggggctttgcaaatgacttagtgactatgagaagagagacaagtcttagagctggcttttggaaaggagaaacttgcagtcagaagcccagtgtcctatgtatgcaggaagctgtgctctagcaatagacagtgttggtaatggttgtgctgtacggcgtttggggtggccccatgttccatgctcagctgaccggatgccaactcagatgaaaagaattcatggctctgggcaccccgtgaggcagtgcttgcacatggctgggagtttgtcgggattgaaccaaacctagtgcttcaaagctcctgggacacctccagtgtccagcacacattctcatacatactgcccctaatttctaaagtccctaaagcactacattctgtaaccttgtttcttttactccattcccagattagttatgcaaaattcaactgcgttctacttttagaagtgtttagggtctttattttctgttgacccttcatctgaaagattctcttcccttgttaggtacaatcactgcccccccgcttttttttttgagatggggtcttgctatgttgcccaggctggtcttaaacgcctgggctcaagcaaccctcccgcctccctgctgagattacaggtgtaagccaccataccgcaacctcaatgacacctttctgatggtctttacacagtctgtgatgtctggtggcccccctgccctggactcaataattgatagattttcctagagtaacagtatgagagctccagccattccattaaaagtattagttctgctttgagctgaaaccagttgagcctaatggaagactggatgtctttcttcttcatccaagcaccctaatgactgtttagttacatccatagatgcagacaacataacacctgtgacttacttgaattgggataagccattccagaagtagcttatcctagacttggaaataagatttttttcaccactaacttccatgcttcagagatgacattcaaagccagattcccaagtgcctgatcatacctcccagtctcaggaagatatttgcttaccccttagaccaagaatcttaagatcttccccagctatgaagcctatcttggaatgggaaaccatgaaatttgtcttttaaaagaaagggaagaaatagccttacagcccctgttcctccaagtgcacatttagccttaaaatcctgggagtcgggagacaccgtggagtcctaacatccacagtgtctgctggtcgtggtcagaaggcagtaatgcaagagtccttttgtgaagagtgtttctatgtagagatgtttatatttaagtagttcttttataaataaaagcatttctaatgg

SEQ ID NO: 37805 - DNA, 139932 bp, Homo sapiens
gcaggcttcttcggtgcccgagagggagcgggtgcccaagggggtggtccctgtggcaggtcccggggtgggggcgcggcgctccgggaagagccttccgcaggtccccgccccgtcacgtgggcgccggccccggccgctgcggtcggtccgctggttggtcgggcgcttggtccggcagttggtcggtgggccagtggcccgtcgctcgcttctgggctctcatgtttgaaggtgggagggacacgggagcggcccgcacacctgagccgcccggagaggagcctcggccccgtacccaggtcagtgggctctccccacaccccgggcttgccgcgcggtcggggttgggatccccgtcgggagcattacctagggagtggagcgcccccagagctacgaaccacggggacgtgtgggtcagtgtctctgtgagccccggagcgtgtcccaggctcgaggacggggacccttctccaactccactggccagaagcctgggaggagggcagaactcctgtgggttggctgcgaatctccacccaaccctgcctgggatccgcggacagtccgcactcctgcaggtgccagcgtggccctggagatgcgcagggaggtggggtccctgagttctgtgcggcgcgtcccagccctgctcagcccggggagcagcggcgtggactagggagcctaaggaggttgcggaagctttaggtctgtcagcccaggcaattctctggtggacacagcgtgtgtctagatgcagggcctcggctaaagccagttctgtagtgtaagtgcaaaaatacagcacactttttaaaatctaaagccgccgcgtcccagtagactgcaggatggggacggtcctatttaaaagtgggctccctcctcacctcatcacatcagattccagacccgcagtttttcctcggatgaaaataagattatgtaacaagagaacagaacttccagcgtttggataggattaagacaggcattcttgccagtgtttaatcttcttaaaaaacgaatctaattatatttttacttttagagcagccagatatttggtatagatccgtgtcccttttctatattttggtctacttcctgtctttctcttcgtctctctcctttctcaacccctccttaattgattgtaatacaaatctgaagtgttttcaaatttgtagtgtattatgtgaagttaaatggtcaactacagaaaagtagttggttttcgacataattcatcttcagcatattcagtctttcattattataggtgtatggaaagctgtaagtgttatctaatttagaaattatttctctttggcttaagagaggcaacccatttgtactttgcttaaattcatagctaaataaatttgaagtgggagatggggatgattgatgaggttttcactgattgcatttatccatgttttatttaacatatttcaattattagtaatactattttaagatttggtgatgtgacagttgttagcttattgctactggagagataagctgcttaccatgatgccttctttactgggtagctaagggagatgcgctttgactttaaaagagtaagtggaatgagatcaatgacatgaaggcggtaggaacaaagttatgggaattcctgtctttcatctgagcagggaaatctgggataattttaagaaagggtgatgtgatggacctcaaaggatccctcctggggtttttgaggcagagaagggtagagtgtggcctgggctgtgacaactgtgtgggcaggcaggcatggactcaccatgagaagtggccagtggtccagcttggctcttatgtcaagtgctagtcaggaaagctggtgacaaggctggaaaatagtcccagctgtccagtacagaagtctggacttggtctgaaggcacagcaggggactgactgatggttctgtgaacttctcaaagtcaaagaccttggtccttgaccctcccaattcctagcctgatacagagaaaatccagtaaatatttgtggagtgcatggtctgacaacactgtagagcagagcttctcaaagttgagaatcctgtggggatcttgttcaaatgcaaattatgattccataggtcaggggtgggacttgacattctgtgtttctaacagattcccaggagcttgctgatcatttccctatgtgtagcaaggatttagagtagcagtttgcaaacctggctatgcctcataatcgcctggggagttttgtaaaacgttcagattaagtagtctgggatgtttttaccaagttcccccaggtgattctgttgacaaacccgaaggcaactgctgcaatggcaaagttctgggagtgtggtgggaagcaaactccaagggaaaaagacagtgggggcggcgaggccggataggaaaccgggaggctgatccagggtcaaagggatgaggccttattttgggcctgagagagtgatgaggtggggacaggtagggagacttcggagagatagaatctgtaggacagaggactagggaatgggacagtctctagactgattagatgcaatgagaagtgaggagggagaaacaatgctgggaagattcagctttgggcctgaggaatggtatggcctttagactgtaatgtttaaggtaaagtttatgaaaggttcttgtattggttcgaaccccgagagcctgccaacagacaacatgaggcggtgtggggcaacgtgctgttttaacgagcgcctgggtgcaggtgggctgaggcctaaaatggcgtcagcaccaagtgaggacgaggcaggggttttatagtttcctgtaaacaagaagtgtctcagtctgatgtaacttctgcacagtacccagacggcccctctctctgtcttcaaggggtacgtgtcttccagccagggtaggtgtcttctggccggctgtcttcctgcttctgctgtcttgctgatgcacactgctggcgcaactggccttgcaccttgggactgggcctgagaagggaggagttactcatctcttcaagctttcagaccccggggagaatctttcattcctgtctatttggttatagtaaaaagggaaaaggggtgactttctcaataactacttcaggcgtgacttaggggtggtgtgggctccttggaaaaagaaaaacttaatttttagggtattcttgagagatgtgttggtatccatcgtgtcgttgtagcaggagcatagtctgaattgtctggtggctaactgtagtttcaataagagttttagtggcttttattattagtgggataacacaggggagaaaaagtgatgaagattactgtccctaccagggttttaaatcctcctaaattagagaactgttgtccggctgctagagtgagagctcgagtgagggtgatgagttcagctttttgggaggtggtgcctgggaggagcagattggcttcaatagtgtggggtctttaagggtaatgtggacaggggtgtggtgttttgcaactgagggtgtggaaatatccctaacagcggggttaactacagataggggtaaggaaaggttgcatgttttagggtgggaggttggaggagcagaagaaagctagaagcctcggaggggtctgggttgatgcgttgggtactacggggaatgtggaagtggagagtagtgtggagttttgaaaggatgtccctgcctaggagcagagttgggaatgagaccaggtttggggtgaaaaagtgagtgaaggaaaaggtgtgcaggaagcagaaaagtggaggggtggctcggggttaggagacttgtccatcaattcccacaacagagacttaggaggactgggtgggtcctgaaaaattaggtaaagcagagtaggtcacccatgttgattaaaaccatcagggttacccttggctcggatgaagtgatggtagttgccggggcatccattccagggcaccatcagtcttcagcggcaaggcaaatgagatccgagtaggaggttttggcctgctcatgaagggatggggggcggtccctgcaggggccgctcatagtccgacttccagtggggtcctccgcagagggggcacggcctggtgggcttacctgggtatgggcattgtctggaccagtggctttcattgccgtacttgaaacaggcgccaggtggaggtggattgctaggaggcttctgtgtggagctgtggccccgtgggcctgcagggcccctgatggcggaggcaggcatttgaaactctgcctgtttttgccttttactttcctcatcatgattgttaaagactttgaaggctaaattaagaaggtcttgttgtggggtttgagggccgtcgtcaagcttctgaagcttgcaccgaatatcgggaatggattgggagatgaaccgaaggtttaagatagtggttccttctgggttggctgggtctaggttggtatattttctcatggcttcagttacatgagagagaaaaagggctgggtttttgtcaggactttgggtgatttctggaagtttttcatagtttaccactttatgggcaccctttttgagttctgcaaggaaacacataatcgtgtggtctcgatggcagcatctagaggccctgtcttgataatctcagtgggagtcctggttggggactgcctctgcaccagtaggcttggcaggagcttgttgatgaattgtgtcagcatgcacctgagctagggtccagacacagtcctggtcttctggggtgagggtggaagaggggataacgtagaggtcatgccaagttagttcataagactgggtaaggtactgaaactccctgatataagaggtagggtcgtctggaaatgaaccgagtcttttgttaatttgagagagatcagtgagggagaagggaacatgaactcttaacaataccttcagctcttgctacttcccaaaggggacactctagcactggcgctgaagtgagggtggggcatgagccaaagatggcgctcgagcgagtatgggcgggagagaaggaagaagtcagaagtcgttcctgctgagggtttgaaggggaaagggggtttgagttgataagcagtggaggacagataggggcgtaaggtggcgggatgggtttacaggcttcaggagagggcagtgaggaaggagaatgagtacaggcagtgctagagttgtcctcaggagaggacagtgtaggaaaagaagtgggtactgctgactgggaagatggtggctgggaagatggcagctgagaagatggcgactgggaagatggcagctgagaagattgcggctgagaagataaagaggaggcttgcggggttaaagaagatggttgagagggagaggtagagtctgggaggaatggacagcagtctgctggatctaacggggaaaaagaggtatggtcgggaggagaaaggcgatcagggctgcgagaatggaggagaaggatttgaacaggtgagcaagaattgcagaggtcgggttgtgatctgagtgccaaaaggcctggaaataaggaatttcttcctatttcttcggtcgttggcaatacttgcttaaatcagttaaaactgtaaagtcgaatgtttcatttgccggccatttggaccgttatctaatttgtactgtggccagactgaattgcaaaaaaagaaaaggcgcttagggcggatatcttgcctgaggcctaaggtttgcaggttttttatgaggcagcctagagggctgttttttagaatggagggccgggagtttcccataatgaagggtaggcacaggagaacagggaaaaaggagacagtcctggacagccggacggagacgataaaaggagcgatcgtcaccactgcctttttcattcctggaacgggatcaaatggcttagaggtgtccccctaagaccagatgatcagcgagtgcctggcacacgctggagcctttttggaccaacgttggattttcggaccagagaaaccaaaagaggccgagcacgtttttccctgttaaccaggttcccggggaagcttaccagtaggtgagatcagtgactgatctgcatgcacagagaggcgactggaggctaaggagcttcctttgtccagctgctgtggcctgctttccagcatagaggggtaggtccacgggggacacagacccgagcctctcccaggtttcggcaccagatgaaaagttcttgtattggttcaaaccctgagagcgctccaacagacaacacgaggcggtatggcgcaacatgctgttttaatgagcgcctgggtgcaggcaggctgaggcctaaaatggcatcagcaccaaatgaggacagggcaggggttttacagtctcctgtaaacaagaagtgtctcagtttgaggtagctgctacgtggtacccagacggcctcccttttggttttcagggggtacgtgtcttccggttggggtgggtattttccggctggctcttttcctgcttttgctgttttgccgacgcacgctgctagcacaactggccttgcaccttgggactgggcctgagaagagaggagttactcatctcttcaacctttcagaccccagggagaatttttcagtttagaagtggttttttacttggccataagattttttttttttttttcctgaaatgcaaatctgttcatgatgctgtcgtgtttgaaatcctctggtggatatcctaatgcaaaatataagaaggaagcactaatataaacacaactgataacacttgttccattctacagcctgttcatccccattcaagatgtgacattcagtccccatttggtgtgggcacaactaggctgaaacttttggcagctttgtttattcctgagtcactattttccctgcgtccttcttcttcagaggagctccacctcccttggactttatgtttcttagtatcattttttggttccaatgcttgatggcacctatgtgtctctgtcttcatggaatctatgtagttctaggaaaggtgggctttatcctttatacacccttaaagccaagtcttgtttgactgtggatcttcacaagcttcattcttatctctcactcatctggtaaataagcctctaaaagaggctgtcctagaataatctgtttagctttaggcccagatctccttagtgcctcaagttccaggggactgctgactccgagctttgtcttcagcaaatgtatgatttctgtttgccttaaggtcgttggcttggttctccctggttattcttactttcacttcctctctctgtcatgttcatatgtacacatttatgcacactgaaagctgagcattcattgtgcttgatgcttttaatcaccctgttctatgttgcatagtaatcatgatccctaacatacctgtagatgggaggcctagacacagaaggaataggactgtctctctgataggataaaatacaccatccttgtatggcattcaaatctctacagtggtgggccctactttagctctccagctgcctctccactgttccccaaactgagaagctgagtaatttctattcttttgtgcctatctgcatttgcatacactattttatcttcctggaaagcccttttgtctctattctgcaagattattaatccttcaggatatagatcaaattcttaaagctcccttgcccctaagtcgtttttactcttctgttacatacatatcacatcaaacaaagatctgctatgctatttcatcactttatgtctatgtctctgtccatattcctccaaactctgagctgctttagggctgtatcagctcttgtgcgtggccccacacttagcagatgtccaggaggagtctgtggtagatatgggccttaagctggctggctttgcaatgtttacctcagtaaagagggaaaggggctggttatttcgtatggtagacgagagaaggaagaggagcagaagctgaaagactgggaggaaggacaggcccagtgaagagtgggcccatatggctagagtcagggggttgggtggacactgggagaggtgaagatggagtcccaggctgggaagagatcatggaaggccttgaaagttggagctatataatttaaattttattctgatgacattaaagtttccatactcaagtatggaaaagacgtggtaaaactgttcaggatgattgtggctgggaagggcaggttggagggacagggaggaacttcttatgagcacaggctgttagaataacccactgaggtagctcaggacctaaatcaaggcaatggcagtaggaatagagagaagggagcagaggcaagtgaccatgccaagaaatccggcaggatttggtgactgattgtatttgagggaaagagaaaagcgtcaaactggatactgacgtgtgttagtttgctgggagaagaatgaggcaactgttagtagcatgaaagcatggaggaacttagtggaagggggaagggaaatgaaagtggttgattcttttggaatcagaagggagcctcgggtagtttcttgcttgccctttatatgtttacccataagaggatggtgaagcccagagaaacctacccaagatcacttagctcttgattgtagaacccaggtctactggcattatggcctgggcttctatcttctgtagcacatgagtttagccagaggagagctgccagaaggtcgagatggagattccattaggcaatgaaaaatgggaatgagaccaggtttggggtgaattcagcctgcagaacagctaaggctggagtcttataggtcaagcacccagatgggaaatgtctgctagttgccaatgccatgggggcccgaaggctcatgaggcctcctttttgccctgtggcctagctgtatgtggggctgatgggagatatgaagtacttttagggtatcagcgctcttatacttattatgctcaatgtgggcacgtgtattaattttcttctgggaatgtaaccaccaatcaatttatcaattccatgggaagttgtattccaaggcccaaacacctcctctacccagacttcagggcacatccagccagttcatgagaagttgcctcttatagtgttggagtggggatgggggtacagggaacagctagctagggaaggcaaccagccatgaggacctcatccaagcagggtccggtgtagagtcaggatcggggactcagatggctggatgagggctacagctgtccgatgaggagtgaggatcttatctggaatctgcactgctgtcgggagactcagtggccctgaggctggagttcttcaatcctcctcacccctcccttccacacacctttgcccagccaggctcctcagcctccagcctcccaggatggagtcttgtctttgtcatggacgctgacacagtggtcacttctgtttcttgaggaagagccaggtttatgaatgtgaaacatttgaattattgtctgagttgtggtagttgccaaataaaaacatatacacaaagaatactgggagccaacgttgaaggaaaacttgtcaaacttccctttctcttttgagctttgtagtggggtcttgccagtttatacctcatcttgttctgaaggttttttgtttctgtttttcatattaaggccaaaatatgtgcacgagcctgctcacccatggtaaagtgtcagggacagccacaaattgcacagattacagacgtagatttgcacttcccatttcttaggaagtaggtgggtggaggaaccactaatgcatctccaggaagggatttgttagctcaagggaggctatggggactagatcctacattgcctcttcccaggcttatggtcgctgtggtgttcccaggtggctctgcttcaggtatgtctctttcctcctgggaatagggaaggaggtgatccagatctcaggatttctctgcctgcttagggatgccagtgaggtgtgtttagtggggatactcttgtccctgccctccagggtaaagttacacttccacagtaacttgtgtgcatggttgaaatgcagccatcacatgcagctgggcctctcactctgacctggagggccactcctgtgactgcactgattatcccaagaggccttcttagcaaacttctccaagttgcttctggcgaaaggttcagagaactctgccaaaaggaactacttggttgacaactctgtgtgtgtgtctgtgtgtgtctgtgcgtgtgtgtgtgtgagagagagagagagagttgtgtaggaatcaagaggtttgtaatagggacaagggggacagagagggggtagagccacagctcaagcttaggaagatcaaaaatgggttacctctttcttgcctgcttaggcaagaaagcctctatcttcaggggcaacagtttccttctcccaacacacaagtccatgttccctccaaatcaaagaggtttttacacaaataactagctcaatgctggactgcttcatggaggcagtggaggtgtagactggccccacagaaagtttcttccacaggaaaggatagagcagaacttccaactttggtggatttgacaaatggcttgtttcatgaggtcagggtagtgttattcccattttatgggaaacaggtgccagagaagtaaagacacttttgaaggttccagagtattagatttaatgtaatttattgtccgaactgaacacttttgaaagtgaaagtaggcacataaatgctaaactgggtggggactggggaagatcaggatcaggcacattgggatgtgtggtttcaaattcagtgttcaaaactccaaattctatgagcaatgggggcagaaaagggaaggggtggggtgggagagtggattggcctgagggggtggagatcgatttgggataggaatagcagattcttctaattcaacatttcaccaaggcagaggaatagttcttgactctgacacctgaccttgactggatgtcatgaaaaagtttcattacataagctcttcctgcgaccaaccagccaagacatctggttcttggatgcatgtgctcacctggtaacaacaacagccttgtgtgtctgtctgggttttcactgtgcctgctcactggtgcggcacaatgccccgggcagggattattgttctgcttgtggaaatgaggaagctgactcctcttgcctgtcctgccccctcattctatcatggcaggcaggaggttttctccagcatgaggacttggcctccctaactcctgtgggccctggtagctctagagtggagggtttgaatcagacagtcctcgattaaaatagctctacaccaattcgctattgctccgtacctctttgagctttacattcctcatctgtttaatgggaacaataataggccaattcatttggtggttgtgaaaattaaatgagatgaaatgttgactccagtgcttggcacatcataggtagtcagtaaatccttttattcccgtctcaggaagcttgagagaaatcatttatcaagagatatttagatcatccagagggcttatcctgaaatttcaggtgggaagttgcatgctctgggcttccaggtatgacacagaaagggcaaccatggtggcggtgagcagaaattccaggaggcagaagtccatgacaaggtagagaacagcccggaatcaggtggctggtcacccacgtacaggacaaaagcagcaaacagcgcagagtccaaaccagctggatgagatgtggcagggttaagtgcaaagtcctgcccttaggccctgaaaatcaattgtgtgagtgtcctacccatctatgtggaaaagcccaatacattggcttagcctggctacattaattgaagtcctgggtttagaccttggtagaggatcttttccctgcattggctgagactggccacacctggagtgtgcaaagccggtatccctgtcttacaagctttggaggggcccaaggacagtcaggaagatataggggaatgactgctattttcaggtgggcaaggtgggcagcatgttctttgttgctcagagggcagagatgaaggcctatggtagtgatgtcaaagaaaactaaagacggagcagattctactttgacataatgtaagaaattttaaagaactcaggcttgtctctagggccaaaccgctgttttagagcagatattggagtctacctgcaaagggtattgttcaagcagtattgactagagaggagtttatgaaataacagggaggaaggtatactgaaaggttatagatctaactaaagtgctgtaagattttggcaaagggaaggctttgtggatcaaccaactggggtgggatcctggggagctgggaagaaaaggctctctggggatccctggtcagtcaagtgagtaaaaggcatagaagcccaagtgagtgaagtgggatcgagaaataataaggaaaccagcttagctagactcttcccattattaaaagtcaaagaaagaagttgggactctaagggaaaaggaacttgaatgccaaactaagaagctggactttaccctgtcggtagtggggaataattggtggcttctgagcagaaatgacttgcagcagatgtaggctggagtgagggtgggaggctggggaaagagcagccttaaagctgtgcagaagcggccgggtgcggtggctcacgcctgtaatcccagcactttgggaggccgagggtgggcagatcacgaggtcaggagattgagaccatcctggctaacacggtgaaaccccatctctactaaaatacaaaaaattagcccggcgtgactatgcggaagcttctctatcccaagtcgcaggctgaacatcccacttagtgacaagggctgggagaggggaaaggctctgagcaaatgtctttgtgggctgaaaatgagactatgatcccaagaagtgactggactgtgtatattctttgctgatgcctaccttggcccaaccatctgaaagctgttttagactcacttgccaccccttgaagattttgagaacacaccatcctgagacctggagaaccagggtatgtggtgtgagacagctgggttcacagcatcctagagggcatagcaggtatagaagggagtgatccaggaggacactggtcacaagaatgtcctcctggatcactcccttctatacctaccataccctaggaagtctgactgtctgcaccttgggccatagagtgagcaaggttccatccctgggaggggaggcaaggaagggatgtgggtaccagggcctcattcaagtaggctgaggttttgggtggggtgtggtgtatgggaggagagagttgctgtggttaggcaacgtggatgtctgagcagtgtgatatcttggtctgggtggcagggaaggagtctggcaagaatggtaggaagagtggccatggaaccccaaggtcagaactggcccattggatctggggaaacctaccctttagcagcagaggtagagcatacttctcaggtactgtggaatcagtaggattgtgacagtatttattatttcagcctctaaataatttttgaaccattgtctatgctgagaatggtgatgatgggaccacaagatgaacagacatgtcccctgactgaatggaacttaagaaatgtacccccttactcaaacagatagtagtaactgctgagaaaatacagttaatattcagagaaagatgttgggggggcctggcttgctgaggaggtggcatttgaggtgtgtcctgaaggaaagacagggaccagagttgcccgtttctatggggctgaagggaattgctggcagagggaacagcagtgcacaaaggaaggcatgagtaatgccaattaaggggcacctgtggaaaacaactggcggcatgatttggctggaactgaagagtaaacgaagttaaatagggcaccagggattggaaattaccgtctatgaagtacccatcatgcatcaggcattgagcacagagtctgtgctcacttaaatttcaaagcagcctttcagggctttaactgaggaggaaatgggcttcaagaagatacctgatcatctcaagtttccctaggtggtgagtggccaaaataaaattgatgtccaggctgcctgaccccaaactctgttctttccacttaatcttgccactatgtttagagtccagattatgcagtcttaaatttacagtgaagacctgttcttaccgtatttaggcaggaagatggtcagatggcacatggcaaaccacattaacctttgagaggcacttagtggacatggccagatagtcacaaagcatatctgagttctaatacatatatatgcatgcatacacatatatatttaggaagttaatctctaacttcctaaatgcagttttcacattacaatagaaactgttactcccagaccactataggcaatttctgaattgctggctgaattccagtattttctcatcccttcaataaagtatattagaatggggcaagataagcctgaatcttctctaatttatacaaaaagcttctatcattagtaacaagttacctacaaccaaccttacctgtttaggataccaaggtgtcagccctaagagatgtttagcaagagtggtactccaagaggtttggaagcgtgggatgagggtaagagtcagagaaatgtgggcagtaacccaggtggggctgtaggggttgagaggagggaccgatacagttcagtaagcatttgctgagagcctgcccatgcaggggtgtagagtgggtgctgggatacctgcatgaaaggacaacattgttttcacagatcacatgttcaagctctgagcaggtgggtgttggtgaggactgcctgctcaagttggggttcttatgcgtatatctagtacagtcagccagtctttgttgctgagcaggtctgcccagggcccagttctccatccagtttggccttcctcctggagctcagaactcagatctagccctggtggccacgccttgcttctgtcctcagggtggacccagggtccttcagacttcctaatgggaggcttttcctcagcctggagagaaaagttgagaccacctgcgaggcaatagtaaccactgagaagacagaggaaatattcagaggaagaagttgggggagcatctgggctgcagtgacgcaggatttcatgttaacaggagacaatgtgggaggaagctctacctccttgtcctaccacttaataaggtacactgtgagaacccgttaaaggctcttccagggtcacaaatccagtcctcaaatgttatgatttatatttaaaagagaattttagataagccaagtgacagctgaatgggaaatggagttaatgagacagatcttatcggctccatgaaaaatgcatctcattacatcactgttacacatcgtatatggaaaccttccctcagtaattcctggagtgattgcctgtctggctatcggtgtccccaaagagtgtggtgtccactgagaataaccgggaggcctttctcagataccagtacggctcagccatcttctctcaaggccatctctagagttattatgggctctcttgatgccagtgcatggagccagggactgctgcaccgaggacaaagccagccagccatgaacgtggtcaagacttggcccttcccctccctaaccctacagagcccagttcagctttagcctccatgtttgaggcctcccaaaatccatttccccagcggtgtcttctctgtcaggtacctgcccctgggatggcccctgagcctcataactcggcctgttcactgttcctaagcaggtcaccttgtgaccctcgtggaatggctgaggaaggaaccgaggggctgtaagagtggccgtgtgatccctaggaaaccttcagctctggaaggccctgtggccctaaccttgccctgttttgtcaggtactgctagagagacgcagaaaacctggagcatgtgtgctgtttgagctgctgtatcccagggtctgccactttgggggctacctgcaagagatttggcaacttctcaaaggaactcaacatcatggttgttgtttttttaaccctgatcccaacatttaggccctgatgaagggtcttggccaaatccatcttctggaatagtacagttgggaacatgttctctgatgtggagaggcagagtgttacatacttactgggccaggcactgaggtgggtagtttattctgtcctctttcttaaccctctgactaaccctgtgtaaggcagatattatatccattacatagtaacctgagaggttaatgtccatattacccaaggcaaaaaacgaatccagctcataagtagtggagcaaggatttaagcccaaatctgtctgactttgctatggtctgaatgtttatgtctcctaaaaattcatatgttgcaatataatccccaaagtgatggtattaggaggtggggccttgggaggtgattaggtcatgagagtggagccctcatgcttgagattggttcctttataaagaggccccagagaactagctggtttcttccaccatgtgaggacatagctggaaggcaccatctgtgaaccaagaagcaatcctgctccagacactgactctgctggtgccttgatcctgggcttcccagcctccatagctgtgagaaatacatttccattgtttgtgagctaccttcccaatttatggtaattttgttaaaacagcctggacagactaagacaaagcttgggctctttctgctgcatgctgctcctctctttcttcaggggaagaagcacctcacttgggaagaaaggagcctcagaaggcttgaggctgggggtatggggacccagcgtctatactaccccttctgtggccatttggagtcacatagacctctgtaattttcactttttcctttgattctgaggaactgtttgggtatcttctataggggaataaagactctgctttatggaaaggaagagctgagaaagatgggagagaggtcccaggagatcattagaccttcccactcccctggagtccagctaacaaacttccaggagcaaaaccacttgggcctgcagggaaggggctacctagtacagtgtcattctccagcaggcctgtctttggcctgcaggaacacttgtgcaagtgggggattcctagatcacttttcttgggaaagtccctaaaccactttctggcctctgaactcttaggggagggaagtgatccaagtggcaaatatcttgtgactggcaagccaaggttagggaccaacccttcccctgcctccccacatgctggagcttttgaactgagttgaagatagctgggcccagggctcttggcccttgaatgcagcttgacatctggtcaggctgcaggatcttagggtttcctctttgtagcatcctaaaatctggcctcactaaatggtctcggtccagaggtgggattcgacttagagctgacttacaaagaatacagataaaggaatattgggaactgtgcttaccttgatgtggtttaaggtctgaggatgtgaagaaagtctctcctggattaagagggaaggggaacaccagtgggtcaggatagaggccgacagccctggagaggaggctgccttcttcccataactttcccagctgcgtgtgtaggatcaaatgggggtgtgtgttagtttgcttgggctgccataacaaagtactggggggcttacacaacagaaatttattttctcacaattatggaggccagaactctaagatcagggtgttggcagggttggtttcttttggggcctctccttgacttttatttattttttattaattttttttttctttttggagatggagtctcactgtgttgcccatgctggagcgcagtggcacgatcttggctcacagcatcctccacctcctgggttcaagtgaatctcctgcttcaacctcctgaggagctgggattataggcatgtactaccacacttggctagtttttgtgtgtgtgtttttagtagagatggggtttcaccatgttgtccaggctggtcttgaactcttggcctcaagtgatccactcacctcggcctcccaaagtgctgggattataggcattagccaccatgcccagcctctccttgacttttagatggctgtcttctccctttgtcttcacatggtctttcctctgtacccatgtgtcctaatctgctctgcttttaagtacaccacctattggattagggcccaccctaattatctcattggaatgtaattacctctttcaagaccttatttccaaatatagtcacattctgaggtactgggggttaggacttcaacataagaattttgagggtgtgggtacaattcagctcataacagggtgtttccaaaatcctcattgaacaaggctcagtgtcatggtgaagcatggagaggcacttactactgatcctgccaaccttgggaccaggagaggatggtggacccagctagctagtggaggaagcctgactggcctcgtccaaaggctcagctccaggccgagctgtttacttgtagtcaggctctctggcagcagtagtttctgtgcagtgtcttcatctggctcccgtgtggccctcggaactccagtgaacacagagctgctaataccctccagcccaggccttcgggggaagcctccttctcctctgatggaggcagaggccaggctgttgttgacagtgcacacaggcctgtctttaaagaaattctttggtcttctactgacttaactttttttattgcaaggggaaaagcattgcattgaatcaaaattaaactgttcaacaaatgttgaaatgaaggctcaaattacagaatacattttgattaattcaattagtgtttacctccagcctgccaaattctggggcctattcctcagcaggcagccagggaggctcgtaggagggagttggctataggcaaaagttacgcacgctccagctaatagagaaaacttaccaattcatatctgtttttttttgttgttgttgcttagcattctaaaataatggaatagggagaagtgcctggttttattatctattaggggaagtgacatccttttttctcattggtccttcaggaatacaattgcatccatcagttatgtctctcactcatgccaggcccaagcgtaagttccccttatggtagagacgctttcacctctgaatatctggctgtaagagagaagggaccccaggtgtggagaaagttcgatgagagaggctgtcatggatagcccccaatccttctttcagagtgctggccaaggttacatgcccagcctcccttcactttccactcaggtacacaaacacttaacattttgtgtcaacaaacatttactgaaggtcctgtgccaggttctttgctgggctctgaggatagaaaggtgaatggagcatactccttgctctctagcagttaatctagacagggaggcagacacattgagaaataatacaaattattatcatcttcataaataatatagacagctctgacgataaaggtgtgtaccagatatgacaggagcagagctgaggcatccagcaccttcagggatgaggggtaatggtgttaggaaaggttttctggcagtggtcatttggataaggccttagcatgggtgggatttgaaagtagagatggagaaaagcacccacgtagaggaagtacagaaaatggggtatttctgtatgcgagggtaggacgtggtccagtgaagctggaactcagagtggtgaggactatagcggggaaggttaactgtattagaggactttggcagagctgcaaaatgcagcttctctcctgaaagcactgtgaagccgaggaatgtttgagagcagaggagcatgtcatgagctccatggaacatgtcttgcctgcacagggaaagaaagacagattgcagggaagttggctagaggtagaaagcccagaggaagcagcttttgcaatctggctgagagatgatgaggttctaaactgtggtgaggtgagaggtaaggagagtttggtggaatgttaggacctattcagggagtttgaatggcactgtagaaagagcaccaaatgagtcatcaggaacttaggttcaaatctcagttctgctggaagggaaagtagaattctctgccccctgccctgaaaagtccacatccccaggtggtggtttggttttttgtgttagcctgttactataaaaagaattcaaatgtacacagaaatagaaatagtaaaatgcatcctcttacccatcatttagcttaacctcttgcttgtattattttttaggggggcaatttttgagatgaagctttttggaaatattcactttgaggttgcatttgaagcatttctctgaatctgtttatgatctggttgaggcaatgaaataatttcacgtccatttgttcctccctggaggtaaattgtgtgtatgcatgtgtgttctttgctgtaagaaggaaaatgagggtagcttcccttgaagggtaagttctggggctgaggaggcacattgccaaccgggtcctgtcaggggcatgaggctctctgtctgctgtgggggcaggtgtggtgtggacaggggagagaatggaggtaaggactaccacaggtcagacacccttatccattcactgggaggggcttgttgcccagagcttaattcacactgaccaacctgacaaggctggtccataagccagacaccaatttaatttactctggcaggcattgtgcagtggccacaacgcaaatgcctgctttcccagaccgccttcctggccttaccccacctggcaaaatgaattacagcatcatccgcaggttgctggggagccatgctctcaaatagaaggcaccatgtgcattgcaggtgcatcactacaggccctgatgggacctcataggctctttctggtgcaggccacttcctttgccaaggtggctctagggagaggggaggatgggctgagctgcacatgctcagttccttctttcatttccaccatcagatactgagctgtttcccaggggaggaaatcctggaaagagaggaagttagtatcctcccattgggtcttgcccatgacaacatgaagcagaaactaaatggaggtgggagcccatgtctcagccaagattcatttcaacaggcaggggtggggatgctgtcatagagaaaacttgcctgagcattgaaaaattagttttgatggacagagattggggaaggggcctttagttgaggaaacagcatgacaaaggcacagtggcataaggatgctctcttgcggctggggtatcaggaacccaggagcaggtcaggctcagtgaggaagtgcgtccagcgtagtggttaggaacataaccttggagttggactgcctgaattcaaatcttatctttactgcttcctggatgtgtgatttgaccaagtcacttaacctctccaagcttcagtttccttatctgtagaatcgggataataatagttataaatattgagatatgagataaacataagaacttagctcagtgtagaagtgagtgtttaataaatggcagccattataactaccatcatgagaacaggacattttcgggccggctccaatttggatgccagctcatgcgttcagactgctgtgggagaggccaggtgttactcaggtgagaggaggttctccagtgccctggttctgaatacctgaacacagtctgggcagtaggagtggaaaggatgagatggagaagagcatccctgcaaggggagaccacagagacctggtggctcacacgggaggggagtagggtggggaagcatgacaggtgaatgcaggctgcatagttcaatgagggacccggagagcgcttctcccaaatgccagaggaggagagtgtcaccactgatgagatgccaaagaaggcactagagcaaacgctgactgatggcgagtctaagcgctttactctgttaacatttaaccttcacaaccaccctttcaggtaggcagttttattattatcctcatcttaaagatgagaaacccgaggcacagaggttaagtgtcttgccctgggacatatagtttctgaatcagggctgtcaccgaggcagtccaaccccagcctgggcttttaaccccaccctagaccgcctcttaaggaaatgggaacacaagcggctggctggatgagagcatggcacgggtgcacacggatgagtgacgtcccaccactgggggtgtcagagagcacgggaggtaggcagtggggctctgaggcaaaggggaaacatggaataataacagtagggtgcagggtcaaaggacatgttctagaatagcagaggaaggagcagaagagggagagagtgcagattcagtttggagggggaataattgagaggttggatctcagtgatgatcgaagattaggggtcacagggaggaggggcaactcttagacagcatgtgaagagagggtaagagatgagagaaggggaatcaagtggttttgtttctcattaaagaaagatgcatggtagtttgcagagggagtctgacacgaagaaacatgagattagagatcccaggcgcatgaatgtctgatggagccgtatgtgttgtgtagcatcccgggagcagaaggaagaagagacatgtgaacctggttccccaggcagagggagagtgagcgtaagttgtgaccagagaggtagaatgagctgaggagcacgttcaagctggagagaggtgaggactctacactctgatgaacagagccagggagagagcctccacgttgtccagaatagggctatggtgaaagaggaaatggagtcaaggaagtgtgggaagggagggaataggtggggacctgaagtgggcaggtagaagggacaggctggcagaccatggttatacttggggaggggaatccagagagatccttgagctccttgagaaggatccttccttcaggtccccgcctcctcctcctacgttattgctgggaagagtgggtggcttctaggtggctccctcagtggttgtcattgcctaatggctacaggccatgttctaggggtgacaggtgagagacccttctcaagctggggcagcttcattcgctgtcactattcccctgctctctggccactgagctacatctttgtaaaacagggctgataattgtactatatccctcacaggacccccttgaagattaaatgagaaaacaaaaatgaggacactttttttcccccccacagaggcagcagcttctcaaaggagacaggaaacctgtgaactcccagagcaggtggtttttacacacaggtggatattgcacaggctcgaaataattcaccatcatcttgatctattgtgaatggctgtgtggccagggcaggcagccaaatcttagaacgtgtgagttatctgttgcctagtcctggctcttcacatcttagccttgaaagatagactctcatttacgtttacttcttagacccactctttctgagcggttcagaaggaagggaaagagcctcctctccgaaagttctctaagtggctacggtgggccctatccccatgagggcactgatatacttgtcttacagtattgaagggcacactgatggggtttggtgatgctctgctccctggatgctgtctggctccccatctcaattcttcccaaaggcacagatccctgcctcgcttccctgccctccccgctccccactccccaatccctctccttgttggagtacctgcactgtttgacctttggcatctccccaaaccattctctgacagacctggcattaaggcatggccttggttgtggctggtttaccctaatcagtgcttgagttgggaaaaggatcagcttggagagagaggggaacaaaggcagaatatcgagagcagaaataggtgagaagagtcagaggagggtgaagcgagcattcaacaacatcaagcaaatacggtgaaggaaacttgacatcagcttcttagtgttcctgaagcccagaaggtcagatgtgcttttgggtgtgagccatcagaacctcagactcacacccgtttcctggccagaccctgcgctcctccttgtgggctgggctcgtggtgtctcattctcatgtctttggggtggtgtttctcttaaaaagcttgccatttccagtaggaggaggatgtcgctgctgagactgtgggacagctaggctcagagggagtctgacttcggggcacccggaggtgaggtctcagtgcctgttgctgctctttgccttctttagaggacagtgtgcagctttctgactgaatgccctgctgttgtgatatgttgctggaaatgctgtttggggtcatggagccttgcttaaagggctgtggtttggtgagaagggctcgagctttttgggaatgcttaagtggaagcatctgggcttggctctgccaaaggaggctggtggtggagcagggacatgtgacaggacttgggctgtgtcttcagtggaaggaccagaaagcaaaaggaatccttccagtgggttcagcagaactaggctccagcacaaatgttcttaaggatatcctggacctcgcctgacagggagtggctgggaatacccggtgcataaaactcactaacctggtatagcgggaaaaagacgctaagcaagaaatattgcattcatcccctgccaccacccagcactgccagcctgtgtctagattcagggccctttctgcagttctgatagatctcagcccccactggcctgagcttaactgactaatcagaacagcctgatctaggatgtttaggttgaaacaaggaaccttgtatgcgccaaatatttttgttgctgtaaagctttgaacaaatgtttgctcttaggagttactgatactatgattagatggggaccagttaagcatgcttgttcaccttcagtggcattcttctattttctcctcttcagcttcttttaggctacttaagcttctattcattgacaaaacaaaacaaagctctgcctcttcacttttattagactccgatattcactgaaggcattcagcaactctgatagcaacgttctcagcagcctggcccctctgtcctgctatggctcctctttgtcctgacaggatatctcgctgtgttgggctcctctgtcctgagggaaatttagcacaatggccttgtccctcattgtgatataaagccagtgtctgtgggctctgccattgctctgaggagctgtcttcgcaggccaggtgtgcggcttctcctctccactgtcagatctgatcctgtgggggtcgtgacctctggatgttataggacctgtggaggacaggtacagcttgtggccctgggcagaaggtggggacaacttgaactgctacgctgagagccttgccagtgtagaccggtgacctctttatttcctttcattttctcccttttagaatgggagctgagctccggggtcagagatatggccctgcctgtgagggccttaccacttagacaaaagtgccctggagaagtctgtcctgggagtggcgagggggacccagtcagaagtagtcacttccatctgggggatggatgggagaggatccttggagataatgatgatggaatttggcctcaaaacaggagtgggagttgagcaggtagaacgaaggacttcagctaaaacactgaagaagccccaaaagcagaagcaagctggggacaatagcttggctgttgctcagggcaggagccagatatggccaggagaattaaaactgctggggttgtgaactcccacccagttttgaatctctacagtcccacaatgtgtctcttttcacctgaattttataaataggtaaaatgaggttcattaatgttaaagagcttgtcggggcacagctcatgaaggaaagaacttggatctacatgcaggtctgactacagaacccactctcctaactgctctgtgggtccttaacttcgtctccaggtccccaagcacccctttgttgcctgagtgatagaaagctggtgaagcgttgtgaatgctgggaagccttggtaagatttgtgaaatagacccaccctcctggcagcagtgtggaggatgaggggtgtgggggggcggtgaggctggaggcagagaaactggttaggaagccagtgcagccactctgatgggagatgacggcagggcaggtgaagatgaggggacagatctgaaagagagggaggagattttaccggatctggtgcccagttggatgtgggtaacaaaagggaaggtccaaggctgactcccaggtttttatcttggtgaccatgggggcatcaccaaggtgggatgggaagcatttgggtcccacccattgtgagaatatagagagggaggtgggtgctcaggatgggaagagtttggggctgttgtaggggaacatgctgcaacctcactccagtccccactatctcccaggctttagcttcccatggacaatgaattggttattttatcaataaatctgtaaacacttatccagtgcttacagaatgggggaccccacagggacccagacacgtggcacagttttcagggagatggctgtgcacagctgctgtcattcctttccttcaggatgaaaaaagatgatcagggagatcccatttaggtagtcagaattaagtatgattacctggaagagctggcttgatgggaatttagcagggacagctgtaggcatgggcataaaagctggaaagcagtgcagacagccaattaactaacaattaggatcagatgccttagtgataaggcatctggtgaggatggggcagaggtctgccaaaaggtatgtatggtaaaagttaaagccgtgaccaagtaggttgagtccatatgatgatagaccatgatttctactgtgtggctggtggccagcccctgaggctgtctaagcaaaagggtgcctggtgcagggctgtgtttgcattccatcagttcctcaactttggtcagaatcagaatcacccgaatggctagatcagccataaaggtcaggctctctacttacaggaggctgggcctcttgcttgattagttctcagggtggttctgattaacagcaaagtttgaggaccacgagataggtgaatcttcagtgcagagtgaatggggagggctgttcggaggagggtaaccggttaggaggctattgtagtcatctagggtgaggtaatacagggacaggtgaggctgtgtgagcagatgagatcaccagtagcgtgagtttggagagaagtgctctggtcttattcagcagcatttggtgcacctgactgcgccctctatccagaaaccctttggttcgcttatgggtgccactctcacttctggctgctcctcctgtctcctttgtccattcctcttctccccggtggctgcatggtggagtgtttcagggagtcctggggcttcctctgtttttataccacttcttaagtcacttcatgcaattgcttaaatacatctttatgaagatgcctcccaaattgacatctccatcccagacttctctgtaaacatcagactcctatttccaaatggctactcagcgtaacttcctaggtgtctataggcctcttaagctgaacatttctaaaaccaatctcctgatttcacccccagacaccccacattgttgctcctgcaggcctccacattctctaggtactcagggcaaaaaccgtgtaggcacacttgactctgctctctcatgcccatgtccagtttatcagtaaatcttatgggctttgtccccaaggtatatcaggaattagaacatctaattcattacggtctgagtcacttcatctcttgccgggtttcctgtgttcactgctgcgtcccctgcagtctattttccaagaagcagccagagtaatccttttaaaaggttaagtcagatcatgtcaactctatcctcagaaccctccaaatgggtttctgtctcaggaaagtggaagaacaggaggaaaaatggtgtgcatcctcaggcaaattgcctaatctgttttctcatctgtaacagggggagaataattcctaactggtatggggattaagtgagataatgttggataaacccttagcaaatagctaacagttatctgcccaatatatggtaactaaagaggagacagatgccgcattaatttaatcttggcactgtgcctgccatgccacatgtattatttcttttaatcttttttatttcttttaatcttaatcaccactatatatccacacaatttaaagactcaaataattgtatgtaatttgttaaaacagccacctcttcacctccccaccccattgttcttcctcagatgcagctgcttaatttttttagtcatgtatttttatccgtatctctagaaaaatgcttgttctgctgctttattattttccccccatttgtcattatctgttcttattgaattaaacaaagtcttcaccaattatgtaagtctgttaagatgttcagatgcaccaggtgttctgtcaatttcatatgactgaggaagtctctcccagagcttttgaactggctgaccttgcaggcttgctacagaactgtaccctagcatctcccttatggccatgaccttgtgtccttttgagtttatgtctctcttgttaaatgagcagttaaattaaatgtttaggttcagcctgcaatgtttacctgagttctgtcttgtttacatttgcccaaaacaatgaaattgattttatactgattttacagatgagacaattgaggctaaaagaggttaaaagactcacagccattatgcagcagagcccatgttttcactcaagtctgtctgtatataaaagctgtactctctctcctttgccctttaggaagaaagtagttgttggttaatatgggatgtgattgagaatttagcgctgccatcaaattccttcatatctgtctttgtcctttttatttttggatgctccaaatggcttcttgctccactctaccaaagaggtttcttagatcctttaaagaggctttctcttaagcttagggatagcaaaaggtatttcttaaaataaccatttaagagcagctatggcttatgggaggcctgtaaattattgggaaaagactccaatttcttgtaatatagtgacacttctttatcatctgtttgccacttggggaagggagaggtaggaaaggagttaggttctgtggttgtggtggggttcttggctgaggcctccttccccaggccttgatttccaggcagagacactggcccctgtctagtggcagctgctaaggagtcaggtcttggctctggctcaactgtgtccaaggctcagaatatcctggaggcacagggaatagcagtgacttccagatctgttcctagttcatttcagcatccagggctatgtgagcctgctccaaacatcaattacaacctaaccatttttattgagagaaaagaagcttagaaatggaattcagcgtgggtggagtaaacaaaggtttacttgcttccgacttaccttcatcagtggttgctgcctacttcaaattttcttttgccaaacatgaaaggagttaacacagtatataaatcactgtttgcctcagaacataccagatgatggggttcaattgtgactcactttctaaattttagaacacatacagatcttgctccctaatcaacttccaggtgccaaactggcctttgtgtggtgcagttcatgtggctgtggcatgtcatcataccttgccattctaaaacatggcttttcctcactggctgcatttacagctaaggggtgtgggatcgttttctccctcactggtagcgaagagaagggttaagtcctgtaatgagcaggacccccagcctcagatgctgtcccagataggaagatgacagcacacacataggcctgtgagtgaaggaaggatgaattgtggatggactgcattttttcttaaacaacataccctgccttatctttatggccagggatgagacagtgtctcagtatcagaagccagcctgctcattagggtcaaaatgccagctatgttaagtgtccagagagaatgaaaagtgctttggtcccatgtaacaactgtctctgtattgtgtgtgctaagagcaatatccttctctgtgtccacttctttctttcctgggcggttgggtgcccctcgtacagtccccatggcacattgttgattcctctgttgtccatgctgtgtaaggcccttgggtagctgctgtagctctcctctcattgctggggagcatgatttaaattctacatcccggttcacgcctgtattcccagcactttgggaggccaaggtgggtggatcacgaggtcaggagatcgagaccatcctggctaacacggtgaaaccccatctctactaaaaatacagaaaattagccaggcgtggtggcgggcacctgtagtcctagctactcgggaggctgagtgaggagaatggcatgaacccgggaggcggaggttgcagtgagctgagattgcaccactgcactccagcctgggcaacagggtgagactccatctaaaaaaaaaaaaaaaaaaaaaaaaaatctacttcccaccatctgcttagctgtcaccctgatttttcacatgtcgcttgggattttggcttgggttctggctctctctgtcttctccctggtgtgttgcttctggagcttggtgcacttaagccccatatccctgaggagccctggctccctaggagatgctgtgtccctgtgggaggaaccgatgtggaagacactgaacgcactgcatgtcatcagacagcatgtttacctctgagacctgtgatactatgatatacagtagccccctcttacccatggttttgctttcctgggattcagttacccaaggtaccgtccagtaaggtattttgaaagagacagggccaggcatggtggctcacgcctgtaatcccagcactttgggaggccgaggtgggtagatcacttgaggccaggagttcaagaccagcctggccaacatggtgaaatcctgtcttctacccaaaatacaaaaattagctgggcgtggtggtacacacccataatcccagctgcttaggaggatgaggcacaagaatcgcttgagcctggaaggtgcaggttgcagtgagccgagatcatgccactgtactctagcctaggtgacagagtgagaccctgtctcaaacaaaaacaaaaacaaaacaaaacaaaaaatcacattcacataatgtttttacagtgtattataattgttctatgttattactaattattgttaatctcttactgtgccgtgcctaatttataaattaaacttcatcagaggtctgtagatacaggaaacatcgtattctatatatagggcttggtaccatccactgtttcaggcattcactggggctcttggagcgtgtcctccaaggataaggggggactactataataaaaaaagtatatatttggtctccttccagtttgctagcacagaaaaggggcaacttttgttattcataataagcgcctttcaaccttactcagctttatgctaatgaggccactcctgcaggatgggctggttaccagagaaaccaacctggtgattagagggttagaactttcagccccactcccaatcctcccgactcctaccttggggaggagagtggggctgaagcttgagttcaatcaccaaggactgagcgacccatgattggattaatcatatctatggaatggaacttctataagaaaccctaaatgaaggaaggggtttggagaacttccaggttggtgaacgcgtggaagtgctgctgggtagcagccctggagaggctatggaagctccatgcatccctccccactcctcagtcccttgccctatgtatctcttccatttggctgcttctgtgttgtcagaaactacacatcagctcctaggattcttatgaaagcacattgtatgataatggatttaagtggttttgtggtcttgtatgcatatgtggaaccctctgtaatgtttccttgttttgtatttgaattttcaggaagaggaaaataggctggcaaaaagagtcatggcttctgatgctagtcatgcactgtgaataggatacaccttgaatcatgtttcacttcaggccagctcccacaggtccacccagcttgctgtttgccaagtacaaactcatcgctgggcagagggcccatgggtcttgttttatggcccttctgttgcgggggcacatagcctgggccctctgggtttgacaccctgtcatgtttacatctgaggccacctgatttgttaggcattggcatccaggcccctgatgctgtgggtgtgattcccaggctcctctcatgcattgcccttgtactgcatatgtgaattccatggaaggctttgactcatcttgagcagctgggtgctcctgcgtaatctcatcaaccattttggcctttgccaactacatcctgcccttacatgcttccctggctttcctgtgcaccacactctctgcctggaacagcattctcctcctcatcttctgagaaagcttctatcatccttcaagacccagggaacttgcacacctgcctctatcaacataccttgcactgtgtcataattatttgttcatacttccgtctcttccactagattgtgtggttcatgggggcagatactaggtctgatttatcagtatccttctagggcctagcacaatgctggctgcatggatctgtccatttattcataagtatctatctgttacacagtgggaacctgggagtaaacaaggcagacagggtccctctgcctctgtgggaaggtggccagttagcaaggaaacaaatacatagaacaagatactgtggatttgttgtgctttgaaggggctgctttacgtggtgccggggggcggtgtggggaagccctctctgatactttggatctgagacctgaaggatgagaataaatcagctgtgcagacaactaggaagtgagctcagggtagggggatggcaggcgtattgcagaggagggaaggtcttggagggctcgggagcagacaggagaccagtgctgctgaagcatgagccatgtggggagagatgtgagcatggcctggcctgatcctgaaacctgcttcataggccacagtaaggagtttggaattttccccttagagaaagagcagtgggaaggatttggagggattatttcaaacttttaatatcccttatgctgaacaggtgagagtctgcagattgtttccttcctcctgcttccccccttttccctgctacctcttcttttatcctggccaaagctggcctccattcaggccccaggatttccacaccgtattcgctctgtagcggcctggctgctcctctcacctcggagcagctctgttccttgttgcagccttttctggctcctgccagggccctgaggtgccactgaagttccccgacaccctgtgagctcccattctcattccctctaagctaactgtgcagtggttcttgacccccgaggctgaatgcctgcttctgaaccttccttggccttagcacctgtaaatccctgccctctccccctccacaagcatggttgcttatcttccttccccatgcctgccgcctccaaacgaaccagcctcctgagtttatctggttctccctccctgcacctacctatttttgtttaaagtttcctctgagctggcaaaaatatgtcctgatgttatatcctcacttaaaaaaaaagctaacatattgaacactttgtgcaaaggaatgtgcttagtgctctctacataattttaatcatgacatctatgagttagatgctgttatccccattttacagatgaggaaactgaggctcagagatcacacagtacatagcagagctgggtctgaactcaagctatctgactttggagcctgtggatttaactattatttcctagtgcagtccggtgtggttccttggtcttgagatccttatccacaccatctctgaagccattcctgggtggtgcccattttcctgtcttcactctaaatgtcccacttcacaggaaaaactggcggagagcctcagaaccacctgtttcctctgctgcaccatgcttgagtgtggaagccgtgcccctgttctccacagcgtgtatggccattcggcacatgtgtagatttgctgaatgagcaaacagcaactcctccagtttacagacgtgagctaattctcttgggattacaagtgctattgtaaatccctccttgctacccagggagagggtggggaacaagaaaaatgagaggaggctgcaggaagagggtttaaactaaagaccttccttgaggtagagttgtccagagatggaagcaattgcctgagggacaggggaggggcattgggcagttcccctttgctatagctaggggatacagcattaaggtagtggccggactgtgtatccttggaggtgttcatctgccctgaaaagatgggattctgaacctcaaatcgtgctgggtagagtggatctaagatggtcagttatggtgctcctgggtgctgtctctacatccttgtggcctgtagacttcctaggcagtgcaccctttcccaattggaggagtggaagtggcatttgagccctctcagcctggctcacacccacccaaggaaagcactgcaggcctagggcaaatgcagatgtaagacagttaaatgcctgcagggattgtcccaggccctgcccttgtgctgcattgccttgtacgccctgacagtgtccctgttaggtgtgctgctctcctacgccacttagtggcgcctttcacagtggggtcggagcttctggaacctgggactccaattgttacacctggtgaggtgttaacaattgccgtcttgctgccacaggtgactctggagagccctggtggtttttcattacagaagtgaatgggattgtgtgctaaagattcatggaaaaagcactcatgccaagagggaaaaggccatggagatgcagaaactacatgtcggctactatgattcttatgaaaacacgttgtgtgatgatggaatgaaagatttttgcgatcttgtgtgcgtaacatggaactctctgtaatttttcctttgttctgtatttgaattttcagtaagaagaggaggaggccaggcaggcaaaaggagtcatggcttctgatgctagtcatgcgctggaagctgccctggagcaaatggacgggatcattgcaggtacgcccagggaaccccagcaaccaaggtctcatcctccacattccaggaactgcttctctccttttacttttttttttttttttggcatagagaaaatccccttttgttatatttatttttcagtggtgttattgtgtatgtaatctcttttttttctttgatacgaacttatacaactctctgatgtctggtgtgatcgttctggtctctgctgagacagtgtggatgtacctaccatctaccgtctcagtttggattctggctgtgaggcagtttgggttcagtgagactgattctaatgtaaaattttcagagcttttcatggcttattatagctgatctgaaacttgaaatctagcagactttgccacctaatgcaggtgtcagcgtcctcagatggtctccagtgtgtttcagagatgaaaggcagttttgtattgattcaattaatgattcaaattttctttatgccatattgttttttatccctctcaactgtttggttttaatatttgcattagccagtaggggactttttcttagaaaagatctagcaaagctgtggttaatttgaaaggactatcaattagctgttccagctgattcctttcttcatgggagcaaccagaagcctatattgattagaccaaacgttttgttggaaatctttccagaaggtcctaagtcttctgactttacctgatacacttcagtggcctcattggtagattggatgtgcttctttggaactttgctcttcattgtttgagctgtggctggaagagagcgtggaggaaggtattgggccaagtgtggctagaccccaggaagtacacagagtacctgacactgccctttctcaggcatttgcttttccttcccattggagggtttcatctgacttacagagggctcttggtgtttgagcctgaagtgggagagtatgcctgtgtcttgcagcttcttcaggttattgttggtaatgtgatgtattctagctatcatctgtctgcttctcaatttctcagttgatagagggcccttgagaagccatgactaatgtcctgcttttcagagaatccatagactgggatgtcgtgatgtttaatactgagtgtcaacttgattgaattgaaggatgcagcaaagtattgatcccgggtgtgtctgtgagagtgttgccaaaggagattaacatttgagtcagtggactggggaaggcagactcacccttaatctgggtaggcaccatctaataagctgccaactaatataaaacaggcagaaaaacatgaaaagtctagactagcttagcctcccagcctacatccttctcccgtgctggatgcttcctgcccccaaacatcagacttcaagttcttcagctttaggactcagactggcttccctgctcctcagtttgcagacggcctattgtgggaccttgtggtcgtgtgagttaatagtacttaataaactcccctttatatctatatctatagatatagatatctatagatatctatctcctattagttctgtccctctggaatacagatgtcctgttctaggttagggtctctgatgccttattgaggagaaagagtcaagaaagtggatttcctagcaatccttttagagatactgacctgtgagctcctcggggtctcacgtgcattgggataatagctacaggatcattccctgagaatgcctgaggcagtcatcacttcagagccttcagccaaagagcaaaggggagactgagcgagtccctggcagacctctttgatggttgtcagggagggatgaaaatactatcttttctctacgtattatctctgctgctttgtcaaaggtcatttgattatatttttgtgatatatattcaggtctatttctgaactctgtattctgtttcatggatttattttttctttcaccaataccacactgtgttgattactgtagctttagtaagtcttgaagttgggtactgtcagtcctccaactttgttcttcagtgttgtgttggctaccttttgcctcttcgtataaaatttagagtcagttttttgatcacaaagtaactttctgggattttgattgcaattgcatttaacttagatcatgttgggaagaactgacactttcacaatattgaatttttgagagatgaatcagacttctaaagaaaagtagccttgtgtggggtcagtacctctttctgactcctgatttctccatacaggcattcctgaaatgacagagcctctggcaaaattcattttgtctctgagagacattatgtggctggatccttaaggccttgccttgacccaggatctgcagttgagaatctgggatgtgtgtggagagaggggccctaagtgtgggttgtgtgaaacccaggagacctaatcttctgatcttccagtacaaactgctctatccttccatttccttagtcctccatcttggaaggttctatctagaagggctcctgggcttttctgtctggaacaggtatgagagttttgtagagagaaggcattctttgcaaattggttctttgcagattggtagggaggaatacctgtagccagactacttgtttgaaaacctagctctacaacaagttacttacatggtctgtgcctcagtttcctcatattagaaatgagaatagtaatacccatcttagagagttgcctgtgttgacatgcgtaaggtgcttagaacagtgcctggcacatagtaagcactataaaatgttagctcttgatagattaatgagggactaaaaataatcttcatcatgttgaatcttttctggggacggggtagtattctatttattaaagctcttatttctcccatctgagttttgtggttttcattgtataaggcttgtgcatccattgctggatttgcccagggtctgcagatttaatacgtggtcttctgattgctctctgcatctgttcttgctcccttatagactgtttcccacagagctgtagagtaaacctgaaaatgtaaattaagtcatatcactcctctctccaaaactcctcaatggcttcccatctcaggataaagtttaaagcccttaccacggccagcaaggtcttagcatggcttggctttcgtggccctttatgcatcccttttacgttcccagggtgtatctcactttaaccatgagcttgcccccccctctcctggaatgccctcctccagatctaggcttatgctgaaatgttaccgtaccggaaggccttccctgactgtgtctatcatgcattcccacataactctgttcttgtatcttgtttatacttctttatagcacttatcacctgacctatcacattcatatttgcctctttgtttattgtctgcctcctgcaccagcatgtaagtttcttaaggacagaggctctgccactgtatctccagtgccataattggtggttttaggcattttagttaataagcatttaatacatgctagatgtttttttttcatttgcttttgtgactaggatctccttttcattggttaggaggtatacatataggtttctgtatacatcttctatctggctgcatactgaacttcatttattttctctattttcacccttgtttcactgattcttttggaataacaaattattattattttttttgaagactagtagtttgtatgtcccatgaaccatccctgaagtagtaactggctcacacagatatttgacaggagctatttgacagattattcaacactgaggttactagtgagtatctggagggcatgttttctatgctattcttgataaaaagaatgatcattcttttgaatgccttgttcaggttactttttctcaagattgctgaggacacttttcctcatttttatgatggcattaggatggctgaaccaaattgggccaaagaggttaagaatttttgtggttattaacatggactacagagttggactgtaggggtttgaatcccagctcagccatttagtgctggctgtgggatctttggacaaattgcttaattcttctgagcctcaatttacttatcgataaaatagcagtaataatagtacctgtctcatattattgtgagggttgaattaatgcagataaggcacctagaaagtgcttaattgatgtaagttatttgttttattgatattagtattaaattatttttaccccccaagatcatagtgctgagatttgattccagggccatctgagtctcttccaggctccttttattcctgggctggtttttatgttgatgcatggggctgtctgtaggagaaaagaattaactgagggaaggatacttttctgctcttgctcacaatccctaagccagagtggttttgttcttgtctctcttacgttatttcttctaagcaagggttcctttgcttaagggtggcacagctaaagaagtttgaaaactggcaccacaccacagatcttgcagaaatgacatttttgtgtgaacatttaaatcttcctctctttatttatgttctcttattaattttagattgcatgatgtcaagtagtgccaccaccactgccaaaacacaactgcttttccatcaaagtactcaagtacccaaagaatgtattttctcacagttaccacgtatttcaacggaaaaaacctttatgggcttcctggacctcccaaatagtaaccacttacacagaaacaacacagattcctactaaaatggatgtactgtattcagtgatcactagtaatcatatactatgtaacaaggaattgcctcttactaattacagtaggctgggttactgtttactttccaaaactccttctaaaaagagtgcactttgggcatgtgatatcaatgtttatgtaattaagcttttagtgcaaaaaaaagtctgtctcctcctgcatcaactaaaacagtgcaaacagtgcgggatgattatcactcctgtaaacaatcagaccaggagtactctgagaggacatcctaatgcgcaagtggtaaatatgcccctccagagccacggtgcgatggcctttgtctcaggtggtcaatgttgggaggtgtgagagagagaaattggttcttgtaaatgcaaaaagaaatgccttgtaagcaggactattaaatgaaactccttgtaaagttgaattcttgaaatctgaatggctgaatcccaggtgactagactagactagactagactagactagattgggtctatactagattgggacctcagtattttatatcagaaagttgggaaagggtggctgttaaagactctaggatctttgtcaataatgacttggttctaatatgaaagaccattattatagtttccagtaggatgttaacctttgatctagtcttcctcctgattagtccctgtgattctgcttgcaaattcactgtaattgaattacactgttgacaattgaaattgaactctatattgcttaattacctccctctggatggcctagagcaactgccacagacactaattttgcatggagcttaatttgtgaactgacaggttcagtggctactttgtcaggccacttctggcaggggaccagagagccacgtggtcaggacacagaaggccacttactcctcttggctctgcatgaggttactcatgcagttatgtacaagcagtactcactgaggaggaatagttaagaggagtctgttttatgacagttaaagaagttgccctgtcagctggggcctttctgccaactctgattagcgtctgggtttgtaaaaagaaaacaacaaaagattgtgcaggggcagagaaagttctgatcaagaccgagattgttcacgttggcttgtgaatgaagtcagctgtggtgctgaggactgttgagtccatactctgaacagtccttgactgatcttgtccccggcttctctgaggtgcagcagcatatagcattcatcagtatcggactcgctgtttcccattgcaggttgtgagagccctgctaggactttgttcagaagagttggagtgggggtcttaggagtgtctaaggggcagagctatcaaagactgccctttgtatgaagaggtcaaaacagctactggggcacccgctgtttgacagccctcattccatttttccctcactggtagaccccatctcccagtcctttatggaactgtgcctcgttttccattctctgaaagagtttggataaggctggaactatgtgttccttaaatatttactatagttgtaggtataggaactgagctgcaaaactgtgtgggcctcgtgtattcttgtttgaagatttttttcttttaatggtgtggacaggttttaattttttaattgagtcttggcaagttaagtttttctagaaatgtgtccattttactgaggctttccattttgttatcatcaagttggccattatattttatctaaagtactttgttagattagaattattctttaatgtttgatagaattaacatataaaagcatttggcctggtgtgttctgtgtggaaaaaaatttaaactacgattaaatttctttataagacggccaggtgcagtggctaacgcttgtaatcccagcactttgggaggccgaggcgggcgaatcacgaggtcaggagattgagaccatcctggctaacacagtgaaaccccgtctctactaaaagtacaaaaaattagccgggtgtggtggcgggcacttgtagtcccagctactcgggaggctgaggcaggagaatggcatgaacccaggaggtggagcttgcaatgatcgtgccactgcactccagcctgggtgacagagccagactctgtctcaaaaaataaaataaataatacttgactcttagaatgctttaattctcatcactgccccatcttccacattattttcgttcagtattctagtatctttgtattctccaaattattgttttttcagttgatagcattttgtttaacagttttaacaacctctccagtcatagttgattctttcatcctgctttttttgcatgatagttttcttccttaaaatttgatagtctgtcagtaatagattgtattagtcgtcatttgaaaaatgtccttaaatgttcataatcttgaatgatagtttatcttgtacaggcttgtaggttggtcactatccataggtattattttgtggtcacagggatttattgctaatgagaagtctggcaatctgtatctgtcttctgtctctggttgtttttaaacttcttatttatctttggtgttcttcagtttcactgtgttgtttcttgggtggatttgttttgatgtatcattcttgggactcagtgagtgtctttaagctgagaggactcaagttttccattctgaaaaattcatagccattttctttgttgtctctgcttcatcctctgtattcttctggaattcctgaagaattgtgttggaccttgtcctccttttttaattccatgcttcctaactcctcttttatatttttcacttgtgtctctgtttgcagcattcttcaaatctatcttcctctccaataattctctcatctgctatttaacctgttcacttaattaatttgcttggctgcattctttattttggtttgtattttttttttcagattttcctattttttaaaatcatgctttccttttctttaaggtttttatttcttccttttctcctttaattatgtaaaacatatgacatatgcccaaatattcccaaatagacaaaatatttactcatattagtgtattgatttagttacgtgtttaagcactaagtaaaaggctttcaataattcaaaataatatgttaatttatgaacttcttgtctcattggcacttttttttttttttttttttgagacagagtcttgctctgttgcccaggctggagtacagtggcataatcttggctcactgaaacctccatctcctgggttcaagcaattctcagcctcctgagtaattgggattacaggtgcccaccaccattcccatcactggcacatctgatgaaataattttattcaagctttttatatttatctttgtttctatcattttgagcgctctttttgaataatcctagcattctagagcagttgtagagcatttggggatgcagattcatatttgtaggtctgggatgggatccgagactgtatttctaatgaactctcaggttttgctattgctactcctgtggacccctcttttaagtggcaaggttttagaacatgccatccttacttggaatttgttttaaatacaacactttaaaaattcacatatgatgctgtcatcagctatttcatctcatgccaaagaactccatttacgtggtaaaaggttagactttaaaagtttatcttgtctatatgtcttaattgtacaaaatatatattttgcatgaatgaagataggctaagttatattgcagtgagaaactactcaaatgtcagtagtttgaaacacaaaggtttatttcttgtacacattgcaagttccctgagatctgccaagagctctggtccttgtcatcttcacttgaacacagactgattgagtctccactattgccagaagtcagggcaggtggaagagatatgaggaattgtgtactggctcttagactttctcccacagtgatacacatggtttctgtttattggccaaaggaagttatgtgaccatgagtgacttcaagggacagaactgtgagcctactatgaatgcaagtagaggagaacaaaatatctgaacaaccccagtcactaccacagacatccctatgtgctttcgaaagcgatcattaaaaggctttcagctggctgcggtggctcacgcctatatcccagcactttgggaggctgaggcaggcagatcacgaggtcaggagttcgagaccagcctgggcaatatggcaaaaccccgtctctactaaaaaaatacaaaaattagccaggcgtggtggcgcgtgcctgtactcccacctactcgggaggctgaggcaggagaattgctggaacctgggaggcggaggttgcagtgagctgagatcacgccactgcactccagcctgggtaacagagcaactctgtctcaaaaaaaaaaaaagaaagaaaaaaaggctttcaatgaaatcctataacacttgcattgtatgtggtcttatcctcaaaaataattattaaatcttcattaaattttggttttgctccttaaaataaaaattctcaggtgacctctataaccatcaaagctagacttcattgaggtgatctgctagtgccatggtttcagcttaagcatcattttagtatcacctgggaaactttttattaccccaggtcacacctcagaccaattaaattagaatccctggaggagggcccaggcatctggagtttgtaaaaccgctcaggtgacttcaatgtgcattgaaagttgaaaatatttgtgctactctaaatactgctttgttgctcaaaatgaaataaatagaattccccaaagagaaactttaggcttgactgtaagttgaattacccttttctgagaaatctggggggcaaatcttgccttatatttaggcatatccagcattagtggtttatggtgtcttctaaattttcctgttaattccaggttttagggcacacattttttttatttgttttctattttgatttgtttcccactgtggttgtaatttttttacaggaggtaattgtgggaaatgtgtgtggagtgtggaaatgagcctcctgggagattttgcaattgctaatgctgggctttaggtgttgcactattctggaccattttgtgtgcatgtgtgttgatttctggtttgggatttcggtagtcagtgcatagtagaaatttggcactataccagtggtatgcagaggcctgtaggcttgatgtctcactggggggtgagggagggtgtatatgtgtggtattataaacacctagggggttacttagcatactgcaagcttccctgccgttgggtgaattttctcagatccatttatgaaataggcaatactttggggtactttctttctataggggtctcactttcaacttactgctttcactggaggcattaaaacctcaagccccaatctcggttcctccctatatctgggtattttgcccctgggctactctagagtcagcttgaattaatttcactgttgagttcactctttgtttctggtacccaaggtttttactgtctttcaagcttggctccatgttaaaaaataaaataaaataagagtgttatctttttcagcttttctgtttgttcattgtgggtaagggggactcctggcagttgagtatgtcctgtttccagaaggttcccccttaagcagcacatggctagcttaccaagaggcctgctctgagattttctgaaatgattgttctgtgaaaatactaccaggtttttccccctttcactaatgcaattatagagcgagggaaagctaatcaacagcacaaggaagaaacctgtctgggtttactcacttaatttcctgcccaaataaaggcctgaattcttccatattgtctagcatcctgtggggactttgaaagaacaagagaacctagagtccctgtgcaaactaaatgtcaaacttgaatctctcacttagagtcaacaaatttaaagtttaaaacaaattgttataaaagtaatgaaaattaatattgtcaacatttgggtatttctctgtatatatatataccatatacatataattgttttactgaataaggcaagtatttccccatgttactgagtctttagataattgttttttatacagctatatgaatcatattctttctttcagaagttatttaaacattcaccaatttggggggatttttcccctactttttgaaaattaagatgctgctgagattattcttatatattaatctttgactacgtgtctggttatatttccttagcttaactttctagaattggacttgctaggtcaaaaggcatgaatatttttcctgtatcttgccaaattgcttttcagaaagattaggccagtctttgtgtctattaacagtgtatgagggtacccttatgaacagcatatgagcttgccaacattaattatcattgcatttgcattttcaacaatttacgtaggtgaaaattgaatatcatttttaaatgttctatttaccaatgcaaaaacattttctttccatatttttaaattttacttctgttttttaattccagaactgcccatataagaaccttgtgcctattttgtgtgtgagaagtggcttggggactttttcttattgatagataaggtctctttttgtatgaaggctatactgagcttttgttgtaattgatacgagtaggtttgtttgtttgttttgagacagagttttgttcttgttgcccaggctggagtgcaatggcacaatctcagctcactgcaacctctgcctcccaggttcaagcgatttttctgcctcagccttaagtagctggggttacaggggcctgccaccatgcttggctaatttttgtatttttagtagagaaggggttttgccatgttggccaggccggtctcgaactcctgacctcgggtggtctgcctgcctcggcctcccaaagtactaggattacaggcgtgagccaccatgcctggcctacaagtaggtttttcaggctataatttgtcttttaattttgtttttaatattccagaagttaattttatgtagtcaggtttattgttcttttatgtcttgctcaattgctcttgtgcctataaaatcttcctctcactcagttttgacctatcttctctttgtatttctagttcagttttttaagtgtgtaatctttgtctgtctaaattttatttttgtgtatggtgtataataaagatcttatttttttctgtgagggtaattctagccacatattttagcagtgtatggcaagtgcctcttgattgtacttctcagaatattctcagctatttttattggttagttattttactgtgtaacataaattaccccaaacataacatcatacaataataaacatttatcatctgtttctatctgccaggaattcaggagcggtttagttgggtggttctggcttaggtctcttaaagagttatagttaagatattagctggggctacagtcatctgaaggcttttctggggctggagcagcagtccctaacctttttggcaccagggaacagttttgtcgaagacagtttttccatggacctggggagtcgggggaaagtttcaggatgaaactgttctacctcagatcaccaggcatttgttagattctgataaggagtgagcaacctagatccctcgcatgcacagttcacaatagggttcacacacctatgagaatctaacgccaccagtgatctgacaggaggcggagctcaggcgtaatgctcattggcccactgctcacctcctgctgtgcagcccagttcctaacaggccatggactggtaccagtctgtggctagggctgggaacacctgggctggaggatcccttccacagtggctcactcatatggccattggtagaagggcttagttccttgatgtctgctgacaggtagccatatttcctcactatatggacttttccatagggatgattgagtgtccttataacatggcagcagccttcccccagagtgagtggcctgatacaataaagcagaaggagtcacagtgctctttataacctagccttggaagtgacattcctgtcatatcctatcatttctgtcatattctactggtgacacagagcaaccgtgatataatatccacaaattacgaatattaagaggaatgggtcactgacggcttcttggaggctggttatcaaactcttcctctgagaggaaatttagaattgtatctccctttgtatagatgtttattcaatatcattttgtcatttacatcccaaagccccatggtggcatctggaagtttcttcttcccttagttttctgccctgtaaccttatctgattcttaaatttaaagtcaagtggcgtttgtcatctgaggcttttctgtcactgtcattacaactagctcagggacaaaatatttatcttttcacttccctcatctagtatttattgactattggttttgttaaagtaataaaagaaatataagtttcaaagaaatagaaattaaagttttatatatatatatatatatatatatatatatatatatatatatatatacacgcacacacacatatgcctgtaaaacttggcacagatatacatgtactcacatacatgtacacacgcatactctgaatagtaggaaagaatcccaaagctttagggcagagagggtcacagagaaaggaagagacttttccaaggccacacagtgatataaagttaatgaaaacccagatcttccatccaccttttagcctgactcactcttcccacatttatgaaatacttaaactggatggctacgtgtttaaaattcatgtgtacagaatggagagggattacttagcaatggtttggagattggaggtcttgctctgcttctgtccgttttcttccctgaagtttggctgtggctgttctaagtccactcttaattggatttgtaggagccagaaagtgctgagcacacatcacagtggtgggtaattgggcagtttcctggctccccagagcctctgacttgtttgtggatggtgatccatgattccctgtatcatgcattttcagaaagcaaactggcaatcaaatggtaattgtttccatctgtgtggatttctgcctggcaaggaggaggttggctctgagaagagtaaagggacctggaattggatgtcaggcctgcagcataccatggatgcggtggccccaagctcacattttccagtagagtcctaatttcaaatctttcatctggttggccttataaataatgcaaatgccctagaaattccaccacctaaaccatattttctaaagtgtttcttactgctgaaaggagcacagacttcctttgttagactgttgccccagttttgatttgaaaaatgtatcactgaacttacggaaaggagacttttgctgctgctgctgttgttaaataggtgtaagaatggtggaacaggccaggcgcagtggctcacgcctgtaatcccagcactttggtaggccaatttgggtggatcatgaggtcaggagattgagaccatcctggctaacacagtgaaaccccatctctactaaaaaatacaaaaaattagccaggcgtggtggcgggcacctgcagtcccagctactcgggaggctgaggcaggagaatggcatgaacctgggaggcggagcttgcagtgagccgagattgcaccactgcactccagcctgggtgacagagcaagactccgtctcaaaaaaaaaaaaagaatagtggaacagttgaatttggggcatatcaaattagaaagagctgacccaatataccagatctctgaggacattgaagcactctctctctagatactcattcaggtatatgtgcgggcattttgtcagattccttttcagtgtctactgggtagagtgcatgatgctgggaactcagttaaatgtaatatggactctctctcagactccacagcccacaataaggagatgaggtatggatatacataataataatgcaaatttaagagcatatagagatatataggggatataaagatcttctaactgggaagatccagaaagattccagttcactaaaccctcaccaaaatgaatacagtaattgtcatctagtgctgtgggataagccaacccaaacatagtggcttaaaactaccatcgtttctttgtaatttcatgatttgagtagcactctgcaggtgtgtctcctccctgttccacttggtgtcagtcggggtggctcatgggggcttggaagatcccagatggcttcattcacatgtctgtcaccacagctgggagggccaagaaaggtggggctgtctttctagccaggtaactgggctttgttacatggcagtttagggtcaaagagagaaagagtggaacctgttagacctcttaaggcccaggcccagagctggtacagagtcacttccactgctttctgttgatcagagaaagtcaccaggccagcccagagtcaagatccatccctttatcagaggagtggaatgcacacacaggaatggaagaatctctggtggccaactgtgtaatctatgactttaatataaagaaaaaaattctaaaagctgaagaatgagatcttactgtctaaacgtagtttatggtccctagtgaggactggctgtgctttcccagttgtctaagtgtgtgagcttcatacatcagtcccaaagggtacagtcatccacctctgtatgcctatttttacactgtccagcccgagattagataaagatgatttctggaaagtttacattgtgagtgattcagctggggtccaggtggccttccaggtttctttatttaaagatggggtctcactctgttgcccaggctggagagtagtgactattcgcaagccagatattgtgcactacagcctggaactcctagactcaagtgatcctcccgcttcagcctcccaagtagctgagactacaggcgtgcaccgccatgcccagctcacccccagcttcttatctgtccctttcaccgtttcttcaccacctttgctctttactagtaccttgctcagggtgtccacccttcttactgagttttcacctctctctcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttgaagagagcttggtgagtagtcccgtggcctgattgggaaccactggggaatgtaatggtgcagcccatggagtgccactgctgactggggctgttgagtcatctgtataccttccagccttttcttccatcccactttggccaacgctgcagggtggcccttcttatcaaggagtatagagcccagtcaagcgacttaagctatgccctctgcccttccatggtccacagttggcctctcctgaggaaatccagggccagagaagggcaaacatttaagatttcacacacacacacacacaccctcgaattacatgtactgcttattgagttctaatccctggctggtgtctctaccctcggctagatcccactaccccttgtttcttaccacaaacaaaagactggttacctcattgatttaaaaaaaagcttgacaaatttcttaggaggcaatgttttcttatttttgcatttctttggtaaaaaggctaaacttttgaaaattagtttattcgtattcctctgtatggtctctaaacttttgattctatatcctgtatctggacaaagaatgcatttcccatatacatattcacatgcagcattttatttttgagacagggtcttgctctgtcacccaggctggagtgcagtgtggcttgatcatggctcactgcagcctcgacctcccaggctcaagggaattctcccaactcttgctcccagaagtgtaccacctctgcagaagtgcgagccacacctggctaattaaaaaaaaaattttgtgtgtgtggagatggggtttccctatgttgtccaggttggtcttgaaatcttggctcaaacaatccacccacctcggcctcccaaaagtgctaggattataagcgtgagccactgcacctggccagtatttcactaatatacctaaattataaaaataccacaaaacagaattttaaagttttttatttgtacaaattgtggggtacatgtgaaatttccttacatgtatataacacatagtgatcaagtcagtcagggtatttagggtatccactgttcaccaaaatagagttttaaaggataggttaaaaaatagttcccatatttttccctgtacacccagaaatcaccttgagcctcttggatgcacctctcccactctagtctattcgtagtctatgctgttgttttctattaggattttagtgtttttcttatctatttgaatgaccttttattagccgtttgctttatttgtagcatatattttcctcactctgtttttaaataacgtttaggtgctttctgagacacagaattttaaacaactgtacttgactctatcagtctttcctattttggtttcttgttttccttttggccctagcaacgcctttcccaacctcagaacagataactgttcacctgtatcttcctctagtaagtttatggtttgatttttattttatggttaactccaatccatcaacaatattttttagcatttggtataaacaatgaatctaacttttaaaacagtttttggaaatttattaaaaatatttttgatccaaaggcagttgacattgttgttggttttttcaagatgcattggtagaaaacagcttgcattcagatttgcagttttgtcttggggttatttacaatggtttagggaatgccttcctttgaagagatttccctaaaagtgattgcattcataaatcttctagagtaattatggccatcactaacctatgcatggcgaagcaagtacttttagggggtcagaagttcatataaacattccaagttgtaagggctgcatgttaaggtttttattctggacagagatagcctgtctgtgttttagatcttgcagacctaaagtcattttatgatcagcacatccacattccacacaaggtcttaatctgtatgggaatagaattcagactggtgagcaaactcatcaagtgctttagattgacacttttagttagaagttgttgctgctcaaattttggtctgtggctcagcagctttcttatcccctcgtagcttgtgaaaaatgcagactatgggctcccatctcacacttgctgaaccatctccaggtgactcgtaagcacattaaagtttaagaagcgctgcgttcaaccctggagactcagttgaattatttttttaaagtcccatgtgggttaggattggagttggaactagtaagatggtttgaaggattaggcagcactgcccagcgccttctcatgcatgatgtctgtgcatcccttgcatatttgctcccttctcctctgtagacacattggcattgttcacacctagaattcctgcttggccatgacactggcctgacatggtccaactctgcctcgtgacacctatatcagttgggatactttttccagtaaaatgatgtaaacaataacaagatagaccactaacaagatgtccagaagacagacagtcccagggttaaataagtggctctgagtgacctcatgggtactggttcttcccatcttttttctttgccatcctcaaggggtggtttttgctcaggcacatcccataacagttgcaagatggccactagaactgcaggcaacatgtccttacaagacacaactatacaactgtgtgcagaggtagagaatcatttctttagtatgtttttgttgtttttaatcaggagggaaactctctgcaaccccctagcagacttcccatttagctgcagtggccagaatttgttcacctgtgcataccctagctgcaagggaggctgggaaagcaagtattggcacttccacctgccatagagggaggtggcctctgtcagaaaagaatgatgatagagtgggggaaagtggccctcaggaagacagctcagagtgactgccacagacttctgttaggtttgagtttactcttgttggctgacaaattctttccatgttttctcaatatgttttctttttaaactcaagtttctaaggaaaaggatctgattgacccagttaattatttttgagcgaagtcctccagatcaatgaagaagcgttaagtgtaaaagaaatagacattaaagacttttaatttattcacaagctatggatgcacaccttaggtccagtgtctaccccagagtgaatcaactgttagcagaggggagggattacatagtgggaaatgtatcttgtactgctgctgctcatctgggactgcagatcttctggcactggagcatctgtggtccatcagaagaatgggctgctgagaagcaggggtagatgtggaggagtggtccatagttagaataggacaaatagcagactagtcctgggctctctatgtcttacatgaaaagggcactcctagtcctagtgcctcctattgggtagctgtttctttgtggtagggctggttcctcttcttctgggtcctggcagagctaaagcacagctgggccagcacagttggcagaagtaggagtgctgttggccaggactttgcctggagatgggtataaaacagaggcgactagttctaaagcccaagtggagcagacctgcccaggagtcagtggcactgggttaagtgagtttcccatgctctggagtctaaactagcatcctgctccttggtaagtataatgaggagaagtgggctctgggcctagaagggcatgtgcaaggctttcttaatggggataccctctggggcctcagtggggcaaggaacaaagggcttggattcccttggtctaggagcagtatttcctctggaaagttggtgaatgaggaccttgtatagagggtgtcttggggtctaagatgggctgggacctggcctgcagaggaagcatcagggaggctgtcctgcctgtggtgcagcagagcagtgttaccctcaggagatgggaaggtagtcctttacaactggaagacacagccaagctcagggtcagtgctcatggaggatgaagctgaggccctggctggaaggctgaggcagctcttttgtgatgggaacagagctgagttctagaaaaggggcagcctcctccttctctgtttactatggtgaaatgtaggatgatgccctcgggagggtgtggttatttcagttcaggagccccagaaccccacaggtggtcctgaagcccagaaagggaagcagtgctcatcagtggccctggcatatgctggcatgtaatcatcagtggccctggcatgtggtacctggcccaggcaagaaggacccggtacaactgtgaccacttccaggattttggctgtgccttgagtggggctttcccatggtctgaaaggggtgtctctacccctccacacctgcttggcttggctggtggttagtggcatagatctttggctaggttgggtggtggaaaccttagacaggatagccagtcagattcagatgggctctacagggctggggatagccagttagctgggaggagtagacctaggctgatacacagtgttgattcgtgtcccaggtctttgggtgacgcccagaagataccagagccagcagagtctccatatgaagtagccatgggtgcttctctaacagtatgttatgtacacccttcatctcctaccagccagccagtctgttctgctgtttaatacattgggtatgggccaaggagattcttggtgaagtttcaagatgaagccagagaaagggcaggcaaacccagcagcaaagtgaaggcaagtcaaggaagagctcaggctccagggtgaggggtggtgcttggcagagaacccacagaagggctgtatgtactctaggccctgtttggaactggggtacatggagtaggcttggccatccaataggaacccaggcttttctttgcaaggtctcaagagtcctggtcagtgtgcttgagcaggtgaaagcagattgaaccagggtgagggagtatggaaggtaggaaggagttaaaaggccagggttctaccctggctctaccactcatgagcctcttcttcacttctgtgggactcagtttccctactggaaatgacagctgagtttgaaagtgtctgcaagatctggccaagcattccaattctgcagtttgttctgggggctatatggagtggtctctttgtaagcaccagcctttgcctccctcagtcttgacctcttgggttccaaagtgtggagacaggttaggaacctctcagtttactgctgcccttatgttagagcttgatggaggcccacatctcaacagtggagaggcaaatctgtttaccatattgaaaaacctgaagagttgctctcctgaatgagcagcctctgctggccccagctgggataagtgctcacctctgatagcccagcagtcagttcaggtgccctcagttacctttttaactagtttcccaagaaacaaagaaacccagacccaggctggggagcacagccacccccccttctcagctccaaaccaccttgtcacagatggcggtttcttcagctcccagctcctcaaacaaagcccatacattcctgccagattcagcttgcaatctttcattctgtccaagaagcaaatctgtttaccatattgaaaagctagaggagttgcaaaaaaaaaagtggagagaaaaagctgttttatgaattataaaatgtgagcttgaatttttttaccatgggattcatttctgtatctccagaatggaaaacaaaagatagtcaggatacgtgtgtgttgaacatttcaattttgaaaagttacagaaggagttttgtaggtaaaccttttcctctggatcttagaggagggaaaatttggtgcttatttttcaagaaaaaaagtagagcctgtgtgagccgatttccagcatgttttcttacctcccctgtgacaggtgtgaacttgagtgagagatgagaaaggagtaggtgtgtccgtgctttctttctgcgctcagctcccaaggggctcctgggccgggctcaggtggcatcagtggtggttctttgtccctgtgcagtgctggaagaagccactaggtgggagtcagggacaaatgctgggaagtgaaatcccaaagaatgaggtcagcatgggcttcatatgagaaaacagcttttaatttttctttttcagacaaagataacataagcacctctcattattgaaactgcttaactgcacctgggtcagctggcaaagataattctttgccattttccttagaaacagtggacaaagggcagtcaagagagggctccactgtttagggtgggggagaagagacagggctggtcctgggatcatagacctgaccttcccctgtggatgtggggagacctctccagacttcttgactgcagtgccttctgctggggtgctagtaggttggccccttccattcctgcaggcatttcctagcccacagtttatgtcacgccctgccctagagaagcttcctgtcccctgggggattttgaatgcccttttcctgacacagcagccaagactgggggccttcagccactgcaaatttagcagtttcaattttcctggatcttgatccctgccccccaaagtaaatttaccctactaaattctagcaatccggctcctttcagacctgacctaaagagactatttcagcctctaagaaccaatgtttataaatgaccaagaatgtgcaaacactggtgaaagagcaaataaatccttccccactatatttcctgcttcaggcccaggggccgtggtggacagtgttgccaggttagcataacttgaggtctgagcacgtagacacccacttaccctccacctacaaaagaaaatcctgccagagatacactaccaagagccttctgccctttcagatacctgctagtgggcaggcaggctccagggaatttatgcttctaggcaagtttgtttagtaatctatgtttcgaagaatgttttgtttgttttgttttgttttgttttttgagacggagttttactcttattgcccaggctggagtgcaatagtgtgatattggctcactgcaatctccacctcccaggttcaagcaattctcctgccccagcctcccgattagctgggattgcagttgtgcaccaccacacccggctaatttttgtatttttcgtagagacggtgtttcaccaggttgacgaggctgatcttgaactcctgacctcaggtgatctgcccacctcagcctccgaaagtgctgggaatacaggcatgagccaccatacctggccttgaggaacttttgaaagcggtttcctaacttcttactcctccaagtgttgtcctgggaccagtagtacgagcatcacctgggagcttgtcagcagtgcacaacagcaggccccatacccaatctactgaaccagaatctgcatttttactagaaccccctcaggtccaggcagttcattctggatggggaagcactgtcctaacccagggattagcaaaccatggcccacagttagcccactgcatatttcttacactcatcagctaagaatgatttttacatttttcaagactgaagaaaaatcacaagaatgttttgagatgggaaaataatataaaattcacattttggtgtccataaataaagttttactagtacacagccacacactggtttaggtattggctgtggctgcttttgcactgcaaataggagagttgagtatgagatagactacatggcccaccaaacccaaatatttgccatctggcgctttacaggaaaagtctgccgacctttgtactgatctattttggaggtgcattctccatgcatgtgttctgtggaggcttgagctgcagtggccaggacttcctccacagcactcttcactcccttcccccgcctccccttctcagcgggcccactgtgcaccatgtctgttgaaggacacaagtttacatctgacttatgaggatttatgagggagtgtcctggcagctgccacctatggcccagaggtgaaggctcagggctgagcggagcccaggatgcctgtaggtgataggtcagtggaacagcacgtgaccatgagattcctctcagtttacagttctgcctgataagatgctgctgatttctggtaggcagcaggagtaacacctcagggggcctcagctcctttttcagccattccctcaagtacttggaattccagccaggtaggtggcaatcctggggttctcttctagaccctaggacaggggtggagcaagctacagtgactttccccggcaaacctgaccaccctggcctcttagctgtgtttttactcccagaatgctcagcctcacagtctcctgcccttttcccacagctggctgctgcatgttgcaggcagtaatgaatctgtttgtagatgagcaaagtacttccaggaaggccttcgggactgttaggtcactgtagtgacccgtatttgtgtaccctttgtgcttcctgaggacttctgtcttcagagaggggtccagtgagtctgagacaccacctcacaggagcagtataatgggagcagcaagcccaggcccccgagctcccaataacaaggggagcctagacctttgggagtaactacctcggccaattaaaagctgggcttctagccttttgggagtcatggactgttctgataatctgacaactctttttcagataaagatttatgaatacaaatagtagtactttctatatatttgacgaacatatttaggggctcatctgatccctggaatcccatctgtaaatcaagtgaggtgccctggacaggatggacttctagggcagtggtgcagccatgggtttgccttgccaggccagtgtgatgagggagccacgacagggacccagctgcccctgggggtggggtgagtgagcgaggaggtgccttagcttctgaatccatcccatttcactcagcccttcccctttccctcctgccaacctgctcctaggtcttttggggtgttaatttgtgatttttgagttgaattacaacgtaagtaaaatgtacttggtgtttaaggaaaaacaaggctgagataagacttgctacttgagaatgccataaaaatgtcaagaatttagctgcagtttatctggattcttccctcccttcctcccttttctgtccctttctctcccctaccctgcaccccccacctttgttcatcacacattgagttgagctaacagaggaaatgggccccgtcttttcctttttgtgtcgaacatctttaccctggagaaacggaccttcaagtctctttccttcacatagaattttagtcttactttaccagtcttatcatttgagccttattctttcatccaaaaaatgtttaaattcgtactgtgtgctaagaattgtaggcatggaagtaggagaagtgagttggaaatcagacacacttctgacagtctggtgcaataggagtggtccagtgtgacaaggtcagtgatgaagtagagaggggaatttaggtgctcaggaagggatagaagagggacacctgagccacagctctatgtaagctgggagtgagcaaggctgatgagagcagccacattggccacctttctcttttctcttttctcctctcttgtaccagaacctaaggaagagcactgcactcctcccaggagaggggagaattttccaccatcctgtagaggctggaaccttgcgccacctctccctgtccagctcccaaatcagcttgtctacctcctcttccttggagtcccagatatacctttattgcataccatatgataattcttaacccagggcatgaagtttttcatttgccttggatgcggggaaaatgtgtattgactggatgaatttcttcatttgacttgttcaggcttttagacagagaaaaaccaacctactgacccctgtacctttagagatgttcttccttggcaacatcctgccatagcacgggcagggaacctgggctgggtgggtcacactgtgctgtggagcagggccagaggtgaggagcaaggggctagagctcagcgcatgggcagcaaagcctgcttttcctttctggcctctgtctgggtgtgtctccaggaatttactcctccccttatgccagctgctggctagagctctcctccttgccgcctctgtgatctctgtgggctggcccagcctgccggggactgtgctgccaggcattgtttctccccttttgggccctgcttctggccctggtggacattgaagccatgctgaggggcatgcggcatgaggggcatgaaggactgctcttcagactgggagttccaggaaaccccggaggtgacccccaagggaactgggaaggcccaggcagtcacaagctgtgcatctgcaagtcctttgccacagcagagctcggggccttgcgtgtaaccacagttcccaccgtgtaaccacagttcccaccgcacccacatcaaaggtcactttgataatcagccatagccaaaggccacacattaagggctggggaagggagaaaagctgtttttagtggggagctctcaaaggagatgggaataggaggaggtggggggtggcatctagggagtgctggaggggccacctggagagcctgcatgtgacctgccctgaaaggaggaaaacagctgcagctccaggtctccgccagcctttccaaggcccctgtctacccagcactgctccctgagtctcatggaaatgcacgtgaagcagcctcaacctttccacctccttggtttgtaaagcaggtagcccagagtgggggacagccagagaggcaggaccctccagccctggcccctgttcagaatgtggcccccagggtgccctggctggtggccaacagtccagggccagactcccctgagtttgcggcagttggtctctaatggatggtaccaccagtgccaaggacagcaaacgctctgtgctgggcccgtcgcacagcaggaccaagaacccagactggagctgcttttttttggaaacaacaggctttcctcagggcacagcccgtcactcgcctggaaaatgggtgggcgtgggcttcagggcgggggtcaggctgtgtgtgggaaccagtgagctcctccaagagcagcacttatttttagtcttctccccagtcccaaataaactgagagcagctgggagccctgggtaaatgcagagtgaagcagagacaggaaatcggggctctcagtaatgagttccagccactccagaagggggaagccagacaaggaattttcttcaggactgtttccctctggcaggctccggtattatcactgagaatggtcccgtgtgtgtgtgcgtgtgtgtcatgtttacaacttctgtccaagtcttctttcttttttctctacctttgtgtgacatttgatttctccgcagggctctgaatcccagtcctggtgcgtgtgcgtgcatgtatgtgcgtgtgtgtgtgtgtgtgtgtgtgtgtgtgtgtttgttggggtggtcggggaggacactgaagcagcacggtctgctctgtgtcgctgtgtgtctgaaactgtctagggagaggctgaaggacgcaggccagggaagtggggaaatttgaacacagcttggagttcttgaggggggagggggcagaggcaaggaagaggagagaactggtctccagccaggaaaagggctttttccaccaaggcatctaactgctgacatgggtgcccagcatggatggggacattgatgtttacaagcatttctcgtggctgaagagggtaagtgactggctgctttgtctgggtctccgtggagataagtgagggggagacgctttggggtgttttggggtgtgtgtgcctgtgtgtggtagggggaggtattgtccagcaaagccctgctgtggccaagttcttcatgagaatctaattatagacaccagggagaaaacagtcagctgtctttgtttctccactgacattctagtgaatgagcctctgtacagaaaggcaagaatggagtgaggaaagttggttattttaactttggcacctaaacagtcagaggctccaaacaccgtgaccagaagaatgtgcccaccgcttttcagtttgaggacacagggaggaagctgctgcctttttaaatgcattggattcggaagttgtttaactcgttctcactctgatgttatccggtggagcacacatctgctgtcagcagaatgagcttctgcatttccggaggaaagctttcagggagttctctttgaatgctctgaagctgagggtttatgttgcaagttgttcatgccctttctttagaggataaacctgagtgtgtggtatgagcaaggaatgaacggacgttgggggctggagtagcatcatactcctagaattcaggctgtttcctcttttgtggctgcctttaaattggctaagataggtatgaatttattttcacacgaagggattttaggctgagtgtttttcagaggcaggaagggcaaaagcagctgacaggttagagatttgacattgtaactgcagaaggacagaagaaccaggaagtgtccagcttggaaggggcatgcagatgcccggaccccgactcccggacactgagctggctggcttttgtgtgagtgcagcagcactcattcagcaaatctgtactgagtttgggtactgggtgtatagtagtgagcaaaatagaaccagcctcttgtggatcttctacctaatactggagatgtaggtgaaacagtcccaggaaataaacctcagattacaaacaataagtgtgcctggaggaagaacagaagacacgggactgctgttttgatggagaagggggttggggcggtcagggagtttgaggaaattatacttcgctgaaaactgaaagagcagtaagaatgagtcaggtgaagaatggggtgaagaacattccaggcaaatggggcataggggatgatgtatatacaaaggtcctaaagcaagatggagtctgctgattgtccagattgagagagagcccatgtggctgagcacagtgatggcagacagaggcgggcagaggctgggatcacgcaggacagtgaaggccacggtaaggcttttgggcaacctggtttgtgtgctgggggacttgtagcagggaagtgacatgggatacattggggggggtctagtttgtattttaagaaaattactctagctgtgatgtggtatatggtaagctatgttgggaaaagtgaggcaactgaacacaattatagggctggagggcttggagggatgggatagtacaaacccctcatttaacaaagcccaagaggggctaagaacctcatggtattagtgtcatagctattagtggtgcagcctggtcttgaaccctgttctctatctcccagtctagttctctttattcattttctctgccaaatatgtataaaattattgctttagaacccagcagaaatcctgtctgtgcccagcccctagggcatcacagtcaccagaaagcatgctgagatgaccagacgttttggcaaaggtttgcatcatcttaggttttttttttaagccccactggggagatactgaaaggaaatatgtaagaaatgcactgaccatcacttggtccttctttccctgtatcccaaatgaagcttttaatcaagaaatcctttcagccaacatgtgcctgggattgtcagagccttgtcccagcccctggggcagatactgtaactctgcctgctacaggagaagttatgtgtgtggaggaactaattttgcatgtgatgcaatgtaagaaggcccttcttgtcccaagacccagggtatgctggctcctgtggacagttggaagtttgcttagggaaactttaagcaaggagactttagaaacccccaggatgactcatagcaaaacagatatttttcttctacttttagaattttaaagagcattttacaaaagcaaaactcaaagtgtagacatgtcattggcagtgtgataagagtattttcactattctctaccctaaacactactgccagatttttaaaatcttcttaaaaaaaaaaacaaaaaaaacaaattccctttcgtcctgtgaccccagtgatgagcccccctggactcacccttaatctggaagaaaaatcaggcccttcggcttgcttggcctttgagaccattagcagcccaacctcaacttacctttttagttttatcttttatatctaccctgatgagctcccaagtgtatttcttcccttttctgagcttttaccacagatgaccacctcctctctaactctcatccacttcaactgactccatccaggctgtcttttcccaggaaacctctgctggccctccctccccacctcctgtagcccaggtctgcagcacttcccatctgcatggctcacccaccctttctcctgtgcttcagctgaggtggtgtggagagctggtttctctgaactcatgcttttgaaggtagaaacactatcgtcttcattctcctttacagagggcatagattctggaagaagaggttcctggtgccagagcaggagcccttgccctttgagcagtccaaggtggtggtgtctcagggcaaaggggagatacttatgttcagagaggcatggagctggaggggaaatatttgctcagaaaagaaatcttgctccagggcctgtgtgggatgggatagtatatactattaatattacagttaagaacatggagtctggagtgaggcctgaattagaatcctggcattgccacgtttaccagctgtgtgatccaaggtaaattatctcaaaagtctggatttctttaactataaaataagggagataatagtacctaccacatacaggctttatgaggactcagtaagatagtacgattagtgcagtatcatgcatgtaggaaatactcaataacatgcttgctattaactgctattggtgattatcaggaagggagaagttgaaagaggaacagatggaaccaggttctctcctagaattgcctctcaggccattcagtgcttcagctttatgacccttcccatactccagatcaaggtctcaaaccaagcatattgaagacctagaaaaggcagctgcaacctgggccaccataggtgaccagaggcctcattggctgctggatctggccagcttggctgtggttgctgagtgaaggctgatcagggctgatgctctagttcattctcctaacagacaaagcctagggataaggtagtctcttgccacaagtatccagagggactcagtcacaaacagctcacacctgttctacattgagtccagtggatccaacccacacaaccatgaacacacctctaaaaatagctccgagcagggtctgtgggacccacccactgctctttcggcaagagttcattttcccaggaacagaaatcccagactgtcagcatcttcacactgcttcctggcttccagcactctcagtgcttaagcaaattccaactgtaggtcacaaagaaaatggaatcactacaggtcccccatgcagttggctcaggttctgcagtaaaaagtggaattaactcaagctgctaatgtgagactttattctgtgtcatctggtgctcaaatggttgatctagtagcctggccacttgggccagaagagctgcaaaggcagacacggaggtctcctcactccagacactgacttgccttgcattcatgttggactgcagtgaaagttacagaaataggcagcagcttctgtgaaggctgttcctactagttaagagcatggatcctggatctagattccttgggctcatatctcacctctgtgtagacttgggcaatttatttaaccttcctagaattcaatttccttgattatatatatggataaacaattctatagatagatagatagatagatttttttttttttgagacagagtctaggtctgtcacccaggctggagtgcagtggcacaatcttggctcacttcaacctccttctcctagcttcaagcgattctcctgcctcagcctcccgagtagctgggattacaggcatacaccgccatgcccagctaattttttgtatttttagtagagatggggttttgccatgttagccagtctggtctcgaactcctgatctcagatgatgcgcccgcctcagcctcccaaagtgctgggattacaggcgtgagccaccgtgcccagccaattcaatgtatgttaagtgcttaggaagcactttataagtgttagagttatggggaggatgacatcgatcagaactgacaacctctggttactcgggagccaggtacccaaccttgattctgaaaagagaggtttttcaatcctatgggaaaggcaacagtggatatggtcacccaagggcactagcttcctcaatttcctatgatacctcctatttctggccaacacacccgagatgcctgtacattatgtttcctggtataatttagaagctagaattctgccatctctgacatccagcacctgtaactcctgccagctccttgaagagaggcctcttttacccagtgggatttaacaaactggcatcacaccagggtcatttgctgaacaacttgtgggcactacagagcagcacagccattgttggttttgtggactggcagcagcacttagggatcctttgactcatccctgcttttctctgtcccttcctccatagcagctctttcacacttttccattagtcttcaaccttatactcccctttcaactgatgtcactaccaatgtcataggaaaaaaaaaaaaaaaccagccaaactgagatgagtctcttcaccctccctccctttcaccgcaaaatgtaactgtatttcagcatcctgtttcatgggccaggagtcccttctctcagccaaggctatcccagtatcctgtccttgacccaatcctgttccagctcctcttgttgctctgattgtttcttctctcagctcctccctgcctatctgtcccttgcccttggtggaaaatgcttctcctcaattctcagggaaaaaacaaatcaaaactatctttgaccctgtgcttgtctcttcatgctgccttataacttaccttcctttcactgttaagattcttggtgagttgttagcctgctcgttcatctctactccctcctggtcactcctgaagccagtgagcactaactttgttcctatagtcatcttttaaattccttctgtaatgttatttttgctgcctctagttcccaggcaatcttccccatacattttcctttgtattcatttccatttggaaatcttgtaggattaatggcattcttgtgacccgaggagcagctccttactttggctcttgcctaattctgtgttctcaaactttggatctttcatgccgaagagacaccaggctctaaagcctccaggggagctaagacagtcacagcgcccactccaccctaactgtagcacccagtcctgctgcactgtctctgaaggtgttttcagtaataatgactcagtgcatctattggagttggcaaggtgaggacagtcttcaaagagtcttctctttttactctcctcctggctttcacatcctctcattacaggataccagcacacatacaaatgctatttctgcagcccagtgctgtaagctttttatgtgtccagctaccagataaagagaatttagcagtgaccaagctcagccaaggttataattttggggaaaaaaaaaatcttggtaaatgtgtttctctacaaatctagctccccaggaagatcagttaggagcttcatcccagccccttggttggagagctgatggccagtttatcttcagggtgtcctgtgtttgctatgttagttctggaagaccagaatatctgaagggtagtgattgtcatagcttcatgggtagcatgtctgtattgggaaggctatttccaaagctgctgttctcacattctcctaggggtattcctttaaagccttcagactcaatcattcaaatggtgcctccactgtaaagcctcttctctcttttgaaggtgaaatgtttttgtctctcctctatgcccctgccattcatgtgcatacaactctttatgatagtacttattacatcctgctgcaaaggttgatttcttttttccttctgtccttattccctgtaatactacagagctttttaagggcagggactaaatcattgtttagcacagaaagtggcacctagtgggtgctcaggattattcaagtcatttcataaatacattcatgacgtgtgatgatgtgaacattggtcaaccaagaagctatttatttgctgtttatgaactctgctttgttcttccttaaaagaggacatttagatcattggatgatagcctcatcagcaatacttaacctccccttatatataattgaggggaggagggaataagggtcaaggtcaggataggctttctcttgttggactcctggtagccgaggatctgactgcactctattcacattgcatttggaagaaatttctttaacactgtgacaaagatggtagattggcttgaccgttcttcacctagaaaaagcagaactggtcctgggaatactcaggtttataataaatgccagaaagccctaaaactccttaataaaaaaatctaggggaagttttcttttttataagaacctgcctacactcatactactgggttcccttggtgttgggtaaccagagtcctgtaacaggaattgactgtagcttttgtgatccaatcatttttgtttatttatttattttggtccccttacttttaaggtttatgtcttctaagtttctaaaaggggttgcatgtgagtggtgcttctgagcttaagatatagccttagtaactttgatatctcccctgatgccctgtgcctggcagctatggttcacttgtaactagttttctggattttgataagatcctcttgactaggcagcctggaaacactacacattttcttttgttttcttattcagctaaaaatacatgtcatctaaatggctaaataaggaagaaccattttaaggcttatccaggacaaggcttacccaacgtgctgtgttcaaaatctcagcgtatttacaggcaaagagccatcatataatttaacatgctctgaccagttgggacagtgtatgtactgtggccaagatcctgaaggcactggaatttatagcttattagaagcactgaaggaaatgtaactctttacctggccaagatgacaactattgatatcaaaaaaaggaaggcagatgcattttgaggatcccaaggcaagagctctgagaagcaactgttggcttcaaaaaccaacatgatgctagagctgtcacactggggagccgactgttttaggttttcccacactccttacttgtataccaatgacacccctgttgtgatctagcccttgccccatttgactactctggaaccaactccttcccctagttcaatgaagtacagtgccagcaggaagtctcctgggtcatgccagttggggagtgctacagaactgccctcatccagcatccctgaggtgtaccagagcacatgtgaagagtgtgttctccttgcaaatggccagccaggccataaagcagtcatgctgcccaccacaaatctgcaggaccccagccatggcatcaagcactcaccctgtctagagctccaaggagagactaacatggctatcccttggccaagctacagtggaagggctaggccaggagagagcattgtcatagatctgaacagccactgcagtcagagggtgatgtctttgaggaggccgctgggggttaacttggctgaaaagttcatgtttaacccaaatttgaactaacctctagattggaacagaaataaaaacccaagtgtttatgattggttattactagctataaaaattcccagtgtactcattataaacatgtatgtagcacataatacttagagtacacaataaaacacttgtacgaaagaaaaatatgtggccatgaatgtatgactcaaaaatgtgagcacttgttcagggatagtggagaagtgaactcatctttggcaatgtggcccaaagacatgatcccagggctattagctaatggtgggttctgcgttgtcactgtcacagaggctttctttttgttttgttttttcatttcaagcctgaaagtattttggttattgttcccttgggttgtttgtacagatcttcatagatatttcttaggcatcctgatcagaaatattgcccctgttgttctcttacacaaaaagagtgaattaattaaaactttttgtagaaggcattaaatgatgccttctaactcatgcttctaactgaatgttggtcttttagattaaacaaagctaaatcatttataagttagctaaattcatttgttaaattataatttaaaaatcatttccatattcctatgattattcaaaaactgtttatatcacacaggaatttttagagcaccctactataaagagcactctgtagttttagtgccacacgttttcaggtatgctgacctaacttgaccctttctgttgctccgtgaagcatgattttttctattgaaaggatggaaagcctgagatgaggtaacctacttgagattacacatggttaggtgcagccccagcctcctaattattcttggtttgtcctctttctgcagagaaggtggtcccttggggaggaggatgcaataggaattctgtaaatgaatatggaagcaccacaagaaagtccccagggatcccctgacttgaagttcagctgggccaaatgaggggaacagggaacccagagctctcagcctcccagcgcccagacctggcatttgtacagctgtgtctgacatgtaattctttcgacataacttcttaaacagttgttagatctatttctgttatttacccttcatttattcattttctgattcattttctgataatatcttttagactttagctcctgtttatttcttgttttgtttgaacttactttttcatatcacacatcctgctccccacctccaccaaccccggttgatgcccatgggcctgttgcatcttgtattcattccctgtcttaacctttttgctctacatgggaaataagaatggaagcaaacaggtggtggatagaaagccatctattccacacacaaaggacactgagtgccctttttatcctagtacatcccacacagacactccctgtgccacaaagtagatctcaattagcccctgatgataatcctggtttgaactatagttggcttaggactgacagccctgtcttaaaaattgccactttaagcaaatcaagcaatagtggcagaattcctttgcaattcagaactatatccaaatagcaggaattctttcctacaagtctgtttccaaaggagtaaattttagtcagttgatcaccttttgagacaaatgtattaaccagaacttttggttgcaaataacagaaactcagtttgaactaggccaagagggaaccaacaggaagggctggaatatatctctgcctttaggcagcgtgcaccggggatgagaatgcctccagtctttttcttggcttttgtttgcttttctgtgcacactgggttcatagctgtctcttgctgcaaaccagctttttccacgtggagcaggacatggccactgacaacctcagaactgtggcaccaccactaccatgctctgttcccaagtttaaaaattcagaggaaggatttcaacaagtcaagcctggatcaagtggcagggagatgaggatctttctaagaagatggcagccctcatttataccacataattacagtaaaggcgatgatctcagcctagtctacacaaacaatagattccattaaagcagggtgctgattctctgccaagactgatacaagtcttctctgtttcttttccttagcaagaaaacaaggggaacaatttggctgatctagggttcgccacaattcatggtgaagtttcttttttggacctgacatatcccctgaaaaatctcatccctaaaatgcaatgttctccaaggtgcagaaatcttgatttctttgagtatgccagcaaccagctctctgtgcatgaggaacttatcaagagtaaatttcttactcagtgaccaaggggagggatgggagaggtagggacaggacctggtttaggttaggctagtatcattgtacggtccaaactgccccttatgtggggacttaactatccctgctggaatcttgctggtcagtcagtcctctccctcctggctactcacagttctctctctgtcctctccctgctgaggctgattgactatcatgatcaactccaggatcccaaccatagaataccctgcacagctgatacattttcctgaggcccctctcagttagggatggcttagaaaatacccacaccttaggctgttaattgctcaagctgcacattaggcttgcccagccacggcagtggtagcagtttgggtcttacagaaacagaccctaggataacctgtaagaatcaaggaggtgtgttgtcactgtttctgaagacactctggaatattactcccaaggcctagggaagaccttgatatgacaactctgtgctgtgttttatatttgcctccgcgaggtctgaattttagaggatgaattccttgtgtccaagacttttttcagcctcttgagagcaacacttgatagacacaaaggtggcttggcttcaatgatcttgactaagggtgctgagttcttaaaaatatccattcgagaagcccttgtcttgattcagttccgtgatataggagaggtagtatgtttcactgtggcattctttagtcaaaattgaagaggatgtggaaatgtctggagttaacagttctccacagggcacacagatcacatggttctcactatatttttaggtaactaacctgaattacagtatcagaaatagctctgaccatttgaatgaatggtctgaaaatttgaatgagaagattgacttttccctgtcacatttgtagcaataaccatcagaacagagggggaggaagtttgatcaaatatatgtaacacagcttaccattggcaggtctagcctagtggctaatgtcattggttgagtaaaaattagctctttcttatattcatctgtggattgagcatccttaacaagtataacgggggtggatgatactctcctttatagtcacttgccatcccacagtggggaacaatagaaaattagcatgtaggccaggcacggtggctcatgcctgtaatctcagcactttgggaggccaaggtgggcagatcacaaggtcaagagattgagactatcctggccaacgtggtgaaaccccatctctaccaaaaatacaaaaaattagctgggcatggtggtgcatgcctgtagacccagctactcaagaggctgaggcaggaggatcgcttgaacccaggaggcagaggttgcagtgagcctagatcgcaccactgcactccagcctggtgacagaacaagactctgtctcaaaaagaacaaccccctcccaaaaaaaaaaaaacctcagaaaattagcacgtagcatccttcagaatttgattggactttcttctctgtgaaatgtgggcatggtttttgcaacctgacttcatgcgtggagagctgggcaactgctctatcgctgacttacctaatcaggaacatggacaagacttttcagagacacctcaaacctggaatcatgcagggatccactatccatccaagccttctatttgcaattccactattaaagaagcaggtatacttgttgaccaagcaagctgtctttaaagtagagcaaaacagagatgtgtcctaactcagtcttttaaaatatttttctcaataaattggaatcccattttgataaccacaaagcttattatgccttgatgatgtagtcattttataatgcaagaatgataccagaacgtgattgaacctgttgccaggttataagaatacagaatatacagattcacccaaaggcaaatccttaccttaggctgatgagtattagcattcagcaagacaatcctcttcttggccctgttctcagatgctttccaagtttttctccaggcagaggtggcatttgatcctggcctatgcccttctgaagaacgcagttttttttaacatcctagtcctatatagatcatgaaaacacatggctctgacttcatcaaaagcaaaggatagtgatactgtgggtttccatctggaacattatctttcactgctgtttacctttaaaaagcttgctggagaacggtgattttgaaggacctgtagaagaggaagatgcactgttcctctagaacagtgattggggtgggggagggacctgtctgccatgcacaccactgctgtatggaccagtatgcctgctaggaaaggagttggctcctcgaatctgttataggaggggcaaatatgaggaaccactgttctaggtcctctaacagtgcttctagattttcaaatatattttaattactcaatagaaacattttgtaagaaactcaaacattatgtcaaagtgctctgaacagtgcctggcacatgttgagcacaaggtgcttgctgtgtatttacagcactgtgcctggaccatattatattagtctccatggaattgctttcacctttggcccatattgtccactagcctctgaactattctgagaacatcacacaaaagtaatgagttctactgggctctgtttactataagggtgtcatggatattgctgatcccatcacacaaaatctgtctatgaaaacgtgaagtttctcccttgctccggaataattatgcttctcctaggcaattgatttgattttaccatactgatctgcggatcctgttaactgattgtgcctctctttttttactggctgctagcgtggatctagatttttgatcccccttctagcatgtgctatagaatctaggtcatacattttattaactgaatttatgatttcaactttcttactcttttttttgtcaactagtaaaaatagttacctctctgggtgattgtatgggtagaccttttattataatgaagaatatactgcacaccatttgaataaggcatagttggtacagtggcttgctggagtctctggaagaagtcttgcctttggtcttctctccttcatttcctgccagagaatgggcggctgccagtgctaggtggctccgtgtccatgtggacttcggcactggggttctacctgcagagcttcacttggacacctgggtcctgtttaattctctgtccactggaaatcaccatcatgtgagttctttgacagagaagaagttgacctgctattaagaattattctcctaccttttcttctctggttctgagaaaatatagattataatatattcttggattctagtcagagaatttgatcatgtgagaaccggaatattaatttaacaacaataaactgccattaacaaagaagtcagttgtgattgttaaggttctttgtctgtggcatgaaagagcttccataacaatgaacaagacataggctccagaggggctggagcagaagacagtggtgtggcagcaggtgctgcctggcacagctggcctggggagtggcccctgggcctgtcctctggctgcaccttcaacaaacaatcaatgaatctttcactagtgcgcatccagggtttgaatgcggtatgcttggtccacatttctgttctaggactgggcatggctctgttgcctccctcacctatgcagtgcattgggaaggggtgggatgaggggaggaaggaggtgccttttctcatggagggtggtgggagagcccatgctaaaagttgaaatgtggggaaatggcctaggacaaggtggcccaactctgggtctctcacatctgcctctttgcacaattaagactttcctctagggtggtagacacctccctcgtgaatattgaagtgctgatttcactggaccagctcagattgtataatactcagttccacatttagcaatcagatctactttttcaaactgccaagcctctgggtggcctattgcagaccagtctgatttcagtcttccatttgcatggaggaaggaggtgttggggccagcttggtgacattagctccttctctcctgtctgcccacaaccaggtcagacacacccaagaaagtgacacctcctttctctgcttgggacatttgtaagattctgcctctcctctgacatttcacatcctctccctttcctctcttttctatagtttctggctacctgtaatttccttagcttttgctctggcatccctctggctattatttaagttcttctcaagatgttttgtcttagcttgcttctctcagctctagcactggggaaatgtgatctgccagcctggctaccaaagctcttattggagggtgggattggggtgggaagggacgtgtgaatgaagggccttgtagttgacatcctccatccttcatgctcactgtgatgttcaggatgggcctccatgcagcaaggtgtgccttggcttcaggggaccctggcatgagaattaggagataccaagatctgtgcagaagctgttcccatgtagtcccttggagaacggtgccagctctccaatctcctcaaagagcagaccctcattgtcgccatgcctctggaggctgtgcctctggctaacccagacccagcatgtcaagtcaagcactgctgggcctagagtttcacagaggccctcctggccaggagtgaggtcatccaggaggtggttgtgccaacttccagggcgcacttttcagtggcatgtgatctggttctcctcatggtagttttgaaatcttgtggtttcctgttttgatgattggttttgtacatataatcagtgaaactatcctcacaaattacatgcatcccttatttcatttagaagttggtaagatgtttttccaaccttttaagtgtattcttttttttctgtcctctttagtcccaggtaaaccaccacagtgctgctagtaatgaaacctaccaggaacgcttggcacgtctagaaggggataaggagtccctcatattgcaggtgggtactttttggtgagaatcggcttatcctgttacctcctactatgtagcttcccctaagtggaagggaagcccaagagattttctctgttggaatttttctccttccaatgcctatgtttttagaaaagacttttcctgaaataaaacattaagtaactgaggggacaatttaactctagacttggcttaggggggctgtgaattcagtcattcatttatcatgcactcccaagcacccgcttctatacactggcagccccatgaccaggctgatttccaggtgctaagaatgaacaaaatgggccctgtcccccagaagctcctgagtcttgcgagggaggggagatatatcctcatgccactaataaaacagagctgtgggtgatacaggcctaagggtgaatgctaatgaatcaagtccaaattgtctgaagctggatctagactgatccctttaatgccaaatcccctggagctggtaacaggggctaagcctttgatagctgtcttgcttgaaagagaggagctccaaaaccttttacggagaaagatcatcaagggagctttttcgctgttgaaagtttgtgtgccttggtaggacatagagttaggtattctcataagaaggctgttgaagaagcaggcccagcactttgctgtgttagctcttgaaaatataaattgattaagcaagcatttactcaaggtctggtatgcatcagatattaattagtgatttggaaaatataaaggctagtatcctaatcccagctccttaaaagcttaaagggtgatgagttagactggtggtagaatgaagggaggggttgagcggggcctggaacccaccccaggctatgggctttagcttggagcactaaggttatgaggtggcagtgtgtttgttttttctctttttaccttacttattttactctttcattgtattttatgaacataagggtaatgaatgattttaaaaacctttaaaattctaaaaatgtgaagaagcaggttaacacttcggccttttttccagtgttgttggttttttttcttttgcctctattgtaaataactgagctcataccaaatatatagttttacattccagttttgtatttttcttcacttcattgatttcttcattataaaataattgggtatctacaacttgtgagatgctggttttagatgctgggataaagcagtgaaagaagcagactaaattcccattcttgtggatcttccatttgaaagagagagagtgggccaggtgcagtggctcatgcctgtaatcccagcactttgggaggctgaggcaggtgaatcacctgaggttaggagttggagaccagcttgaccagcatggtgaaaccctgtctctactgaaaatacaaaaataagccaggcatggtgatgggtgcctgtaatcccagcactttgggaggctgaggcaggtgaatcacctgaggttaggagttggagaccagcttgaccagcatggtgaaaccctgtctctactgaaaatacaaaaataagccaggcatggtgatgggtgcctgtaatcccagctactcggaaggctgacgtaggagaattgattgaacccaggaggtggaggttgcagtgagccaacatcgcatcactgtgctccagcctgggcaacagagcgagactccatctcaaaaaaaaaaaaaaaaaaaaagaaaaaggagagtgtgaattgacaataagccaatacattaactatttcaggtgctggtaagaacgctggaaaaaagtaaagcaggatgaggattgtgtagtaaaaggaagatctcctttacaggaggaagccaaggagggagccatgcagatacctggagaagtgcattccaggcagagcaggcagtcagtccagcccacacactgaggcaagagtgtgcttggggtgtgggaagaacagcaagtggccattgtgcctgcagtctgtgctcaaaagggtggtgcgagctgcctttagaaaggtagcaagggccagattgaatagcacattgtagcacagatgtttgagggatgtgtaatttgaaactcttatcccaatgacatgattaatgaaagagtatccaatgtaagattttgcagcaaacagtatgaaattgcaaacttttgaaccaggacccttcatgattgaaatagcacattcctatttacagaggattacaatttaatttttcaaagtcctgtgtaataatgctccctttcacattcatagttttctaaaattccaaattcttgaataatccccatttaaataatcctaacacaattgggaagctgcttgccagtaaagtcagaagttgaccctagtagtttctactctactgggagcttatgggcagactccaggagtgtctgttaagtgatcactgctgttctgcagtggagctggttaggcagattctcagcagggtagagcctcttgcttaatgcacacagcagcttagccagactgaattaatttagagtccttggcccagaaagttttcctggttctactcatagaacaaggcaaatcacacataacaaaatactttgtttctaggattagttaaaaacaaaaccagaatctcttgtatcttcattataatgtaactccttaggaaaaggatttttatcctttttttttttttttaacttctgtatcctccagtacctaaaattatgcctagcatctattagggtctcaaaaatagttgtttttagtgaacaaaggtcacattttatgacctttatgtattttgtctggatttcctacatcccttcatttgtaatacttagaatcagcgttgaggttcagaaagcccctggagctgaacaattagctatagaatgctagagatcctatgattccttgagtatcaccaacacatggcctcaaggcatggtatagaccatagaaatgtttaaccctcataataagattaaccagaaaacatccttcacaaacagaaactctggattccagtgagcaaagcccacccccagagtcctgcccttttgaaagtagagttagttcaggatggctgagagtgttgggccacagggattaataaacacccacccacaaaggtttgcgtgtaaggtggaccaagttgatagaaagagcccgttcttgtttttttttttttttttaacattttttttggttaaaagtggaatgttaaccatgtgtcaactccaggaatatgtttcaataattcattaatcatttgggaaaataaaaatggagatcttaaagtaggcatattaatttagattagttcctttttaaacaggcgctttataattcagaaagtttatctaaacactcataaatgaattcacatcaactcatgcaccatctattattccatttcagactgagaaataattctggataatctatatgtaaatggcaacaactctaaccaaaaaggtctaaaggatctcagtttatcaactgctaatttcttcactttggggaggacactcattctctctcttcttgctttgaaccatctcttaataaagaaaaaggatcctggggccgtttgctaatagagaaggctatgaaaaccattgttaatatatagttagtgcataatttgaatgacttcctgtaaatgagtttttactaattaatatttttaatagggattctcagcgttcttcagaaagatgactttttttctgccaccgtatgtgtaatgtggcttctctatatttatgacttagagtcatgttttggcctgtgaagcacaataacctttctggagccaagttttgtcagtgctaatacatgccctttacagcccacattccttaattgcatcaaaacactcacctgataggtgagcagtcctcacacccttatgagagaggtaaggtcattggttagtttccatgaagtttggaccgctcttccacacgaggttgcagaagtgctggcaagccagctgagatgtgccttgaggtcggggctgttctggaagaggaataaggagcaggagtccagcccagaggcagctcctgtggctgttgggtgttttactcttgagtctatcaagagcagtaaacgtgacccatgtcatcagagcagtggccgagactccctggtaaggtaagaatctaactgcagctgccttcgttcaggacacttcctccacctgccactcagcaaaaatcaaaatcgttcactgtgtgtaagagtcagtggtgagatttaacggctcccctgaggtggggaggctttcctgcaccatgtcaaatccctggtcctccaccattgctttatttcctggaacaggtgagtgtcctcacagaccaagtagaagcccagggagaaaagattcgagacctggaagtgtgtctggaaggacaccaggtgaaactcaatgctgctgaagagatgcttcaacaggtaagggcgggtgcactgaaggcccttgggtgccgaagcagctcatgtgctgaagcccctttgtgtgcccaggctacagccctcgctgtctgctttcccatcctgcctgggggcgggattggctgctcagttgtacggtgtttatacagcaggtgaaaccaacctgaacgttgagagtggcagagggggtagggaagggaagggctgccctgagatgaataacctgctgagctggttagacagattcccagacagcactttctccagacctggtgcagtgagggagcgctcggctgggggcctcaccctcatcctgtgggtgccatctggagttttagaaagtcaattctcagctgattctatgcccctttcccatctcgctctgcctcttcctactgtatatagtttttaaaataaaaatattatataaataaccttttagtataatttaatagatatcaaaatggaaaaagatatttaactgttccctaccattcaaataatgtcttctccttgttttctttttgtccttgttatgtgtacatgtactttccaaatctgtaatcacaagagatatgcaatttagtcctcagattttgtatgcttaatattatatttttcccatttaaaatttttgctgtattgtcatctttactatcacctataatagattttcttagtaaaagtatcagaattgacttaactttttttcaattcctaaatatttttactgtattataaataatgagctacaattttttaggaaggggtgttgaatttttattgtatcaaaacttcagaatttgttgagaagcgaattaggtttttaaatgaaatgtattaatatatctaatcttaaattttccttaagtcattcttacattttaagttatcttgaaaattaaacaatgactgaagtttatgtgtgtatgccttataactcctggcatagtacttggcacataaaaggtactcacaattacttaaagaacaaaagtttgttccttaaaatgagtggattcaattagaggactacttataatctttcctccaaaagcgctagcattttttttttaattgtcatgatcagcataagactcagattgtttcttgacagcatactggtgaacacaggctttgcattttacctttggtctcatgacaaatgtcatgagaattaatctggtgtttgttagttttgtttgagtgcctttgaagaactttatacaaatgtaagtcagtgtttttatatatatgtcttcataaaaacccgtttcaatgattcaggaacttttgtttgttatcttttcattgctgattaataaattaccacattcttggcgccatttgattttctacttaggttgtgtgccatttctcttgttcataatatttcctaaaaatctgactagcaaaaggaattgaggctttttttttttaattgaatctttcttttgaagacccaggaaagaaaatagcctgatggaaaaaaatctcaaatgatgaaagtattttcacaaagagtgcagaaaacaacctactagattgtgttttcaagtctgcacaaggtgtgtttttgaggtgagaaggataagggaagaagatgatggaatggtgtaaacaatccagaaagagagcaagaacatttgaatacggaagggaacgtgtcagaaggttgatgtttcaggaaggctatgctgggagagtaaccacataatcagaggtcaacagaatgctgcattgtagtgcctgagttatctgactgcctgtgctggcttctctgagccttctctacatagctctctatgacagtgtttctgctccattgtcaaagtctctgtgtcaaggagtctgattgtgatgcccagcaccacctggggagaggctgtctagttcctctaaacatcatcccatggatggcattttagacttttttaaagtcataaactcaattactttttttttttttttttttgagacggagtctttctcagttgcccaggctggagtgcggtggcgcgatctcggctcactgcaacctccgcctcctgggttcacgccattctcctgccttagcctcccaagtagctgggactacaggtgcctgccaccacgcccggctaattttttttttttttttttttgtagttttagtagagacggggtttcaccatgttagccaggatggtctcaatctcctgacctcatgatccacccgccttggcctcccaaagtgctgggattacaggtgtgagccactgcgcccggcctcaattaccttttttagcccgtttattctaaaccctctttcctgtgtgctgtgggtttggtattgggcgtgtggtaccatgtgccatagagggtagatgtcttaacctggcatattttggagtatggtagccacttctgagtttcaaagattcctgaacttgaccaagttatttttctgcccataagctttcattgtattctctcaaactgtcaagggtcaaatgatagcagtgtgcagtgctcctttcttaacaaattgagttcaagccataggacacatctgagcctcatcttccactcatgtgttcgctgggctgggtggcaccagagcttgagatcttttgagttcccagatctaaatccaaagttgaatgttcggccgcacatgctattgctttcctgaagtctgtttgatgctgtttgtgaagacacttgattcttgcaccacagtgctgatgcaatatctctggcttggagtatgtgtgtattctctgagctagggacaggcaaacacttgcctgatttgactgagatatcctgggctgcagggcccttggcttctggtggtaggagcaagaatgactcatggcctagaggcagagaatggaggcaaacaattgcctctttctgccagcctcagaaaccattcctgcctggagccaaggcgagcctgctgctcaaagcctctgaaggaaatcctttcactgtctcagtgtgcgcccttctaactgcctgtagataaggtgcttcctcggggtttgctgctcctgataaccctgcatgctggagacatcctgtctgaaggcagcagctgctgttctactccagttgactgcccatgtaggcctggtaatgctagatattctcatttttcacaagagactcaaaatccagatctaaagagttaaggatctctgcttttaaaatattagcagctaatttaagttttttaaaatgctgtgtgaatcatacagtacatacctataggtcaagcctggcctgcaggcctccaatctgcaacctctgctctagacttggccccttctacaggctggaataactccagggggacttggggaaagccaaatcaatgaggatagcccaaaccttgtgcttaaaggggctccaagaaccccattgagctgtctctctccatgctgctctcctgaccaatgtcaaccttcctccaggagcacaagaggtgaggagttagttccttacctagttcatgaacaatatactcactgtatccccaaccacaacatcctcagtctgtcgctgctcagggctgacctcccaactcccatctgtttttgtctacacatgaactcatccagcctccagaaagagcaagaagacctctcttggggttagacaggcaaatcagaaccaaccagagccagcaaaggggcaggtccacatgagcccacctagattatgaacacttttcagggcaaaataatgtttctgttttgcagcccacggcaggatgtgggatgggaagggaacatgatagctacaagcatctctcaggactgctacaagcagacagctacaagcatctcatagctgtcgacatacacatatagacataccttgtagctgtctacatagacagctacaagcatctctcaggactgcctatggaagcacctagtcagatgtggtcttagactcactgagcatgtctggattgcccaggaaactttccccattaagaagagttatttctcggccaggcgctgtggctcatgcctgtaatcccagcactttgggaggccgaggtggacggataacctgaggtcaggagttcgagaacagcctgaccaacatggtgaaaccccgtctctactaaaaatacaaaattagacaggtgtggtggtacataactgtaatcccagcactttgggaggccgaggtggatggataacccgaggtcaggagttcgagaacagcctgaccaacatggtgaaaccccgtctctactaaaaatacaaaattagacaggtgtggtggtacatacctgtaatcccagctacttgggaggctgagtcaggagaatcgctggaacccgagagacggaggttgcagtgagccaagatcacgccattgcactccagcctgggcaacaagaatgaaactcaaaaaaaaaaaaaaaaaaaaaaaagaagagtcatttctcaaaaggatctttaagggagggacagtctgagtcagttttcactggtctggtattgtctgagcctgaaaatagaactcacagtgctgggctctgcctctttggtccttaagcagatcaaggcattgctcagctgcacagtgaggctatcagaggccagggcccagaattgtacactagggtttccggcatggaccagcgatgttcttgtgactgcctcaaactatgctggcaacaaaaatctctgtatcatggggagggtttccctggtctgtgatataatcgaggcctgtggtggcattttctaaagtagccactgtgagctcactggggtctagtaggttcctgcacaataagctcctctgcctctgatcactgacccttctctagaggaggaagaagctgatgctactcggtggataagaggttttacatggagctggtggtcaaatggagcattttccagagactggccatttacagatataatcaatgtaaacagaaacaatgttcaatgtcaaaacaacacagggaaagggaggactgtggggagcaagtaagggcataatcctgcttttgggaaaccttggacaacaccagcctctatttctatcctccctaccgacccagagcttcagggtttaggcaacttcattttttttacttttaggtgaggttggggagtgacaaatataggggattaagagttcatggatatgggtttctatagatttgctatttgctattgatctgggaaagtcagtgtacctgtttccttattagtagagaatgaggatgacaatatggactctgtattgcctacctcttacttctcagagttatagtaaagttattccactgttattaagcatgagctatcacacagtgagtcaagacactgagcctaagacacaggcctagtagatggctggtaaacttcccaggagagcctttaagcaggtatttctatctcaaagagaatattaaacagagctgtgtacatgttccggtgggaacacaaatctgtctgaggtgggtaagacagtgattcagaagtgaagaaaacaggaatttttcaaatattccccaaaattccctctggggatctatgagctaatgagtttcttcatgcttatcccatgtgatgttgggaatccagactacagggcaaagtagatactttaactccattttacagataagagtgaggttcagagagatgattgagttagtgaggactgagcctggcctcaaactcgagttgactacaagcacctcttctctgcacagtgttactcatgaaagagacttccctgcaagacctgggccttttacttcaaagggcaaagagacttatttttcctttcatgcctttccatggcccactctttcattctggtttcaggttgccagtctggctgcagtcctctgtcattggtcggtaacaccctgggtcatattccacacttaaagatggaggtaattgcttcaagatgtggccctttaaggagagaataggttgaaaggcaaattctttttttcagctttagtcagagcctgagttttggaaaaaggaaatgatgagttgctccgagatataaactttctttcatctcttagaagaagtatttgtccttctgaaaaggttagtggcagttttgtccattgattttttttctaaacctttattacccagtttcatggtccatcacagtaagtaaaacaaaccaccctcccccagaccacctccctccttatttgcacagggaaccttcaaacaattgggagcagaagcagaatgatgcctgtgaagcctttgccccttatcctcagctcgctgcctcccctcaactccctccccatatactgcggtagctgcatgactccagcaggattccaccatgaaggtcaggaagccttcagcagggggcaagcattgcctggcgaggatgtgggtgctccagacagcctggatcagagttgactccagtcttgggtgagaatgagattaagggctccaagaatgttttccttacaggattgacagaataaaggcagccagcaaagaaaatggagaagaaaaaagaaaggtcaggaaaaccgagagcaaggaagattggggtggctaggagtaccttacattgagtggataaagggcgagacagttaagatctgagaaatgcaagctgcatctcaaagtttgtacattggttccaggactatttctgtgccctagttggtgaaggcagaagccaggttcaggcaggcagaaatcttgttgaggagtgacacacacatacacacacatgcacccacacacacccacctactcacccacccatacacgcacacacacccccccatacctactcacccacccatacacacagacacaccctccacacacctactcacccagccatacacacacacaccccacacacacacctactcacccacccatccacacacacacacccccacacccatgcatttgtccagcaagaggacatgggagttgacggtgttagctttgagggcaaggtcaagacggaagtttctttagaatgtcagaaatttgatcatgtttatagcctgaggattgggagctgatggtgagggagagattaaatgcctgccagagtagatgattgatggccctaacctagagtagcacagagcttggtgggaacttactcaaaggcagtacagaagtgagggagagtccaggaccatgtgagcaggagccattctgagttaccagctggagggagaaacaggaccagaactcagagaacagagccaaaggctgctggttgaccaggaagttaccgtaaggtttatcaagttgtatgggaatgtatgaagagtcaggagactgagaaatagccagaaatgggaaggtcagtcaggggcaattcaggagcaaattctggaagcattgtatcctttgatgggtactttttatgtgcacctggaagtattctgaactagggaacagttttcaaaggtgaaagaaccctgcagaaaagatggcaatgtacaattgtcgcagtttatccttggaaaggaactatgggcttgctgtttctaagacagggatttaagatatatgaatgagagatgatgctaggaaactttgaaatagaacttacattcagtgaacagatgcattttatcttttcagcaaatacgaggagagattatttgaggagaagagggagacatggtaggggtttagggcttgagcagaacagaaaagacttggaacagttcctgaaaggagtcagccagagacaaacacaagttttgccaggcagtattggaagatcagctgtaattagatagcacaaatttgtacagaaaccaactggcatcattaattgcctttcactagcaatttttaagctgtggagagtggaatcacgacaaaagactaacaaatgcacatgaggcctgttacagggatgagatcccatgaggattttctgctgtggtatgaatacaattggaatgactcacctcaaggtacagagttgataaggagaacaatgttgcttcaaggaagttgataaaccaggaaaatagagttactaagtaactagtggccgcagaagaaattagaggttgagtgagcaagtgggacagatgaaaggtcagaagattgtggccagaggagagaatttcagagctgaagattttagaagcaaagcaaacacattctggatacacgtgagatccaagtggtgactgtgctactgagaagctgaacgaaatggaaagcaaagcctgttggagctgaggtcaaagaatgtgaagccagagtggatactgaatgggaaagttaataacaaggatgtggaagctattgaggagacggagtgcgcctaaagtaggtagaaaagctgttgatcaagtcaaaagcctgaaggaagtaggttggttccttcggtttggggagaatgtggtataagtgaagagcactgtcttagaatagcaggatagatgcagatggtcggggggcaaaatactggcttggaagcagccctggaatagggagcacagtgttctataagttgggttggtggaagctgagtggtctccaattgaaatgacggggaagaatgtgtaatattgttgaaaaaacatgattcactttatgttggaagtagaaggagcaattgaggatgtaggataagttaactcctattaaagcacacattttagagatcacagttcataatagtggctacgggccttgctggatctggagatggggaagtagagctggactgggataagtttgttgaaggctgattttgagtttagggaccaaaacagtaatcatgacaggggcaaggggaagatgatcatgaaaggtagaagcacatgctaatagatataagctagaagagaataagtaaatgttctgttattagtgaactatatgaaattaagcaacctcaggtttctaattaaaatgttagtgtgtccaattgtgaatgtctgtttggaatgttagtgtggctaattcaaacactggcatgaccaattggaatggctgttggaactagtgaaaatattgtcttcatcagctggaaccattggtatgactaatcacaacctggtagttaaaatagggattttggcaatgatggaagcagagtagactcttagctttcaaaagagatacattatgaaactttaaaaaatcacatcaaagcagtattttgaatgctgatcagaagacaaaactgcatgaattttttttttttttttttttttttttttttttttttttttttgagacagagtctcactgtgtcgcccaggctggagtgcagtggcacgatctcggctaactgcaagctctgcctcccaggttcacgccattctcctgcctcagcctccccagtagctgggactacaggtgcccaccaccacacctggctaattttttgtatttttagtagagacggggtttcaccatgttcgtcaggatggtctcaatctcctgacctcgtgatccgcccgcctcggcctcccaaagtgctgggattacaggcgtgagccaccgcgcccggccttttttttttttttttttaagacagggtctcactgtcgcctaggctggagcactgtggcatgatcacagctcactgcagcctcaacctcccaggttcaatcaatcctcccacctcagcctctcaagtagctggaactacttgaggcccatgccaccacgggtgctaattttttttttgcgtatgtattttttgtagaggcagggttccactatgttgtctaggctgatctcaaactcctggggctcaaatgatccacccacctcagcctcccaaagtgctaggcatgagccactgtgcccaggctgagcatcaccttaaggtgttcaagtactcaatagtggctttgttttattagtaattgtcatgtatctaggcactggcatctggtaggtatttaaaaacatatttgttgaataaaagaatgaagtctcttgggggatttttttttttccctgagatctcagtagtctgaagacattttcttgtggaccttgacctgtgcacttgttccttttcccctttgcattggcagctgggaagctcacatgtacattatagtccatctctagctgtttatagaagtttatggcatagattttctactaactctgactttaacttattttcctacctgctttaatttttatgatttattttttaatttgaaatatctattttgcaaactgcctaaacacattttgggaataaggtaggtaggcagaaggatggagaactagagaatgaggtaataaagaaagagagggaggtagggaaaggaaagaagggtaagagagtaggtggtgtgggggatgattacatcttaagatactcacgtactcaagactcagagactcagataacttattttatgtgccctcacactcagggaagaactgcttaaggccctttgtggcctgcatagccttagcactgggtcctgataggtagtatgtgctcaatgaaatcttggcaatttgagtgggcatttcctgggctcattgaatatttgttgattgcctattttagcatgtttttttaaatgtctcttaaaatgcttggacttctttctctgtttgggaaactgtgatacaatagactaaaatgagttctggagtcaaacagacttttgtttgaacactaactctgcttgctgggtgtggtggttgacgcctataatcccagcactttgggagactgaggtgggtgaattactggagatcaggagttcaagaccagcctggccaacatggtgaaaccccgtctctactaaaaatacaaaatccgctgggcgtggtggcatgcgcctgtaatcccggctactcgggaggctgaggcaggagaatcgcttgaacctgggaggtggaggttgtggtgagccgagatcgtgccattgcactccagcctgggcaaaaagagcgaaacgctgtctcaaaaaaacaaacaaacaaacaaacaaaaataactctgctgctgattggcttgtgtccttggccaaaagatttatgtactctctcttggcctgtttcctcatctgtcaaattgggataatatttattgccaactcatttggagggtttattaagaagatgtatacaaaagcaccagcagtctctggtacagaggaggcactcaacaaatttcagttctccattgcattggacgcactcatctggctgactcctagtggccaagtagcctgtgctctggctgcagtgctccacctctgccttgtgagccagcttccagtctggctggcccaggaagagctggcctccttaccccagagctcggggagctcattatgctgagttgctgggcttcaagagagatacccatcccctcagactagcagatgaacagtttgttgcctacctttcccaggtaggctgttgcccagcctgttggcctggggaatcatgtattccaagtcaaaaatttctgtcccgtgtggtttgattcataatctgaggacggttccaaatctgtgacctcatagtgtttgagtcagagtgttgagattgccattcttgtgctgagcttgggttgcccaagatgatacaaaatgttcagaccatggcaggatatcgtatattttccttctgttcatttggcccattgctttcctggttgctgtgtctattctccttgccacaacctttgtagccagtgtctaccatgtgccgggattttggacctcataggacattgccctttgccaatggaaaaatatgtttccctggactttaggaaatgctcctgatttttgaggtcctttataattcatattacttctaagtgggtgtcttgcctatcatctttattttttaccttgtttatgcttatgaagtgtttttattagtgacaggtttgttgtcaaagccctgggttatttggttatagtctgctactgttctagtgatggcaggactagtaataacctccctggtctgtcttcacaattgggaaagaacaatcttcttatttacattccagagtggccagattgtaattttggaacagcccaggaaagatccatctcacataagattcctatgtaatcattcaacactctttgcacatctactttgtgttctagctcctgtctaggttcattgcagtgaagtcttgtattggaacatgttgaaaactgggctgagcattggttgagcccagaaagtgatctagaaattttggctttgaaaaaaatatattgttaacttaagcgaggacctactgctttgtcttttaaaaaattgagaaatttcgttctttgaaagtatccattcacttttctctacatggaaataatgaataatggtctctatgggcaaacacatttgagaaatgtagctcaccttgtctatcaaagcacagtgggtggtattgggggtgcgctatccctgagtagcccagcatcagcccaggcccatccataataggcctgtgactctcatgtagcagtctcaattctgtgttgttgaacacacaacttaggtgttgccttatgtgctgtaaatgaagccagagctgttcttattgccatagtggtttctgatttcgagatctgtttttgcttgcaggagctgctaagccgcacatctcttgagacccagaagctcgatctgatgactgaagtgtctgagctgaagctcaagctggttggcatggagaaggagcagagagagcaggaggagaagcagagaaaagcagaggtaagggtgagtgtgtactgtcctaagctcagacctgggaaggctgtcataatgtgaatttaggccatctggtcaactcccagcctggaagctattgggtgccagaaatatctatacactagagatgcagtgatctgttaataccaagttatcaggttttgctgtggctgcaaatttcagcaatatccaaaccagccagttttggctctaaggctttatctgccctcaaactgctgacaaggatggaaagagaagcaatagttggggaagaataagacaaaatgtggagggacacaagatgtcttctgtgagaaccaaggaaatgacgacgtaccggaatgaagtcagcctcccaataggccattgacactggatccaaggagtctggaaacgtttcttgacgtgcgtttcactgacccagatggaacctcgggtgatgtgtttctcttttcctgatgggtcttatggagcatgccatgtgcaggccttctcttagagaatgttttcctaattttgtttttcagtctttgtatgccattggctggaacatgccagactcttttttaaataaatgtttagagaattttacactcagagctcctttgagagcaggcagcctgttttaaccttagataaccgtcttcctgtgcctctacctttaagttcttcttatattcacacctagcaatgagagatatgaaagaagataggttttaggtttagaaacacctcgctcatttactgacctaactgcttaatagttctatgaacttcaagctggctacttaatctttctgaacttcaatttctttatctggttaaaatggataactgtgtggtaaagtccaaataaaatcgtgaaagttaagtacctgtcatagtatttggcattttgtgagcacctggtatgtcttcatctccttccttcatttaggctaaagatggatattgttcccttctgataagtgccagcattagtgcatactgacatctgccatgtttgctgagtaaacacactggtgattagaatatttctaatgtgtgagcatgttccttgcattgcttttgagaacatgttcattaattagaagtacagttgccaaaagaagatatccccaataagctgagaacagtagcttgtattgactaagagtccaggctgatgaatcagatctcctggctttaaactgagctcagtggctttgtgaccttggtcacgtaatttaacttcccagacctgtttcttctgtaagatggaggtagtaatacttccaatttctttggttattctgaggagtgaatgagacaatgtatgtggaacccttagcatagtaatagttagcttttattgatcacttactgatagtattgttaagcatgttggaaatgaaaatgtagacatagatacattatttacatattgcaaagtttatacagcctgaaagctaatctgtgtgaagtgctagttgaattaaatgttgagggagaagtaactgaattttcttctggtttgaagtattttaccaatgtttcaacctgcacaattgtatgtgaacatacattaggactttgggggcagaattccataaactctgtgagaaggcttaaagtggcagacactcaactcaaagtcacttaagagaaaaagggaggagagagacctatgtcacataacttgaaaagtctagtgtttgaaagaatacaatatgactagatccgggtaatctcacagtgtcactagaaattagtctcagttgtatcacctggttctgctttagccttattctcaagaaggttctccccaggtggtgacagagatagccatcagtagctccggaatgatatcctgccagccaggcaacttctgcagtcaaagaggtgctttctcaaaggttccagcaaaagcctcaagattgcatctcattgggccactttgggtcatatacctggttctacaccagtcaccgcagggatctgtgcatgaggggtgggaggtgcgaatatgaaagtcagcccgtgtgtggaagtatacagagttagcaccaagctaggataatgcagtccctttacagggacatcagaaaggaaggagagctcccacttctgggacaagaagcactaatgcagtcattttactgtttgcttttttctttcttttctgaaggactatttttaaatctgaattttttgtttttgtttttcatcagtctgttcatacataaggcgacgtagaccctgagtgtctggcctcagtcctaccagataacagcccttcccagttgctagtacaaatattaggtttccacgtggaggaattctgtaggctgttcaaacctgtgataatcagtgagcagccacatggcctgaaacaaattcctcgttcttgtaattgcacataatctttgctggtatgcacagaacttctacctctatttgtgagtgtctggagcaaccaggggtttaaaaccacagggtactgcttaagctgcactattgtcatgtgcatggagatgtttattttgagtgagacattttgctaaggtcaccagaggttgtaattgcatgaataaagggaacgctgcttcccatactatactgctgctgttttttccagtgagtgtatttagcctaagggctcattgtgtgtggtttggaacaggcaggattcttttttttttccccctcaggtgtgagatagccagatctgaaatacagtttctcagcttagctcaggctttatcctcaaattctgttttatgttttaatgaaaagaagagaatgcttgtggcaagagcattgccaccacaatgtcactagaaattagtctcagttgtatcacttggttttagttctagttctaattttagttcacactgctccttctctgattctgatcatagcccaagccagcatcttgctgcttgttttaagttgtggaaatgattaccgacagtcattctgtaagacctagggacttgcaggcgcaggttccttgatggccagccttgctcaagagtgagtagtggcccagatgagatgtgggtgaatactaggtttcctgtttaccttttctcatcagccttttgcaatgattcagggtcatatgagggtactgaagattgggtgaattagacgtattcctgaaaagtaggactacagaagagtgattgacgtggaaagtaaataccaaaatcaagaggatgaagcatgaaagaaagagatccagaggtaaaggaaaacctctgtgtggacacagatcaaagcattgcaaaggcgtgttgctcagatgggccttccccaagaaagaaatctggcttctccatgctgtggaggtgccagcaacctgcagttggaccccactgtggcaactagagggttctgtgaatagctatcagagcagcctgttaagaagggagcagggaccccagatatgctaggaaggggagtcagcccaactgatcaggggtacacgtgagcaagaagagaacagggaagaatctttaggatttcctgcagaaaatggaaacatctcacagcacaagtgatgatgccatcatttcttcttccttgtggttaggaccctgggagaaagggattctgatttctgaactgaggcaacagagtgatggacttggaacacagagtgagatctgggaagattgtgtttgctcagagatgagctggcctaataggagagtttttttattcttgtttttattttctttatttactcatttgcatcagtgtaggaaatatactcccacaattcaaaaatcaagtgttcaaaagggtatatagcaaaaggtctctttcaacacctgtcctccagtcagcagtcaggaagcagtgccatcagtttgtatccgtccagagttatattatgtgtggacaagtacattcatgtggatacacacagacacacacactttccctcatttttatacaaatgtacactattctagacctttctttttaaatttagcagtcttggagttctttttacaccaagtatgttttttaaaacttcctcattcatatctatgtctgcatattgttctaccatccaacaatagcctaatttatttaatcagtcgtctctcagtggacatttaggtggtttccaagtttctgctattacaaataatgctgtagtgaataatcttgtatatatgtaaagatattgatgtggaatttatgggtcaaggagtacatgaacttgaaattttgacagatatttccaaattgccctctctagaacatagaggttatattcccatgagcaatgtaatgtatataaactgagcctgaaaaaagaaagaactaagtaaaattgtgtacaagattaacaggtaagatggaattggaaacaactgtgattatgggaggtgcccagtagtttcacatagaaaagaaccataaagaagaactttaatggttggcaaagtgtgattaaaaaacaaagtgagctgaggttaaaacacaggacagcaattataacctcataaatgccacctagacatcatgatgtggaacccagaatggaacagagctacaaaagggtctgctttatgggagggaaacagacctgttaggaggtgggccagccctggagataaagaattatgaagctaggccaggtgtggtggctcatgcctgtaatcccagtactttgggaggctgaggagactggatcacttgaggtcaggagtttgaggtcagcctggccaacatagtgaaaccccatctctactaaaacatacaaaaattagccaggcatggtggtacacacttgtagtccagctacttgggagactgagacatgagaattgcttgaacctgggaggtggaggttgcagtgagccgagatcgtgccactgcactccagcctgggagacagagtgagactccgtctcaaaaaaaaaaaaaaaaaagaattataaagctaagttgaaatgccaagcctgtggacagacataccagaaaacaatgacaacacatggctcaggagaattaaggcagagtagcccagaagttttgggtacaccacacactgagcagagggatgaaaatagatgtgttcctgatgcaggtctccaaactgactgatgcacacaaggggcagtaatggagggaggggagtagcaacctatttgttagctcctaaatatctcccagctgaattctgaagcatttgaatgtttacttgtttgtttttctcacttgctttcactctactcagagggtagaagacaaaactaggaaaactgcctttctagctccaacattgaagcaaaaggagaaactggtttatgaagtaaaagtgataggtaccttgagagaaagtggtcattgttatttgaatgttcacgagagtgagcatggaaaaactaggcataaacagacatgcactgtagacttgggtaaatcataactctgacaatttaaaaataaaatggatggggaactgtcgaatagaggaagacccaagaatattgaactacttaaatataattctgactgtgcaatctcacagataataccaataaaaaggaagagtttagaggtctcttgaaaggaagtagttttcagaggggcttctacaaaaggcagaaaggacatatgctaaagacaaaagtgcacctgcatgaccagtgtcaggaaggggacatccgaaactaaaggacaatgctgaggacaacacaaagccatacacacacatacacacgcacacacaaacacccacacacagttatgttcttaaaaagaaaaaatggacttgattccatggatgcctctgacagatacaaaaaatttaggacaatagtcccccaaagtgcttgctataagttaattttaaggaatcaggaaaatcaaatgagttgctagaaaactggaaatgaaccatttccttcttgattttcaaaatggcaaaagtttgatagattcagtaaattttagtctgttgagtttggggccaactctatgatggtttgcaagaagggaggagacaaagtagggatccgtgtcctcaaggagtgagtctcgtcagattggccttatcggtttggccgggaatgtgtcgtgtggtagaccaggtaaatccacatttcagtgaagtgttgcaaaaacgttgcttgagataatcttgtagacaggatggaggaatagaagatgaatatactgaaataggcatattgatgcctgagttcagggtttgggtacatattgtcatggataagtgtgatgtgtgccatatgtcccctgtgcataggtgctgacacgttgggtgtttgggtaaggggagtcggtgtgtgtatcatgcatatgtggagagaggacgtgtttgtgtgtgtgccccagtgtgcacccatctctgctattgcttctgcttggatgaagagtttcttctagactccatgcctcggtgttgacacaacaatatggcacaaaggagctgttggggatttgttcgaactgcaagacaggcatctggatggggcaggcctgaggaaaaatgccatgtcttttggttctgttgtggaaagtggagggccgtcgacagtgaccactgagtgccacctgctccctgccccatgcacacttcctctgtgctgttctcttaaggagttctgcgtctgagagctgtctgacctggagtgcttttctcttctttcttttccttcctacagtcggttctgaatgtgatcagtgagctgcaggagcagatgtgtaggctgcagctggacatccacaggcagattcaagagcgcctgttactcagtagggaccaccctgaggaggtggcggccagcgacggtgtggccgagccccagccctgcagccaggactgtgcctgttgggaggggtcacctgtaggaaccacacttaagtatatcagagcatgcgtgtgtggggcatttcactggtggaggggctggggtttctcctaaccagaacagagtgcagtggcttggcatggatctgttgttacctctgggcagagcttggactcactcaatcctcttgggatgtgaggtgagctcagtgaccctcactgagcagggtctgagcaggtgaggccaaccctcaaacaggtggcactcatctcctttagggctgggaatgaggtgcaccaggtgctccgagtgatggggcatttgtgccacaggaagcctcatgattccccttctcaggtatgtgactcagatactgattcctcttcccaggctgggagattaaacaaacttttgtttcacatgattttttttttaaggaaaagaagtattatgaaaaagaatcctttcaagtttatgttcaaagaggtttacccccagtgaaaaaataaaatacaagttttcatatgctgtgaataattaagtcatcatctgaatttccaggaaaaatcccccccacataatcacatcagggtgattttataacaacagggccatgtggggctctatctgactgggattctggacttggctctccacacgggggtaacctggtcctctgtgactttgctgatggcaggtgatggcagcttcagcagagataaccctatgcctcgaaggaggcctcctgttgaagaggacttggaagccccccaagaaaagaccgaggtcacagcagccatgagtactacagaggataccctggctctgtaggaagttactatggtccatactcaattagggagcctgttgaaaatctagacataggtgttgcgggaagggatttggttggaaagatttcctgctgcattaaaggacagcggggaaataggaaagtcaagatgtaaatgtagacttggatagagaagccttgagagggtgttggcgcatgacctatgttgagtaggttactccagcaagacttttaaaggaaggaaaaacgtgtgtgtactaatgttggtagtcaatgatggacaacaagtaacatagaaggaagaggatgttccagaggtcacggagcctggagaggatgatttctgtatacccacagtggcagcccctcaggcagtaggaacctgtacacttctgattctgatatcagctggcctgacaccctctccaacaaactgagtaacctggctaggatacaaggctgagcagaagaaccctcaacttgtgggcattggagcctctcaggcagggccaataatgtcctcagagaatgattctgggtctgctgcaagtcaaagcaggtatctgaggccttgacatccagtgatgcagatcatggatgcaataaccttagctgagaagttttctttttcttttttttttagctgggattacaggcacttgccaccacgcccggctaacttttgtatttttagtagagatagggtttcaccatgttagccaggctggtttcgaactcctcatctcaagtgatccacccacctcggcttcccaaagtgctgggattacaggcgtgagccaccatgccatccagaagtttttttttttttttttttgtcttgtttttaacgggcatcagcatatgctcacctcaactagaaggcaatcttaaaaaatgaccctacaaaattcaagggtaagcaatgtcaactttgtggtggattatctcagaaggccaagacctccaggccagttaaataatgacttaagtttcatgtgtgcattcattgacaaatagtatacacctactatgtgccaggcactgcaggataatcagaggttagcaaatacctcatggagtttacagtttagtaggagagctagctattagctgtcatacaaataaatatttaattgcaaattatgtaggaggtacacagagtacaacaagagaatatagcagaggggcctgatatagtagggaggtcaggatagctttactcagggagacctgaaggatgggcaggagttaacctggcagaaaattccagacagagggaatgttgtctgcgaagacctaagttggagagaggaactgaaaattatccatgtggctagagcataactagggagaaagagtgatccaagaggcaggcagggagctgtcaggtcacgggttgaagtttatgagctttgagaagcatgggagtgccatgatctgatgtatggtttgatcatatcactcccccagatgccatggggtcagttgctttgagaggagcaagacaacagaggagcaaccaatgaattgactgtccaggctgtcagtgctaattgctagaccagagtggtggtgcctgagtgggaaagaaatgagacattcaagttgttttcctggaagtagaattaataaagcttggggacgaattgcatacatagaggaggaaggacagggagatgcagaggatagatcctatgtttctggataggccgttagatagatggatatggcatttagtgagatgagagtaactaggaggggagttgagcattccacttggcacctgacagtccggaggtgcctatgcagcatccatgtgatgttaagtaggaagtttgttgtgtgagactgcagttcagaaagcctatggaagtaattatctttatgccagttcttctgatgggagctagtcagcaggaccaattgtctgttaaggaaatcttggttcaagataacagtgcttagtggagtcatctttatagaaggagtagtttcacaaacaagggtcctagagtcagaatatatgggcttgaattccagctccaccacttactagctaaatgagtaagagaaaattgtttgtgtcacttccccactcagcaaccttcagtgactccctactgcccaaagaatggcatcggaactcatcatgtgtattctcatcctcaagcctttaccttagggcctcaccttaacttcccagcctcatcttccactgtgtgcctacaccctcagctctagccgcatgagttatctccctttctgtctcctatctttactcctccctggatgccttctccctcccttctttcttcaaatcaatctcttcctctgaactggaacacccattttggcatctatatttggcccttaacatttgttcccttagggttcctctatgaggcctttcaggatcacaggccccctcttctatcttccttcactcccagcacagagagatgctcccaattagcctgctttctactactttgcatcacagggaagaagctgcctcatttcagcatctctattcttcccactccgaagcctcgcctgcctgcctatactcatgtgtgtgatgttggcataccccacagaggacatagatgtcagagaaaggggcaggcagaacaggttctaaaactaaaaggaaagttttcactttcttatgtctggaactccctggcctttgttttttaacggccatacagctttcctgaaacaagggacgtgtttaaagattaaagctgttatgtggagcttgatgtggttgctgcaccccatatgcatgagcttaaccaggttggtaaatcaagagcacatcttttaaccatcagaactttgtctttctccctcatcccctaggagttactgcaagagctcaggcacctcaaaatcaaagtggaagagttggaaaatgaaaggaatcagtatgaatggaagctaaaggccactaaggtaaacggcactcctgatgcttatggagagagtatgagggccttgtggggagggtctgcattccaacttgggggtttccagtagcctaagtttgaaaatgcaaatcaaccctccagtgtggacacacagcagtgcccagatggtgcagtagacagacttgatccaggaaagatcctcatggagaatgcccgtgagattatgaattggtcaattgtagtaacccagtctgcttcctctccctgcaccccatagcacctggctgaagctgggccaagaaggggctaggagtggggagagcaggtgagtggcaggcagtgaatcatgcgtcctaaagcagatcttggatgcatcattttaaattcagtagtcccttctagaatcagtttttcaaaaaaataggcatgctttatatttggcacaaaatatattcctaaaaatggcataaacttcgaattatttcttcaatcaaatcatgtttctcttaaactagggagcctgcaatttaaaggacaccaataataaattctattgtgaaataaatttcttccctgtcccctttgtttcttccttcttttcctatactaaagtgcagagatcaaaactagtgggttacattcagcccatgaatttttttggcctgcacattggattttaaaacgttaaattgttatttaaatttcaggaagtttacattaggctacagttaggtttcctttgggagtatggggaggtgggaggctcacacctgccttcccctactgtgtctgcagtgccacccaagggcattactggatgtttttattagagttttcttaacttctagtttgtatttttattttttgtgcaagttagttgctaattattataaaaacaataacacacactatagagaattttcaaaccataaaaaattaaaggaataaaaagcactcataccacccaggcactaccattgctaatatttccttccgtgtattattctcttctgttttaggtctgtgttaggccattcttgcattgctacaggtaaatagcttagactaggtaatttataaagaagaggtttaattggctcagggtactgcaggttttacaggaagcatggtggtcacatctgctcagcttctagtgaagcctcagggagttttcaatcatggcagaaggaaaaagcaggagcaagtgagagaaaggagaggaggtgccacaaacttttaaaccaccagatctcgtgagaactcactcacagttgcgaggacagcaccaagagggtggtgccaccattcatgagaaatctatccccatgatccattcacctcctaccagggcccacctccaatatcggggattacaattcaacatgagatttggcaggaacaaatattcaaacatcagggtctctctatctcagtgtctctgtctcttaatttttattgttgataatttacatgcaattttataacatgctgttacttaaaattttatgacttctcatgttatcaaaagaaagcactgaacatatataaatatttatgtaatctagtgtataaatataaaatcatttgattaaccattttacagataatgaaatggatgtacagagagattaactttcccaagattttacagctatttggtaccaagcctgggcagtcagacccatctgtgtcctggcctgtgtgtatctgagtgtagttttgtatgtgtatgcttcacaggcaccagctctaggggcactggttttgtccagtagctcagaaccttccatcacaacaccccactcaaacaagccctgtcttggggaaacctttgaagttgtacataccgccctctgtcataaaaccaaataacacttttctttttaacaccccagctctttgtcttggcatgtagacctttgagatgctaagggttatttaataactaccaggtgtggagcacttcctatgtgccagaatgtaccaagctatttgcacacattttatcatccataaaatcacccagtgaggtatatgtttttttattctcacttgactgggaaggaaacagaggctcagcgtggccaagctgaggttcacatctgggtctctgtcattcccgtgccttcatgctgtttccaacatcatcctgattccctgcagagaaaaccagcactgtttttggaagtttttcacttttctgcttcaggcctctcagtctctgaaggggattcatctcccagtgcaatggcagtagggcatggtccctgggtttaatgaggcacagcacttgcagggacccagagcatccgtctctgcccaactgcctgtctgcatagctatctcagaccttgtgccacacagccctagccatggtgactgtggccataggaacagtggcagtagcatacacagtcaagtagaaggtctctggactgttcttggccttcccaactgcggagacagagatcgctcaaaggataacagagcacctatagtttctggcctatttctgtggaaattggcacaaggcaggttgggcccagtcacttggtctgtagggtccatggtatatacctacaggacctcccatagaggcagggctcaggaaggagagccctcatagtgccacgtgctagattctctcttgatcggtccacattgctgaattcccaactgtggggccagcagacaagcatcaggtatccagatttctaacagagacgagtgcccatcctgtccacaaagaaagggagaaatgggcatggagaggtgcaagaaaagttaaaggaatatctttcaagaatcatctggcctttgtagaaatggaggttgagagtcccaaagctaatatcttcagaagccattgtcaccatgagtcataagcccatgggcatctttgccctgagtgagctctgataaactgctccatagctgcatgtctcagaaagtgggttacacagcaggacccagctcttggcctctgtgagtggagcccagagtggagggacagtgcttcattatgaactttggaataaggaaaccctaccccttgtcatctctttatatggtcatccctgtcccatttgggggatgttagggaaggttattcagaaacccttgcggtgggctgagggagcccaagcctggtaagagtggccttcatctgtcctgttaactcagaagcagacacacggtggtgggtggagccctgacattggagcaggcaggccagggtttgcatcctggcctggtcaccaagtagctctgtgactgacacagaatcttgtactactcccgttttctccctgatgacttacggagatattgtttcctcgggtggttgcttgtgaggatttgatgtaagaaagcagtgagcacgggggctgatcagggtgcgtgctcagtccatgcgctgaaactgaacacaaggcctgtccagcaacagagttgccaacagggccagtactcatttaattacttggggttggtcagatattaacttgggcctttgtggaattgaacagcccatactataaccttgaggaccaaagtgggacatgattgggccaacacatggggaaggggtggccagaggagaagcctttgctgtcttttattgaccggctccacggtcgatgctcatcccttttcttacctggtttgatgctgagagaattgaaccgattatccacaaagaaaagaataggatgagaggagcaaatagcagtagcatttattgagcacttagtatatactaaatattggactaggttgttgataaccattatcttaaacctaattgcagtcccatgaagtaggtgtagtttttcccattttatagatgagctgagactcagaaaggttaacttacttgctcaaggtcacccaactaggaaatgagagaatcaaggtttgtttgactccaaaatccaggtacctcttcggacaggacctatacaattctgatctcctgatgagtatgggaaagcatgaacaaccacacctagtgttgtgtgtggatttaacctgcactacttaatggcgacatgggaaccatctagtgcagctgcctgtttgtgtgcaaatatgaatgtatgtgtgtacttatgagctgtgtatacaatgtttttttttgcaaaagtatgtaaatgaagcactcctgaatgcttgtacatctgtatatgagtgagcgtgcacacatgcctggaggttgggcagaggcagtgactgtacccaaagggtaggagcgtgtggagggagggagcccttggcttaccttttcttcagcagtggtgatttggcttccgctgcattttctctgtgggttggaaagatgaaaactgcatgcacttgttatagtggtgtctctaaatgttactgtatgagtgagtatcttgggagaagaaagaccatgtccagaatatcctcctctgcaccaaggacagccctcccattgcacacaatcccagctcctcatcacaatcctaatcctcacagtgcaggggagagaaactggtcaggtaggaagatgcaggggaagaagcacattgatggccagagccgtggggagggccaggatggcctagaagagtgagttcactcagcagagttccacctgtggagagggcagtgagcccctgctcctgctcacctcttctcctaactcctgatgcaccctggtgcctgatggggtctggactctgacgggaggcacttcatcatgatttggcagtccttctgacctggtagggatcctctgttgctcttccaggctgaagtcgcccagctgcaagaacaggtggccctgaaagatgcagaaattgagcgtctgcacagccagctctcccggacagcagctctccacagtgagagtcacacagagagaggtgactagcttgactctgacaaaatgcagttgtctgggtccctgggtctactcttataagtgagcatgtgtttctataaatgagtgtgcatatgtgcttgtgtgtgtagccatgctaatggacatgcatgtatgtgtgcaagcgtggccaagtgaatggatgcaccagtttgtgtgtttgtgtgtgtccctataatgcagcgctcttgtggaatcattcccatggaaccctcccctaactagaaggtttttctcagatgcacagaagttctgtgcagccacctctggagcttttactgaaaatgtaggaaatacctaactctttcatttgactgaaaggccttacttttgtgtcatcaccaaaggggaggctttagaaatttactcagtcatttcatggatacctgcctgatgcctgtataaggccctgagactacagaaacaagtcagttctttttcattcttgagatttcaaatcttacttctcagaaagacctttcttggccaccctaactcaaataggtgctcccagtcctattattctctaattcatcatccttcctttttcctgcctagcacttattataacttaccagtgttgtgtgttatccccactcaggggtaaggactatatttttcttgtttaagagcatatctacaaagcccagcacaatatttggcccattgtaggatcctaagaaatacttcttgaataagtgaaaggatggtgaatggtccctgaggagttcaagtcttgctgatcaaaaatagaggataaatcctcaactactgtaatgaacacataaatctttatggctgtttgccatgtatacaaagtgatcatacacctttcaacttgtccactgactaccaggctgcagagcaatgccgaagatcatatagtcctacggattggtgccactacctagtcacatcctggcctcagcactgcaagcttagcttggatccccagctggggtgtggaagccatgcaacaatggcttaggctggagaaggaaattagtgatcaatgtgctcgtccctctccgagcttttctcagtgtccgcccaagccactgggtgtgttgcctacctgccaaggcctgcttgtagaggctgggttctactaagacaccctggactatctctgatgctaagcctggacagagagtgccccatgccacaacttctaggccaggcagccttcccagtctacccctcctcttcccacagtctaagcctcccaggccctaccccactccattactgggtactttctagagctggtccttgggtcatttgctgccgaaggtaggttctgaccagtggatcagggttggcagtcttcatctagagcttactgccctccccagcaaagtgagctgcagagctgatgttagctacctagagcctaaataatgagcaagcaattctccactttattctgaaaatgaatctccacaactatttacacaaagtccatagatctactgttgctattcttgttagatacaacaagcatcccaaaagaaaatgggaggcctatatatttgttcccttgtacttttttttttttatatagacatccctattcccatttaggaagaggcatagatccttctttgaacaatctagctatgtgccaattcctagagtatctggcaaatgacctccagcttccttaggctcttcaaaacagttaaggaatcaacagagtccctcttgggtccaaactgagagaaggccttggattttccaccacagaccaacagagatttctcagcccatagggaaattctggtttatgatgaaataagattgtttatcctcaacccagcatttgcatatatgtatatatcccaatacatctaaacatttgttagtcaattttgactatatcattttaaattaagccaagtaccaactcttttacataatttttatttcccagtcttcactcaactgtagatttttttaaatgttaaattctcctcttcctacaatttgtcagactgtatgattttcttcaaagccagtcagaagcccaggtgcatgcctactcaagttgtaaaggataaaaatgtctatattcttaggagatgttggttttgaaagatttttggcttcctctgtcctctcgagtacatgggcattttgattttgcccataaatgtctataaagagaagacagagtactagcttccttcatttagtagtctagcaaatatttaaggaggccgattctgtagcagacaccatcccggcctctttaaagaactaaaggagccatgttcacatggcaagtcttcatttgaacttgggggacatcatagcaagtgcggatagctgtctgtatttatataaataattatttctatacctgaattcttttagaccaagaaattcaacgtctgaaaatggggatggaaactttgctgcttgccaatgaagataaggtaagatggtcattgggtagccctgtcttttccatgcttacatccctggctgtgtttggtccctgctggtctctgatattctggacaggaccatgcttatcatgccattgacatagggatatgtcaggagaatgacttgtgccttctagagacttggcctcagccacctgtttttggctttgataactggaaagtttgtctaaatggaatctcctaaaggcagattatagccctgcctgttcctgctggtgtggggggaaaaaaatactgctgtgatcactgccaatatcatagctcctgctggaactcctagcacaacagcccaccagtctcccatgtgcatgacctgacaatagaaccatcatagagacacttggcagtatgcagtgcctcagtttaccctgccatcttatatccttcgcatctaatttcggcacagtcataaatagccacctctataaataaagagtgcctggctggtataaacatcatctctgaggatcacaaccctgcattttacagatgaggaaacagactcagagtgcttaagtaatttggcccaaggtcaggtaactagtaaatagcacagccagctttcacacccaagtttgtctatgacctgtgtggtctcccaagttcctttcaaggcctttgccttgaaagaaacgatcttctctgggaatttcctctgtagtatgaggtatctcagactcctagggaacaaatgagtatattgagataaatatgacagctttattttagtctttttttgtgtcgctccagagggcaacactaggaccagaaggcagatttcaatggccacttcaggaaggtagggagacagtgagtttcgtgcttctgaaaatgtttaagccctgtgaagggtgtctcagatgactcacagtcttcaggtagagcgtgaatgcctgcagatgcctatgaggcagaccactgaaatcccagctctgtggaatggggcctggacactcttttcctttggttccacgtgggatttcttctccttgtgccaagaacatagcgtgggttccaaaatgaaatcatctgagatgccagcatagcattaatctaaatctctacttgcactatggcaggaccgtcggatagaggagcttacggggctgttaaaccagtaccggaaggtaaaggagattgtgatggtcactcaaggtaagagcaagggcgatcctaccgttgtctctgaaagatattccatcagctgtgttaaagccaggggcagttctgctagcagctgtttcacctctgtttcagagaagactccctactggagaacagagctgtttagacttttctgcatgatgagaacttagcagttgttgatttccagaaatactaccaaatggaagtcagcttagggccttcagggactatccagatcaccaagaatataaagcttgtgaattccccacccttggaaggtctcttatgcatcttcccaggacacgccttagaggcagcaagtgcagttaaacctggatcaaaaatcaactcagtgccatcattggggattagagctcatccacctcctagaaaatctaaagttccgcagcagactcagagggccctctgggagccttcctcgagttgctgggcctgagttgctataggaagtcacaggacagagagagctgctgtgttttatatttgctgcccagactgaatgcaacatgcaagcagcatcagggttcttatgggcatagtggtgcatgtgccgggctgccttcattgttcatgccattgacctgggctcccatcatagatcctgaggaagcagctgtttcacagcacagggctgctttgaaggatattcaggaacctctgattctggctgagcttctgctgcttcttgggaagaagccaagcctctgccaggatgtgactgactggtcactggccagggcctctgccagccctcacacacagccctcttttttttctctttttgagatggagtgttactctgtcacccaggttggagtgcagtggcacaatctcagctcaccgtaacctctgcctcccaagtttaagcaattcttgtgcctcagcctcctgagtagccgggattacaggcactggccactatacctggctaatttttgtatttttagtggagatggggtttcaacatgttgaccaggctagactcgaactcctgaccttaagtgatccgcctgcctcagcctcccaaagtgctgagattacaggcgtgagccaaagcacctggcctcacagccatctttttaagatcatgggtcaagtcactctcagggccttgattgcctatagctaaggagtgagaggtttggaggcaggggtacattacctctgttctgcagataaactttgaccttgaaatgatcctgatgccagcccttgctcagatgccctgaagaatcttcagaatcacactcttactgtccctttatatatttcttagtccttcttaatgaaggagaaacaatgttagaattttgtggtacgattataggtttctgaacatgaattcaacaattcagtcttactaccttaatgcttgcagggccttcggagagaactctctcaatcaatgaagaagaaccggagggaggtttcagcaagtggaacgctacaaataaggaccctgaagaattatttaaacaagaggtactgtgtttccatccatgacgtagggtttcagcaggtcctccgagcttgccctgagcttgagggaggatctagtcagacacgtgtcaggtgcacatcttggcaggtgaatacttaaattaatatagtgcccctcaggctgtgatggggatgggcgagcaagaggctgaggctctggcctgtgctctggttggaggcagcatggtggatactggaactttcaaggataggagttctcctttttaatcaggctcctagtttatttttatcttttttttctctggaatgtaagcatagaccaaaggtgatgtttgatttatctaccaccctttctccaaggtctgcagtaatgcccgatacccagtagaattcaacaaatatttgttgaatgaacgaacatgtcttgctcatttagaggaattaactgcaacctctgaaatgccgcattcctgcttgacagatacgcccttcagcccctatagccaggacacagattttccttctcatctatttcgtttgtttaaaatctggtcctattgtatgaatctctctagacttaagctagatacaaataaacaaataaacaagacctcaggtgaaggaggggcttcagcctagggtccaaaagattcctgaaaacgtcacactatcaaattgaaaagaatcttagtgcttcagttcaacctttttaattaaggagcaaaagcatcatccagtgagccagttattgactcagaacaagcaccccagattgctggcaattacagaatagcggtgtccaagtcttaccaagtcttactggatacctccacgtggtcactgtgatgaacattgtatctggcagaatatggacttgaacccaggtctgaccacaatgcccaggtatttaaaactatactataatgccagcgttgttgttatagtagaccaagaggatgctaggatctagagaaaagaggcagtactggagacatgggactgtcttctttcataacctccattagctcaaggtggctccgcctgtgatgctaggtgcactgctgaaggcacagtgttgtggtaggtacaatactgaagacacgggactgtattatttcataccatcattagctcatggtctttccccctgtaatgttctttcctttcttgccttaaccagttctcatttctcaaaattcagctcagcttttctcctctctaaagctttctcagccttccctctggtgagagggagcccctctctcccactgttcccatattgtgttacaggtgttggagccataagagcattgcacattattctgttatcctagtgtacttgtctgtctcccagatgtggggagtgcttgctccagacctggcacagggcctggcagggagtagatgttgctgatgtttgtcgggtgaccatatcaaatgggattttctcattgaaagcaacaaaatttggctctggctaacctaagccaaaaagaatgtttttaaaagagtctgcagtggctcgctgaatgaaaggaaaagctgaagaaccaagatcagaaagggaaggagcagaaaaagcccaagaacccaggtctcaggactgtactactgggatatgaacatgatctaagctctagggtccaggaaggagaggcaagctggcccagatggactgataagcctaccacacccccttgcatcttgaaagagcaaggcatctataatgatgtatccaccatggctgcacccagggaggaaatgtctccctaaaaggaatcatgtgaagcagggggaaagatggtgggtggtccccaaacagactgtcctctaccgtgactcttctgtctctggtgcagatgcctccaagatgtagctctcctacagtggggccacctccattgccacagaaatcactggaaaccaggtaagaggcctgggcatttccccacagccactgtgctctcaggcttgccttggggctgccgaagtagatggtgatgaccgtgaatggtgagcatggccactgagtcctaggtgcacctgcccctctgttgttagggcagttacaaaccaggcctacctcttttggccacagaagggcttctcatccttcaggctgagggtgtggatcattgtcactgagaaaggatctggccaaggattagagcctcagaggagaggtggctgcaactcatctgtgtcttatagcagctcctcagagctgagagcatcccgtgatgtgtgttccttttgtcagcctctgcctcctgctcttagagtgaatttagccctttgacagtcgaagctttctagggaaggccatgtcttctcatagcaattggtctaattgctttaaggatgcttcacaacaatgaactaataatgggctcgcctctgaggtcatttgactgccatctgtcttgttccctctaaaataaacctaaatctagttccctatgtccgtacttcagcacacattttgaaattgagccccatgtaagggagacatggaggcttcactaccaaggtactggcaaccactaccaggctgcctttcagctaaggtgttggggcagatgaccacaagcatcacagaaactccccagaatggtgctgagtctccagagcctgcactctgagtccactttccagaaagcagttgttcccttgagcctttagcccagaggaaaatggtaatgttagagaagttgatcaggcagtccttagttttggagaataagaattgtggtttatgagttcactgagggaaaggtcaacaccaaggaactcggactgaccagatttacaagagactaatattttttaaaatgatgacttactcgtataatctgagaaatatgactgccaaggagacttggcacaggttacccttgtgaccactggtggcattgcctcttgacacatttggtgcctttctctgcaaaatagaccctgagagagccagatgagtctgagcagactagatgggcatgcagatccagagcagagtgtggcagggtcctagcaagtgatgttctggagccatggctggttaatgtgttcatctctactctaaggaggcccaggtccctcctccctggattactcttagactcagacaagcccagcatcagcacctttcccctcttttgacactgtagaccttggccttttatgaccgcacaattgtcacctcagtgcagcagaattgagtgtattctggctttttgtgcaatgccaagaacatttcatttggatttaagtgaccctgtcatgcccttactaacacattattggaccagtctgtcccccaaggtgggccagtctcattttgtatgtaaaggctattatgagagggtatttttttttcttgactttgaacctaagcccaagaccatcggttaagcatttgaaatgtcctctgcatgagtgataacatgtacctccttctcataactatttctttcttttgtgtttttttcagggctcagaaaaagctctcttgtagtctagaagacttgagaagtgaatctgtggataaggtcggctcatcaacctatccttaaagatgactgagttacttttttgggcctagcatagtactgggatatacaggcaggtcctggtccctaccttgtagaggattttataaagttgtagaggaagcaggaattacatgaacattttgagaaaattaactgggtgtggcccaaagcatcttagaggaaggacaattcaggaaatgttgcctggagttgatgagagaagatgttgagatcagcaaagcttggttagagtctgctgagcaatagcaggttttggaagatggtggagagtaggaggaggtaaggtcagagccatgagacagatcaagccagggaagatcttgactactagtcctatatccctggggcacttggggacatcgtatagatttttttaatgatgaattaatgtgaataaaggagatgatcccaaggaaagatgtgggatcgtcaggatgttggagagtgagctgttgtaagagtctggaaagatggaggagggtcttgtggctccttatataggagtagcccttgatcatgtgggtggacctcatgctgcaggggacagtagcaggctcttgagcttggtcattagagaccaagggagcctgccctgatagagacccttcagtgagcctgtgctgcataccatcccttggtctccaataatgttcatcagcctccttgttgatacagtggagaaccataaaggctgaagtctgcaggagccctgggatcattcagtggctctgctcccatggtcacgtgtctctcggttgccatggtcatgttgctggcagctgcccaggacatctgtccatggagttggacagggatctttcctgccctggatggtgattacttgacatgaagatgtggagggaggggatgcgcctttcagatttaagcaaacaggtagtcctgagttgttgctgtttgtgaataacacaagtctctttttctccacataaacgaaatcctcatgttactccatagtgtatggatgggaaccagcccttcccggtgttagaacccaaggtacattgacttcgtgccccgtcgtctatttgtggttacactgtttgctagtattttaatttagcaagtcatagttttcataaccttaaaatgtgccaactgtaaggagtaagagggcaagaggaaagacgcaacttttctctcccattttatttttatgtgcactcagctatttaatatgcttttgctatcattatctgtgggacaggatttattattatcacctccattttataggctcagagaaattaatctttaacaaagtaatctagatttaatcactgggaaggggattgctacgatctcagcacactgaagaacgtgacagctctcatcctttctgtgctgatatgtcatggttaaaaaaacacaagtgtacactcagtcccgctttgatgaacaagttatgttataaaaattccattaggactgatcttctccagggaagcctgttgtggaagaggattaagtttttaggccagtgcacaaaatgttgagcccataaagaaatgaagattcatataattagcatgatttcagccacacccaaccaccatttataacattatatggaaaatgtattgtgaggctgatggcatttcccttctctgtcccctgcctccatgtccatatgaaacatggagcttctcattgcttgctgacttctgcctgagagggtcattttatattttcacggtaaaatggggcatctctgctcctccacatctgcgtaagagaaagatcttttctgcacgtctgcatctatataaggggcttctctactcttccatatttgtagcagttggttcttcaagtgggcagccattccttgggccatctgaactgtatagcaaaagtcttctgcctgctcccctgcccaggtgctctgcaacacagtcccttgagcctggggttggtgtggtccctttgtgaactgaaaggcttcctatggcgtcagctgttaaatcgctcagcagtcccccctcccacctcagcgtcacagaggtcattcgcaggtgtttctaaagcacacctgtaagtgaccacctgctcctttggaaacacacccagctcacaggctcaaggtttaagacgccaatttgattaccaagaaatataagtaacgtagaactatttataaagaaaaaaatgctccagattaaaagattaattcttacatggttttggccataatcacaatcttatacaacctcagttattcaacatgaccaccctcccctctcacccacatacaccaccgtcctccccagaatagctacacaggtgcagaaccgctccacagtcatctttctgcagcatccctaactgtagtgtctggcccttgcttaaactggctcttgctttctgtgactgagagctcatttcattggaagacatcctttgtattcttttgcagctgtgtgagcttctctaaaatgtgcatctgctgatcctctccctccacatctagcccatggaaaaagtcaatctcccctactcctgacagctctggaatttaagtccctcatgccctctctgagtgctctgttctctgggctgaacatcaccttctcatgtgcatggatcacaagccttttaagctgctacttagtcttcttaggctcagcgctagtttctcaatgtattcttcaagttctgccctggaccagacttggagtgtgatattctagatgtagtctgaccagtgcctgccgtggtctaaggactcctcttctagattgctatttctttaggccctgggtatgtgatatttcctgtgcttctccttatccactgtccgctgtgtgctaggccctgtggatatgttatttcctggcaaacctgaggtaggaattgttattctccatttagaaatgaccagaggtcctgagaggtggaagagaaacagctctgtctgagttggtctgactcaaagcctaggccctttccactctggcatgctgcttctctgttgtaatttaaagcagctggataatcagttctacactactcccttggctggggcttctgttcccctacagccaggaggattgttctttttggagacaggagaaacagaactggagttgagcatccttgtttcctctgcgtcacgtcttgacattgcactgccttccacatcagtgagtcatttcttcccagcccttattcttggcctgagcagagctcagagagccctttccattgtccttgattcctttttgctgtctttcttacaggtcggggctgccttttaaaccccatccttgggttaggtatgtgttctccttgcatctcagctcctcagggagctccccgggtggcccacttgcttccttggctgtctctgccctgccttgagggagcatgcgtgatgatgcaaccagaaacacgtttttgagagctcttcccccctccatatgtcgtatataatagggagcttggagtcatgcccttcaggtctctaacatctttgaacactaccttctcacagtcagtggttcctgggtctgactgcattagtataatctgagataatctgagatccttgttaaaaatatagacatctggggtgtgcttccagagggactgaatcagggactgggcactgggaattcatgttgttttacaagtgctccaggtaattatgaagagcagccggcacatgaactaccacttggaaactgtgggtcttgaccgtatgtctgatcatgtctaatcttcacctcatgggtcatcacaaacttgaaaatctcatagccttcctctctgaaggttctagttacttctactccaccagccagttctttcagaattcagtttcctctcactgtatctctcctttctgaactatttatggggagttaatagtcaatgttcaatgaatgaactgaatctcaaacaatttctaggacatatgtttataagcaaattgaattggaaatatattggatatttggcctttagctaaatggaacttcataagatgtctcagtcacagcagccttccattactgttgtgacttgccagtttgaaatctgttttgttttttatattactttcttcaggatctaatcaggtgatccacagttgattcctttagtgacattgcttcaatttctcttttcttttattctcactttcacagcacattccactgtgtttctctcaggtttgcagattaagagaggccattgtatgcctctttaccaaataagtgctatcttcttcctcatttaatcaacttgtttctttgggacctttccatggccagggtccaagcatggagctggctgcactgaggctctacctcgtgcagactatgatcctaagttcccaaaggagctttgttggcatgtagtcctctggcccatttcttgttgtcagctcccccaagggtgtgtgtgtatcttcatgcttgccttaacatgatgttttttaagaagccatgatcacaatatagggattttttcttcttttgctccacatttaaactataatttcccttctgtaccatagccgctctcaggcaagatccatatcatttatgcagttggtcaggccctcacagagatctgcccttttctggtctgagtaagggttccaattagcagaagcacctctctcctcaccacaggaaagcaaatctgggggaaacagaggagcccagaccagactgagctcagtttcctctcttgcaggattgttattttacatatatatgtatgtatgtatgataaaacactaggcagcttttattagaatgccaattttcatatccaaagagcttacagagtaattcacggctgttaattcattgagtctctgagcactaggccagacagcaaaggccgctttgcaagacagcttcacttcctgttagagtcagtttcagtcagccccagatttgcacttgactctgtccctgtcttactgtgtggccttgggaaagtttcttccttccttggaactctggtcccctttctcggactagctaaataatctttgaggggtgttcaagtcaccatatgtgaaaaatggctcttgcaaaacagggagttgttctgtatccaaggatttcctaactgaggctgacagttaagtcggtatctctctctttctctcaccttccaataggacagccctttcttggcggagcacaaatatcccactttacctgggaagctttcaggagccacgcccaatggagaggctgccaaatctcctcccaccatctgccagcctgacgccacggggagcagcctgctgaggctgagtgagtgtccagccctggtgctggtggcctctgagcagtgtccttggcactttcaatgattgtataagatccctgcacctaccaccacaatccacaattggagaatggtggggtgggtggctggaacaagttgtaccttggggtggtcccacctccccagaggctccccctgggcgagctgttttctaaggtcagcactctacagtctcagcaaaccagggtgtgtgtatcccctacttcttttcggctgcagcttttcacccttatttcctctcttcttctcttcctcctctcgaactctttcctgtccttcctagcattgttttccctcctctcagacacccccttctacccttcctgcccctggtgcttccttcctctgtcattctgatcttctctctcctgtctccaccttcttctctgcagcttccctattccccgtaggagggtatcatgcactccaagtgggagcatttccttaggcaaatgaagtcagtggccaatgggcaagggtgtcggtctgcaggtatcctttcggtgcgtaagacctgaaaccacagaggcttttgctgcttttcattcaaaataagccatctttccccaccagcagcaaaagattcaatggccccggaagggaacattctggtcctggcagggttcttcctgaggctcctcagcctcagctcttccctgagctggcccatgcattggcctagtgaaggccagctctgccgttggctgcaggaacttcagataaacccttgaatgagtgtgttctagtgacactcaaactggactcactatggcttcagattgttctagtctgagctgagtgagcccaggcacctgcacaagagctgcctgtggcctggagtattcagcccctgctgctgtcccttcctttccctgggtgtggacacctcagcctgtcacaaaggggccccaggaacacttggtcccctcacatgaaacctcttctcagtgtcagtcaccactcaccccctccttctccatgggattatttttctttctgtttgagtttttctctcttgctcgatgacactcttttgtttatttctttgcttccccgtaactctgttgggctggactttggcctctcttgtttcttcatgtggcttctctgcttcttggttcactggagatcgtggccggagtgtcagtgcccccgtattaggtactgtacccattccaggtgaggtggagagtgagaatgcctttgtttccctaccctaaccctccccttcaccagcactcagccagggacccactactgcctgcgttcctgcatctccctctgaggaaaaagaagctgcttgttggaataatccacaagtactttggaccccaaatccttaaaattaaagacattagctcacctagatttgaaatattgagcacactaatttctcagcaaggaagcctggagtccccactagtctctgggatcttggtatggagttctgccctgaaggcagaactgggcagattctctggactcccactgaaggggagggcccaggcttggggaagaagggttccaggggtcacatccttacattcacattcattgccttcttccaatctcaggagacacagaaagtggctgggacgacactgctgtggtcaatgacctctcatccacatcatcgggcactgaatcaggtcctcagtctcctctgacaccagatggtaaacggaatcccaaaggcattaagaagttctggggaaagtaagttggtgccgttgatcctaattatattgcttagaatttttctttttgattgggcaaagagtctatgtaagcccctggtccaatagacactgaaacagcagtcaaaacagagtgttcatgttcaaagagaagaatctgagatattttccagggccaagagaaggagaagtatgaaagacacccattgaatatatccagttgcctttcatgtcatgcatcctaagcacccacccattccacacaccctgaacataatctctgcagcttatattacattggatctggcacagacacagatgagactgtattctcccttcttaggagtcagtctgttttaagaaatctttgaaaaacctttgaaagccaagtacttgctggcccaactgatccactttgtgacatgaggcagaaactggggcctcctacaaggcatcaaactttgctttgacttctatggcaagtgaccaaatcccagaggcaggatccgaattgaggcttgagtctggccaaggagctgcgacaggttgtgatccttgatctctgggaaggtacggagaagcagtgctgccgagagtccctgtgctggcctgcatggccttgcaaaagaggaagcacagtgactgtaggctttctgactattccatgaccgtctccatggattcttctccatgcagaatccgaagaactcagtcaggaaatttctacactgacacgctggggatggcagagtttcgacgaggtgggctccgggcaaccgcagggccaagactctctaggaccagggactccaagggacagaaaaggtaaggcttgacccactttcctttgatctccctgctctgaaaaagaagtatctcccttcaaacctgcatgggtgaatctttactcctgtgttttgcggaaacccctttccatattctcttccccagtcaagcagtccctacagtacgtcatttccagcacaatatctcctaagttctgagttactcagccaagatcagtactcctggaggtcttccacaggattggaatgtgacattttatatctaaccaaaaggcaaaaagtaagctgtaactctcttcagtttagtcacctcaagattgccatataccaatgcagagtacaggtaattactggttatgatatgtatcattcagatgtccgttctcagaaataatatagtctagattccaattaaggaagaaaagcatttccctaaatgcatcatattgtttgcagacctgcatcccctgcggaagggagtcttagcttattttgcacatggatatgatactgcacttccctggcttgccaaacaggtttctagtcttaccaggtcctcctcgtgcatgagacctgggacctttccagatccatttattcttcgatgagtatccccagactccaggaagcttgaaaagaagcatgagaatgtgtagaccattagcttttagaggctagagaatctaaggacatagtctaagtaagtcagagaccaattcagagcccttagaaagtgagccagggaaagctttacctgtatattcaataattagatattctaatttacttggcaattttctcaatgtagacattactgttgtttctgatttatctgagctgaaaaaaaatcaagctatagtaagcttgaatgattgatctttgttttaattctggctagttcttgaaggattgactctagaaggggaatcattgggtcagggtataaaaactttcctaagacccctcagcattgtccctagagtaggagagcatggttagggagctatctgtattctgacagtcactttagggtatggggtgaccagggtcagtagctttctttgccaaaggaaaaaactgcagttccagccacaggctgctttgttcaaatgtctttgtgctttatgaaccgtaacagtggatgagaaagggaagacgtatgaagaagtcctgatgagattgttatgtttatcgtaatggtgcaaaatgaatttgctcgtggaaaagaaaggccttgtgactcttaactagaaattgatatatgttaatgtcctctggtgatatttataatttctagatattaatatttaggtgtagctttaaaactgttgttgctagtattctttaggaaaagtactttgatactgaaagcctccagccccaacctttttttgttcaataaaacaattgatttttttttaaatatgatatttgataacattgtgtaggcactctctctcagattatggatgaacacattttattttctttcttctcccaggtaaagttttacagagttacattccagtcagcactgctggacagagtgcgcctattacacccacatccttgtcagcattgagtagttaaatttttctttttcaaagttttctacttttatgaacctccaaatttcctttttattggtaatttagttttcatgtttgtccttttaattcttttgtgaattatctgcatttttgttcattattattattgtatttcttatagatttctaactgttctctattaagatattaagtcatgtctagtaattgtgacaaagtatttttaggtttgtagcagaattttacttttgcttctgatactttgatacatggaatttttatgtttatatagaattaggttcatccactttgtgaattctttcatcattttgttttaaatttttttctgtgatttttaaaaactttgaataatccatttaggaattattatagtttgtgagtttattatgagttactatttttgagaaaaaggcagtaaagtataatgtttaaggcaaacaggctctagagccacatggctggatcccacctttgcggagtgtttttttcctgagttgatctactgactgtattgcccttcaggactccagctttaggagaggtccccaatcctactgctcccctaccctgggccccattttgtttccttttcctacacgcatggtgagtcagattcatcatgaatgtaaagatgcttaagcttcagggaccctcctttgtatggagcccttccagggtccagagaaagtctgatcatagtgttaacagggccaggtgttttgaaaattttgcctaaaaaaggtattttaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcccgccactgcactccagcctgggcgacagagcaagactccgtctcaaaaaaaaaaaaaaaaaaaaaaaaaaaaaaaaaggtattttaaacacaaccagttttaagactgctgactatttttactgcaactttcccttggtctatacttttccttgtaacagatggtgttagggcagctgtgggggttttggaggacttgctaaggggaagttgacctggggatccatgtagtttgggtttaggggggtatgtgtgtgcatgtggtttgcagtcactgcatgtttagttttgttaggtttaattcactagctttcctactgcacaaatggcttccaggatttcttctacttcccattgtgccgattcgctcagtgctctgtactcactaatgaactgtaaattataaatgtgccatgtgctctccccctactgtgagaagagcatatttgagaaatctcagctacatcatttgaactgcaatttgaaaggatgttttggaatgtgtcaacaaaacaaatggtttggctgtatatgaagggtatcttctctgtcatctccaaattatttcccagcgtgttcagtggtgccctggctgaggatatgggagatgctggcactgagaggagctgaggaggaggtgcagaagctgggtctgattctgtgtgaacacctcaaggcttaggagggaggagaggattcgcaaaacaaaaaatgggaagactactggagatgatgcccagagctctaggtggttttgaaaaggtcgatagcacagaggttttccaattatgatctcaaaaacacttatttcccctttagagctgaaatgttaggttcacaaagactaggcaaaaaataaaagttaaaaaatttaaaaaagaactgaaatgtccctcagatatgtttgtttttcccacttccaagaaacaaggaaacaaatgaaataaaaaccaaatataatataaaacaaaagtgataaaatgagcattgaaatttgagagaaattattctttcttacattaaaaaacaaattataaacaaaaaatccagatcacaccaaaagcagtaatttgctaagagcaagaggtaaggtttaaacaaaaggagtgagtagccctctagattgttgttcatataagatgaatgatatgaatccattgggaaaaggttgaaatttcttgctgagtttacatgatgtactgacagtgacaaagataacataaaactcatgtactgccgcaaggacatagacaacacatgagttaaatgaactttgtcaattcaaagaatgtttaagattagccatagcgttagaaaacttgaatgcgttatagttttacaactcacatataaaagacatttgatagaggcctttctaaatttaaatgattctaaaaatgtacgtgacaataccagttataaattgtgaagataaaacttcttaactattgtcatagaagataaatattgatcagtcatgctagaagaaagactaaatcaaccgtctgttgtcatagaatatattataaagttgtggacatacaaagaagcagtcaaagagtatccacccaaaatacaagagtaaagaagtactatagctggatacagtagctcagacctgtagtcccagctacttgggaggctgaggcaggaggattgcttgagcccaggagctcaaggctgtaataagctgtaattacatcactacactccagcctgggcagcaaagccagaccccatctctaaaaataattaattactaacaccctgtctctaaaataaataccccatctctgaaataacaaataccctgtctcaaaaaagaatcaaactatagaggtacatcaagattttatataatgaaatatttctagattttgtgatttttttttcagttttgcaaaacttgcaattttttgtggcttgttttctaattctaaatattccctttgtttctaattgtatattcaaattttatactattttgaagagaaagtttgtaagttccaggcctcgtaaaatattttcaggacccatgaaagcccaggttccagattatgattgatcagtccctgccccagggtatacattatctctaacatttgatctaaaatggggcattcttatcatgcttatcctttgaggaattccctcactttaacaacagctcaaccaggcatttaaaaaaatatgttttaatctaatatgttaggggtactttgaaggaatctttctggtctttgaaggaatatctacgatattctataaatcctcatttatgaacataaagttgctctgtcgaatcccccctaaaaaaatgactctattgggatttttagtgtgctattcacactttaaatgaaaaatggatgtctttaagaattgatggctttataaaacccagtcatcctgtctaggaacataatctagcttttcatttattcatgtccttttttatctagctcagttgactgctgcagtcaatacctctccccacccccgcaatccccacacataatcacacaaggccaaacatctcttgttaaggcaattcctagacgttttataatgttggttgctatgagtgggatttttaaattgttttaacagtagcattagtatctgtgcattgatggtattagaaaattattgatctttgtatgtaacatacgttacatatgtttatatgtgtatttcgtaagtggccacctcactgagctttcttgggttttctaaatgggcagtcctgacatctgtaaagaatggctttatttctgcctaatagctatacttcttgttcttatttatctctaatactggctatgactctcagaccagtgttgttagtactgatgaaaaatatattgtccttttattgactttaatgtgaatgttcctcctgttttgttaataagtaatgtgctagctgttgttgattggcaagtttttgcttttagttttgggtgttttgttttttttctttttaatgttaagagaactgaccctcttaaatgctaagaaaagtagttttctaagcattttcctaaaaagatgattccgcctaatgaggccacagctctggacttgtggcatgtatatgtgtgtatgcggacctaggacatgtgaacatgatctcaggagggccatacaggctgccccattctctaagtagcctgagatttgaaattcagatcttgtgttattaagaaaactctagggtctacctcctatgagtgtgttgtagtggaattttgttcagcagaatcccatgatggaggttgtttgttaaaaaacaggttttttgttttgttttttcttttcttttcttttgtttgtgagacatgattagattcagaacctcaggctctcccactaacaggaatatgctgttttcctgcttcccagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggtaagggctcagcttggggagaggaggctcccatttctccccaaagcatggggaggccagggtccgccactcctgtcacacatacacacaggaggatggatggaggaggctgagagttcctctgtagctgcaggttggcatcccagggcacggtgtggagatacactgccatactcagagcatctccacccagacacagctttctctgagggccaaattgcctgccaaaatttcacatgtggtcttcatcttttaatttcaggagctaggaattaagcacccactccacaggaagaagcttgttttagcagtgaaagccatcaacaccaaacaggaggagaagtctgcactgctagaccacatttgggtgacaagtaaggataggcatatatgtattaagaatgtctctggcagcaactaagagtagaaagaattttcctgttaaatgggtacctcaaggacagctgtctccttgtaaaaagcagaggaattactaaacttttgggggaataaaacgaacctcaaaatataatttgctcccctttttttggtgtctacattctctcattctcatgaatcctgacacatctggggtttttgtatttgtagggtggcttgatgatattggcttaccccagtacaaagaccagtttcatgaatctagagttgacagacgaatgctgcaatacctaactgtggtgaggactttttctttaaatatttcagttgtccctgtgagcactcagctcacgtgtacccatggtggttattttaaacttgattccatatattcttaaggccttgaaatagtatcatttgtcacaaaagaggtcccaagtagcagagtacaaaccactgtgataagctattggtgtctccacgtgcaccttcctgagatgtggttgacttgtctatgcttggtctggtgagggacatcaggggtcttttgtcactttggaaactctggtttataaaccaaactttcctctttcagaacgatttactcttcttaaaagtcaccagccaactacatcatctcagcatcaaatgtgccattcacgtgctgcatgtcaacaagttcaacccccactgcctgcaccggcggccagctgatgaggtgagaccacaaatagtatctctccaggtagccctgagccaggacccctgaaacatcgagcatgagcaaacaagaatgacatcataaaagcactgttttttgcaccatggtgcctgggattcttttgtttgcttgtgcttcctgttgccccaaacatccgttacctgcactttgtgtctcacagtagccatagacctctaagctcccaccctccactggggagacacatgctataaagtcatcatagtgattaaaggagatgaggagatggtgcaaaggagagggggagggaaagacaaaatggaaagatgggtgtcacagtagaagagaagagaagagacagaggagggggaagaggagcccgtagaagctagacatttcagaataggtatccctacttgtagatccaaaattaactgacttccaggcccaggtacaggggatccatgagtagtcttgctagagaagaaatagtatacgtaaataacagcaccccaagtcttgaagaaataactgattatgttccatgaacttcggagttcttggtggacccccaaactgaagattgtcagtcacatcctatctcctctgttcctgggaactaggtctaaccttgctgtaaaattaactcagcttcctgggctgctacctttgctgtctatctcctattttctccttattcaaccaacatgttttgaatgtcttgtatatgtcaggcacagcgctgtgcatttttaagaccacagtgctacgtgagagcacttaggaataagtaccttaaggtgtgctcccctaaaatcattggccacaccagggagatctttcatctataaaccacttggattgtaaaattgacagtcatctttaaagttctgttgaatcactgaaagaataactataatgtcctcatttatttgtctcaaagttagctggaaaatgatggagtaacagaattctggattcagatatctcagtgtggaagatcttcaaagattcagtgggagctctatttcctagaaactggggaggctggtgctctggcagatggggtgggtcactaagcttgagggccttctattgttgtgatgcgtctggggcagggttacttaccggggctgactccacagaggaccatggtgggacctattaagcctaacttcctcactctccttctccctctgacagagtaacctttctccttcagaagttgtacagtggtccaaccacagggtgatggagtggttacgatctgtggacctggcagagtatgcacccaatcttcgagggagtggagtccatggaggcctcattgtgagtggctctctggcctagcccacctgccttggtgcaaatgggatattcagaaacttatttattaaggacaaggcacaaaagctaacgaaaaaaaataggtacttcatctggaggtcttgcataatttgatgtctcaaagtattttgataacttgtccttgagaattaatatacctcatggaagcaagatgccttctggcagcacctccttggcatgagacttgaggattctaggtcgatgggttgcatggagaccaacgcttacaaggcgagggaacagcagggctgaggaagggacggggaagccgtaaaaatgcagcttcccacttgctgcaataggatccctatcactactcagatctgtcagtggcaaagccagaggggaaatgaggaagtgtggtggcttggatgtcatccagagaagatcctgagagacagcctcaccaaagaggtcccagttctctgctggtctgtgaaaacaaggtggtcagtcagcacatgtgctagtatgtgctcagagccaggccctgtgccagccagtgagtggagtgggactcagaacaagtgactgagctcctgtccctcctctggaggcacccccagccccaacaggccagtctctcagcatcctccccctcgagccatttgtatttgctcctggccaggcttgtctctggttccttcttagatcctggagccacgcttcactggggacaccctggctatgcttctcaacatccccccacaaaagacgctcctcaggcgccacctgaccaccaagttcaatgccttgattggtccggaggctgaacaggagaagcgagagaaaatggcctcaccagcttacacaccactgaccaccacagccaaagtccgggtgagttgcagagcctttctgggtgggccctgggctgcctcctggccctcacgcagcacagcacctggcgcgatgcccacagccagagcagcatgcgcagcctggacaaagaggatctttcagcttctgctgtgggcttgtggtctgtgaggccagtctttgttaagccagttctccaccagtttggagtccaaggaagacagtgcaggtttctttacctagaaaatatgtgcaggaagcacctatcctcaggtggcttagagctcgtcctctaccccactgctgctgtgactcaccttgcagagcggaagcgctccgagtctggctttccttcggtcaggcctgcctgcgtgccgcaatgccgtgggatcttggtcaaagctgtcctgctgatataggaagtgcttccaatggaagctggttccatttgtcttgtttcgtgaagtggccagcacacagatacccagaggtccccaggtctttcaagcaccaacactactcactggggctcccagaatcccacaaagccctttagacctgcctgagccacagcatcctcagaccacattcttcccagactacagaccaacaggcaacctctggaggccaggctggtcctatccctggtagtgttgatgcttcatgcccagctacaactcaggcacagacctccttccccaggggagcaagacaggaagtatgtctgggggagtcaggcagaaacagtgctggatgacgctagggcagggagcaacctggggctatcctacgcgcctttagatggtgccaggtgctgagatgggaaagggttggggtgccagcagctgtgctgaggcaagttctctgtgcttcgcctcaaatgcagacctcaagtacattctaaaggaactcccagttcatctatggaaataagaaagtcactttggtggggcagccaggcatgagtttcaggcatagtattggaggggcagctcttattgttcaagattatttacctattggcctttctgcagcatagaaattgcttccaagagctctgttttgttcagagtctttctaggagcagtttacattattcctctccttgagtgcctgctcttaaattttaagtatattgtcagtcatacctgcacactgccttgattgccttctcataatcttgcattttctgtgttttagccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgc

SEQ ID NO: 37806 - DNA, 316414 bp, Homo sapiens
gcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagacatccctcccagccagcagattacaatgctgccaaactaaggatttcatttggactttgtttttcctgggaactgcaggtacattttttttttttttaattctcaatctggtttgctaattaccccttcctcctactcctaggaggaacgctattattttgggtggttttacgtggactgctaaggctggtcattttcgtttagctgtgaaaggagcgcgtcgcccttgctgcccagccgaaccccgctccctccagggctgcgctgcacggggctgcctccccgagccgccagcgcccggcgcccctccggcgcgtccgcccttcccactttgtgcgcccgcggcggtgggagcagagccggccggctcctggggactcagcggccgcgctggtgatgggcagcgctccttccccaaaggcgggcggcggggcgggggaggtcgcggctcgggtggtgccgccgcacgggctcggattccgagggggaagtggcttgtcagccccggctccgggaagagtgaacaataaggctagggcagccgccccagatcgttatattcctgggtctaataaagtcaggatcgctgctttgcttcccccgccccagaagaataacggtttgcaaaatggggcaaaatgggcagaatcgcacggccgttgttgttggtgtgaccgttgttgcaccccagtcgacatgacgttagtttttcatttgccaaattgctggttagttgcaaagcctaccctcggccgcgagcactgaaggatgggagggtcgagcgccgcgttttgacaggaggaagtgcggaggggcggagggcgaggagggcgtgattggggctgcctggtgtgtgcgcgcgcgtgtgcgcgcgtgtgtctttacacgcgccgcgtgcccagtgttgcacggggcgggagaagaatggcaggtagccgcccgaaacacctcgccctgtctcctttctttgggcgaggttcccgatcctggcaaagtgtgaacaatagggagctgggaggaagacagtagtgatgctgccgcgggtggcgggggttgcgccgccgcccagagaacctcggcagtgtgcagggaggtgcatttcattttggctatttccatcccggcctccctggaaaattcttctgtgcgtgcccaccctcccctccagctgtcatccccccacctccacccaaggatttgcgctttggctctgatggacgggagggaaggaagaaaagcaggggccgcagagagctgggtgggttgggcggacattctgggcggggggcgtgtgctgggaagcgatcgaggaaagccgggcggaggggctgtgtgtcgcggtcgcagctccaggtaccgttgtacctgccctggacggccgacccccggttggggagcgcacggggcgggccagggagcacccagtgcgccccctccgcgggcggcacaagagcagcgctcggccgccgcctccagccaactcgggtccctcccacggcgaccaatcagtgcgaagctggctgggcgggaagccgcgagaggcttttattgcggcgcgggtggcggccaggagctgccaggacagtctcccggtgcttcagcctaacggtctcgctcactcaccgccaagagaaaccccgccctgcggccggtcccccgcctgcccggcagtttccgaggaaataaaatggagactaggtggtcaccgggagtgctcctggtccggccgcccgtgctcgcccactctcgcctctttcacgccgacttggagcatcccaccgcccccgccagcgctcactctcgcgccgcggaatccgggcctgagcgcgtcgccggggagggcatcctggcaggcacacctacgcgcgtgcgctgaccggccgaccgcgggccgggggctctactgacggcggggcggggccgtggcagggcccggagaggaggggtggggaccaagcctagtccgcctggccctgggtctccgctgccacctgggcgggggccaccccggttatgcccctttccgcggtgcccgtgggtgccgcgacgcgacctgtccacatggggcgggggaaggggggtgtttttgagacatcctcgcccccgggtgggagcgtgacaatggagcccggatatttggtgggccttttgggggatcgcctggcggtcctttccatcatcgtgatgggtacagtcatcagtatttggatcccgtggaagttgcaggcccaggaattcccactgggatgttcctggatgcccaggcaggggaggcattctaaccagtgttccctggaatgaaagcgacctctttcctggcccggtaccttgaggatgggaagaaggcagaacgtgaaacacatacaaggttgcttaacaaaagaaagaagttgaatggttttccaaagagaaataatttcccattaaaatgtcttttgtaccatagtttttttttaaaaaaatcaaagaattcaagtcaaagggttagaatgaaaatgaaaacataacaacaagtatatatacatatgtatatatatctgaggttttttttttgttttttttttttttgttttttttttggactcaaatgtagcatgtccagggcagtggtaactgagtttgtgtgctcggctgggtgcatatgaaaatttacatataaggcaagctaaccttaatacgtcaagtgagtccgatgggctgcccctctcctctttctgtgtcctctgctctttagaaatacaatgaaaggttgtgcaattgcatagtaaatttgagtttattctagtataaattttggatgttttgaagaattgttcgcttgaacgatctggaatggttaagtcacatgtttacttgataattttgcagtcttctgccagttaaacttgcaagagtcaaggaatggataggactgggtttctaacaagataccatcggttaagaacaaagagctactttacaaaagctaacattgaaatcaagtagtatatataatatctctcactaagcaaattaaggtgcgcttccacaaagttgactgtgagcacagttatagtgagccatatatttttgttgattttcatttgaagactgagaatgtgtgtttttaaacagaatttcactgaatgtaataaaggctatataagaatgtggaaaacctttcacaactctaaccaaaccctagaaagattattttctttcaataaatactagcatatttagaaatattaataactgataatttgttttaaatccaacagagttattaaaaacagggaatataatccagacattgtagacgtgtgggctatgatttatgtaagtttttgagttactattccctctataaaggtcttaaagatctgctaacctagctaagcttccattagtctttaactgttttcttaagttaatgctttatgaacgccctctttctttccctaaattgttgaacctgataacttccttccagatacctttatctaggattttttttttaaaaatggaataccagaaaatagcaggacatattcttgtttagtaaaggagtttcctctaagtcttacaatgataattgattaaactaagaatatgttgatttaactggtgactggtttcttgagtttgatagttcaagaattaagatagtaattgcaaagaaaaaaaaatcccacatcaaaactgaaaaaaaaatgatgtgggtgtgctatttgtaagggatgtgggtgtttactgaaggcagcaataagaaggagaaattagtctgtagcacccccaaattccaagttttgaacagtgcttctgtttggaatccatttatcattaattgaattcctcagataggtaatatgtaatttaatggaagtaacctatatctgtatttttctgtcacaaggaacaatgtcttaattgcctttcaaagtaaacagcaccattttgtcactcaaaagctaatctttagacatgtttttgttcactacagaacccagtttctcaaattatagagagcattttgtaaaatttacactgcttaaataatggactctggaatttctgatgcaaccacttaatttttcaaggtgatgaagcctctgttaagtatgagtttgataaatttctcataattttgtctttagtattaaagaactgtggctgctctccagactgaaagtggcttcaatactactggcaggcttccaaagacattttacagacagtcctttctgacttagtgtaaaataagtgattgagtacctgttgctaaagaacgggttgcacttttaggatcttgagcttgtgatggagagcagaaccaattggcaggccagggagagaagggatcgcacctgcccccgtcagtctgcgggaagaatcatagactaggaggagacaaagacatcttataaaggctctcctgcaccagttcagcattgcttttttgagcacacacatgttttctggtgtcaagataaatattttaatgtaaattccataattgatcatttttcagtttagcagttataacatatagactaaggaatgtctggaactttaaaagaaatggcagcacattacagggagcattttactgatcttaaaactgggttacaaattacacaaaattgaaaacattaatcacgtggctgtataaaatgaagtcatttgagcttttaataaaagtcactaaggtgaaaattcctttggttaaaaagaaagaattctaagtaaaattcgaagaagaaaattttttacttttcataatatactcagtgactctgagcaatgctgtaagagatggtcttttaggaaggaggaaatgtccaaggacctctgaatcctaatgattaggtttctatgagctccagagttttcactattcgaaaacattgtagtgaaactatttttaacaatacaggtagatatgcttactacttactgtagggtaatagaatacagaagtcaatctgaaggtcatagtcctgttacctctagcctcttttgttattaactcttggggccaaaccttaaaaccatttgctgatgtaaagggatgtaaattatttggcgttggcagtggtgccattatgccttttcatttcatgttgttgaaatactgtctctcagctgcagatgctcattaggagcattgctttttgatgttggcctgggtgccaaatggcggcctttcaggcagtttcaatacgttacatttaaaacatgctcaggccatgtctacatgcagccactgagttaacggattttcagttgggtagacacacttttcctttcctgcagtattaatttagcttctaagcaattggagactccaagaggactgcactaaaaggataagctatttggtgtatcttgtgtatgtgtgcttttgaaaaacagattgtaataaacccattatgcattctattttcttccatatatacgtaacactttcttgaattcaaagattgcatggctgatatgatttaaaaggcttctatgtaacctatattccacttcgtactctgaggactttttgatttgtagctgcaaacatgggtaacagctgatcttccgttttctatttggcgtcattcctgagataaggtgtaaaatgccttttgttgtacattaatcacctcctttggtatctgattacctcatcatttaagaatattcatagtaatgtcacactgtttgagattgtgttacattaggtattctcttaaatagttgatcaaatatgtttattgagtgccagctttttatcatctgctctgtggggaattaaaaggagtgagatgacataatttctgctgtcagggaaccttgggagtagtagagactagagattaagagaggtagataaccctgggttgaaaccccagacatatcccttactagctgtctgatctcagacaaatgatttaactccttcaagtttcagtttcctcttccgtgagatcggaaaattagtaatgcctacttgttagagttataaatattttagagatcttaggacttcagtgcatgtaggcagtgttcattagtgagcaagaaggatatatatggatctggaaaaaataattatttagacatagtgccctctttttagaaggattttaaaaagggtattatgatacacaggactccttcagagattagaactaggcttaaaaaattggtcactaaatatgcctgcaattccatgttggttgtgaatacttcagagaaaaaaatggcctgattataaggttgaaaaccatcagcacaagggtggatctaggtcttgttgggcctgaagggtatataattttgagggccttctttaaggaaaatacaaaactcttcttgcttttgcgaaggttagttgaatacatgaccatgagaacacattgccaagtcccagtcccccagagccttggaaggagtccatgcagttgaggaaccctgaaaacttctggtccttctttagcaactatcctttggtccacttggacccacttgcttgggaatataaactaatcgttccagtttattaaacgtggacctcatagaggttgtatgtgtagtgctttgaagattagaatcatatattgaagtcaaagtcatttttagaaagaagtatttcacttttatttgacagaagatcttaaatgagatctgagctgatttgatatttgtcactgccgatattcttgtaaattactaactagaagaaaataaagcaattgctattattattcaaatgagtgagatgtaagtgcccgattggcagggcaagaagtagttttgccagctaaaggcatatgatattggagaggagactgaagattttgttttagctatctaaaaggagataaactggatatataataccaataattatatcttaatcatcacgttatggtttacaaaacactttgatatgtgcttaatcttcacactaattatttagtaaatattgactgagtacgtgctctgtgctgggtgctgggaatacagcggtgaactaaacgtacatcgtccctgttttcatggagtttccagtctagtagtacagagaaatatagacattaaaaagtaacacatacatttataattacatattcagattcaagtctaagaaaaacccaggatgagagattatcaagggggattgggtggttggggaggtgaagatgtaacatttaaacaactgtgaaataggaagaacagatggtattctcattttagggcatggttgattgactacttaattcaacaaacattgaattacaacaaacattcctgaattccttaactcaacaaacctttgtgaagtctggagaaggtcagatagcttcaggaatcgtgtggagtttcacgttatgaagtccaggaaaataatacatctgcctttagagcttaccacctggaaggaggggagacagacatactatacttataaacagaggcatgaagtaaatgctgttgggccacaagaaaggaagcaattaattctgcctgggactccctcgagctgggcttggggaagaattgctttcattagatggagcaggaagaaggggtgatctgggcagagcagacaccctgagcagtggttgagatctgaatctggttgtacatggggaacagtgtgagagtagtggggaggagtagccagagataaggagaaaaaaaaattctgcaagtccagattgtaagtctttaaatggaaactgagactgagaaaggttaaatgacttaggcaggtggagctgggactgcaacttacgttcgttgtctgaattttatccttttctaaggcaaggataatttgaatatatatagcatctgaatacatgccaagcaaacaggaattcctgtggcttctggactgagtctgaccaaagtgtgggaggagtgatggggaggaagggcactattcagagctgtggtctgaaggaaccgtcctgccattctgcaagttgctgtcgttctgagcctgtttccccatctgtaaaatggggttaatgacacttcccttgtgggtcttggtgagctgaaataaaaccacatatgtaaagcagatataaagtatgtactcattatgtgctttaaaaaagttccctgtggtcagatattttatttgaaatgtttgtttaaaaaggtgtacagtactctgaatatgatgtgcaaagttctgtgctagaggcttagaggaaaaacaaaataaatttaaggttactatactgaccctttcaggtggttggagaggaagcacttttgcttagttcaagctgcgaagaaatcatgaaagatattatatcagtaagtgcccgaatgaagcaggcaggtaaaaactgggaaaattgagaggcaaaaatcatgtctattagttttaatgtctgggggaaaaaagaggtatagaaaagctagaactgacctggacctccacagatatgaaggtaaatagggagagagggcctgttttcctataggatgaggtggatctggccaaagaattgctattgaagagcagttaaaggctggaacttggggcaagccatatttaaatcttaaatgtcagacaaaggagaggagtcctgctggagatgacagagaaattaaaaatatatatatatgtttaagaggatagttaacaatagcaactgagcgtgtgctgcctcaggctctatgtttgggactagctgggaattagcagagagttaagtaggaacaaattcatatagttcattgcagcactaaaagggaattctggttttatatagcatccactatggtggtcggacaaaatgaagggctaacgaagggatttttattgctgtatgaaacatcaactagatgatactaggagaagggaggctagtgaagtccaatgaaagtatcttgcttaatcagtaggaacacctgtatgcggggaaaggacaccattgggcttagattcgaaagatctgggttcaagaagttgctctgctactaactagccaagtgaatttatatcagttatgtaacctctttgaactgtaacttccgcaatcgaatataagaacaaaataagataatatatgggaaatgcattgtaaatgaaatatttcacagctatacattttattagtagacatgttgctgaaaaataaaaatcaaattttatgtactgctagaggtgcttgtttgattaaagaaacccaactatgatatattttctaaagcaggaaattttggaaagatacacttgtaatgattttggataaggataaagggggcatagctgagatgttagaaataacaaagcaaccaagggtagatgatagatcccaaatggtagatgactgagagggagaaagatctttgaagttacaaactcgaggaaattaaataatcatggtactgtaaatatgatggagaaattaagagacaggttaggttttagaaaaagtttgggcctcctaataccttaacttgtaggtcagtatttttcaaactatggatgatgaaatctgtttaacgggcttccatatatattaagaaagaagtaagagaggaaggaaaaaggggaggaaggagggagagaaggagggaagaagtggaaaaagagagtgtgttttatataagggtaagtactgctttgagtacttcaatttctctctctctctctctctgtctctgtctctctctctctctctctgtgtaatatgtaacttggttgtaatggaaaatacattcttttggctcaggtcaaaagagtttggaagctactgtcatcgaaggaagaatgtgggatcaaagagagggtgaagcagtctgtagtggagtaagagtacgtcagaaggtatagaatagaaactgaatgggttgtgagggtggggaggaagaaatgacagcaaagttacgtattgagcatctaagcagtcagttaacgacagggtgtgaaaaaaacaaaacaaatcaaactctaaatgttatacctttttttgaaatggtatctcactgtgttgcccagactggcctcaaactcctgggctcctgcctcagcctcctgagttgctgggactgaaggtgcacatcattgtgccctaaatatggtaccttgaccttacagatcttactgtctgtttgggaatgaaaagataactgggaataccaggtagcatctacagccaaaatatgaggcacttaatgtttcagagtcaggataaatattgcctgggaaccagagggtggttacagctgtacattctattagtagacatgtagctgaaaattatataaaaatcaaattttgtgtactgccagaggtccttgttagattaaagaaacccaactgtggtatattttttaaagcagataattttggaaagacacacttgtaatgactttggataaggataaaaggggcatagctgagatgttagaaataacaaagcaaccagcaagggtggatgatggatcccaaatggtagacgacggagagagagaaagctctttaaagttataagcttgagggaatgaaataaatatgcagacactggagaattcacacaactttaggtgagagttgaaggagactttgaaggaagaatttatctccgctgagaggaagggttgatgaggtaagtatgtgtgttccctgtttgggaggtgaatggaggaatcccagttaaagagactaggaagactcaaagatggtagtaatctatatttttatatgttcagtggagagaaaaacaccatgagttatggtcagtactttgcggggtttttatcacgcccacaagtatttatgtggcagtgtttatgtagcacacagaatgatatcttgcctataattcagaaggtaatagtgaacaaatgaagagaaccagagcttagtggcacaaaagcctaggttagaaaagtataataaagtgaagtgaaagaaagttggaaacaaataatatatataggtataatcccaatcttgttaaaaaacgtctttcactcaccctgtaatcaagactggaagacggtaaatcactatttatgttgtctgagtttttgataatgagcacatattgctttgcaaaacaaatagtgcagtaaaaacaagggcagcagtactaagggtggttaaaagtataaagtaggtgagaattaagtagaaacttgggatttgtgtcagaggagagtagtgatgtcagagggatttcagttgaatggtgaaattcaagttctttatttagagtcaaagactgaggaagagctgatgtccaggacacttggcaaagaaagaaggaaaggagggctgctagtttgggtgacggcctcatcatgaagcttcctgggcgcattgaactatgcatcaccacggaaaagagccagagggaggggagaggtgatgagcaacctttgcaaaggacaacaggacaattttatgccagaggaaatgaataaagttaagggttttccccagtgacttcatttatcatatgagttgattatttttagattcagttttgtcttcttacctcattgcctgtggtgttcatacatttatttctagacctttaaaaaatgtttctatagcaaaatcttttgaagcttgttctgcatgtcacaaattggatgtgctgtttttatcagatcagcacaggagtgattgattacttttctaatgttcgtttagtcattttcaatttgagtgtccattctgttcacatgagaggctgccagtcaccagttaagctgcaattgctatatgagaattggacttacagtactccataaaggtgtactttaagcagccttaaaggcctgttatcaagggcataagaagatggaaatccaatgaaagctctttggtttgggtacataattataaattatctttctttctttctgaatttagtatctccttttggtgttggaggcagtgcatactgcacagggtgccccatggacctttggtatcaaacccacatttcgaactgtgactctcctgcttttcatgaccttgagccagttatttaatctccaacggtcagtttatttatctgtgaatcagggataatacctaactaatagggttattgtgaggatgaaatgaggtagtttatacaactgtctggcacatagtgagctcagcaattttttcccatatcctttctttctgctaaagttcacagtgaagggatatacaattcgcgttggatttaagtattgattctaatgagaatcacattttccatttatttttcatgttctgagagttcaggatcactgtgaattgcaactgagttggaaatgccatgcttcattgtggagctgttttacctcctatgaaagcaaagcctagtagatcttgattttgacaaaagtaatagttaaaaaattaaaagtggtttatctagattctcctttccatttgcatagggttaatatcaaatctgtcaattcactataatggttgagccataaaatttagtgtatttaaataatggttgctgctaaagatcatattggtgacacttcattaatctggaagtcacttaatctggaagtcacttacctggcaaccctgattctttgaaacatgaagaatgaagaagtaacggaaagaggcctctgaagagctagcatagcatctttttctttcttgatgcaatatctttcatatcgctgaggagttcataacatttctcttgcttcttgtctctttttgtctgaattcctctttattatgtttgctgttgtatctccttttgtgtttcatgttgtttcatttaactcctcaaattctaatgatccctggctgcctattagtaaagagtgagaccctgaagagctgtggggctcagtgtgggatgtcacacactgaaagactgtgcagaaacttggtttattgggtgggggacatccatgtatattcatgagtacttacattttcttttggactgattgacttaagagaatccaaaattttgcagcaggcacggtataagtccaactactatttttctctaagctgaataagaaatggattgggggtaattttttcttctgtagtctagacttcatttaattctcctattttcagtagggtgcttctgccctcaacaaagtctggtatatgcaaggacaaagtgcatctggttcaatctctctatttataaaaattgagccttctgctgaggtgaggggagtatgggagaagagacatatggctgccaccctcctgtagcttacagtttgtgtgtgtgtgtgtgtgtgtatgtatgtgtgtgtgtgtttgaattagtggtatcagaggctctattgactttaattttggagcagactcagaacccactgatgacctatctccttcagggtttctaattgctaaagtccaaagcgggcttttaaaatcttttttgaagtcttttatcttgcacgttttagggtaggatcgttgagactgaaagaagcttgcagttcttaaaggaaaagggacatgctctaggggtgcatcaaaggcaaaaacccgaacagaggaatgttcagacaacttcaagggattgacaatttaaagagttttgaggaaacttttctgaactgaagcattctcaagagattccaaggtggcctgagattccacatttctttgatagaaagacgtggacttggcagtgattttgcaaatcagaacaagaacaattttatgaacacattggcaagtggccatgtctcagacttgttgggtagttaaatgtccactagaaacattgacttaatccagtatttatgaaataactcccgtattctatgtagttggtctaggaattggaggtgaaagatgaataccattcagctttgtgaaaaattctagaccacgttcaaaaagttttttgtttatacttgtaatatttatgcctgtggaatgacacaaaagacaatcttgaaatgtcagaaaatgataaataagagttatttgttattttctcagcatttttttccttttgtgtgtgtaagtgaaagttactcatcacgtttaaaatttaaaattttcatcaaagaaaaccatctgtcataatgaagtaaaaaagggacattatgtgattttctttgaagataagggattgaaagtgagtcagttaactgccctaggttaccatttgaggtcattttgaactaaattggctttggaatcagaatttaaattaccagtcagactcaattaagataactggtcatgaaggcagttcattcgcctgccttccttcttataaaaagaatatttttattatttgtattcctttatagccaagttagacatatgcattatttttgagaatataaacatttcacacaataattgatttaggcatttaagggtagttttgtatctaaataggaaaccagaaaaatcattcactattttgtgttctagtgatattcacagtagatacttttgaagtcactgggaggtaaatcaatatattactgagttatatttttgctgccctgtgcaatattaagagaatagctttcacaaacaaaccccagttaaagttatttagtcacaataataaaagtacaattggacatattttaagaaaacataaattataaatatgtgcagttattttaacaatttatgaatgtatttctaaatactaaactttttgtttgtgataagtgagtataaaaatatatatacaattatatactcttaacttgctcaacatgagagatttaaaatgatgagttccactgtgagtttaatcttcactttcatctttttatttatttatagactggaacaaataaatcaattttttaattataaatttttagtaattgaaaattattaaatgtacaaaggaggagaacttttagaatttagaagtacaaaggaggaaaacaatttaaacctacagattgatttggtgggattggttgtatgtctgcggctgtctggagaatccaggtgcttaagtgccttggactagctggacactgaaacttcacagggaaacaaaaatgtctggaatgacttgttgatgttcttgaaatgatgctaatatctattctataaaacctgaaggtatgtagatattattgtctgtttcgagtcatgtatcttgggatttgggactgttggagagaagatcggtttgatttagaccatgataggtattgatctatatatatttttgaaatattttggctaaaatgcaatttgatgtggtaagtcttatccatatctaacattttatcttaaaactatatctgtagaagttgttttttaaaaagaacagaaaaatcgagttgcattttggtgtttaatgcattgattttaaaaaattatattcagagcaaaatgtttgagttttcaatgattttttccttaaagcattaggtgcaaacgtcaggtaattctatgattagaattgtgtcgtgatactttgtgggtgaagacagtccaaaaccaaaaatgatgagacaagtgaaatctttattaaggaaggcctaacagctgtatcagataagtttgctttttcttggaaactttggtaaaaaaaaaaaatcacctgggaaataatgtgattagagatgcttcttaaatgtgcatatgtgtttagtctgttctacaaagatattattttctttgtagcattgttttattgaacaaattttgttaaattttctattaaaatagtcttatagtgatttaataacaatttggaaaagtcgcaatctttataagcatatgtgtaagtgagatggattactattaaaatgcaatttctagtattatagctcttttataatttgtctagcagattttctggttttcaccacgaaagaaatgtcatttcttagtcttcatttggaatttataaaaaattttaaaaatcaccacattttccaaaagtttatgccagaaaatcattcactatttaaaaatgaagtgcaatttcttaatagaaaagtatagattgagtcttgtcccatataaatgagtttcctagatttggaaaaaaattaatacattggaatcaatagttgaccacagatttaaatatgatacaaaaggtttaaaaatctaaattgtcattgtttacaaaatactggcaaattagagctacagcgcttggtgttattgtgtaatcttctgtttaaaaataaacagtggaaataattgtagaaacctctgggcttagaaaggcttgttggtggttcttcacatcctactaaaaaagcaggctgtctttgcatattaatcactctgtgaaaggaagcttgccttatttgcattgtgcatgcactaagaagtccaatagtgtgcctgagaaaaaaatggggggattgtaattgttgttctcaaaagggtttttattccattcaagtggaaaagctgaatactggagaattagtgcagtgttttgtggaagaagagtcccttttggccactgcattgcatgtggtgcaatcccagtgtgtaaggatcctgaacgttggggtgaagaggaaagtgactcatctttctatgatgcaatagtctatgttcttgtacatctctataattttgtaagcattttctccttgttatgtatccgaaaagaggtagaatgaaattctgagaatatatgccatattggaaatctcaggagagttaaacatgaaccaaaaaatctaaattggtgtttaggttttgggagtggggtgagatgaggacacacaacataaaattaagcaaattgtatttaagtgttattgtttttagaaaatacgtgattcggttaatgcctggaagatatttgtccaccaaattgattttaaatgatatttttgacattattttagtaataatggcatgtttttttcttcattgtattttaagactcagtggttgaatgtaaacattgagaataaagagaagaaatgttcttaatattagtgaggctttcttttaataagactgtgtaagatgagctacttataatgtttctcttctatggtaaaacactcttcatgaaagcttttcctgatctcctagttctagctggcaacagccacattagccagtacagtttccaaaacctcaaaatgtacattaattattttggaggtctgttactttggactggtttaatatactttacatatttttagcatcttttgaaaaattctgcacagattatggcatttccaagtagatttgaatttcacaagggggaaaatacgccattgtctgtgttcacatattttgacaaaatgattgtgtataatcatggagacaaagcttattgttttaaatgattttgttaaatactagaaagtagttcactgagttaaaaggtttcatacaggtttcctaaaaaccatttggcttagatatatttaactatctgtgaaactacttgttattatcctctttactattgtatgggtttggttggattttgtctgttgaacacagatcctctgattttatttcgattttatttgaattgctttctgtaatattcaactacatggaaattgtgtttaatttgggcttatgtagagtggtccatagactttgagtgtgtgtttgggttgctgttctgaagaacagaagtagccaagaagtagtctgaaaaagtaggaccataaaaaattagactggtagaacaaaaaagaaaaaaaaacaaacaaaaaaaacctgtaatttttaccattcaaaagtccttatataggtttcataataaatttttttccaaaatattactgatgtacttctccaaatgtttattatagacatgtcaaaagacaaaattatgacaaatttagttataaatcaaattgtcttttatttgtgattcataaattggggcagcctccattcaacaaaatagaatgagagctcccactgagcaatggcagaacagtgggtttggaaagtgggaacaaggaaacaactatagaaaaaaagaaactggttaacatcaggttacttccggtgactcttttgcaagttaaagcagaggagacttctttattgcactgactcaggtcgactggaatctcctgttttcaggaaaacccaatctgttttgggatctatctgcttctttaacgtttcagtttgattatatggcatttagcttgagtgactccattttggtttggtctggtctcttggggttgggtgcagaagctcagtctaaaacaatgggctcccataatttttgtttaacggacataatttttagaatgtatacttcatttaaatttgaacctttttataaaaatctgaaatgcataacacatttttagaattgtgtagacttcataagtatgcaaaacaaaaacagctggtatcaagcaccacttgatcacctttaaattcagaaaacacacttgacaaaatgcgacaccccttcaggatgaaaacactcattaaataaggaatagaaagtacttccttgacctgataaagggcatctatgaaaaatccagagctaacatacacaaatgggccataaggacaaatggccaaaagatgtcaacatcattagccatcaggggaaatgtaaatcaaagccacagtgagataccacttcacacccgctaggatggctagaatcaaaaagacaggtaacagcaagtattaataatgttgtggaaaaattggaaccctcaaacactgctgatgggaatggaaatggtgcagcctctttggaaaacaagtctggcagttcttaaacagagttaccatgtgaaccagcagctctgcccttccaagagaagtaaaaacatatgtcagtataaaaacatgtacactaatgttcatggaacattattaataacagtcaaaaaatggaaaaaacctaaatttccatcaattgatgaatggaccaaaaaatgtggtatatttatacaataaaatattgttgggaaataaaaaggaatgcagtactgatacatactacaacatggctgagccttgattcagcattttagtaatgtgagctccttaattgtgttagctgtttgtttgtttttttgtaaccatgaaagtttatttatttatttttcaatagttttgagggtacaggtggttttttgttacatggataagttctttagtggtgatttctgagattttggtgcacctgtcactggagcagtgtacattatacccaatatgtagtcttttatccctatgaaggtttattttaatcctagcacttgttaatatttatccttaattcttactaacttttagattgtgggtattatatcttcatgagaatagctaaaataattttatttggatattcctcaaagaactattgaatgtgagcatgctaagattacccctggcaaaatggaaaatgcctagcacctggaagcatctgtttctgccggtcttctaggagagaggaaatatttatgtcttccatttatgtattttgactggggaaaattttcccttttattctggggagctgttactcagcataagagaatgtagaggagaatcacccctttcacatatctaatagctttaccacattactacagtagtatcttatgttgtatgcattgattgtcaatctcttctcctcatctccaccattttgatagcttaaggcttatcattcattctctgtgcatagaaaaaaaaaccgaaatgatgttttccagtattttgtaatctttccttcatgaattgcagaagaaaagtgtttgggttttgtcccattcatcataaagcggtacacaatagatacggttgcattttaaagcaaggctaagatggatttaagatgtatttcttgtcatgtgaaacgtcctcctcagtggtcttaaataaaatattaattagataattctgcagtgattaatatgaaaatggttacataattcttagatggtatgtattgtgttgggctaacaccacattgcttttctagaatactggtatctatgggataccatagataccccatagaatactgaatatcttatgggactgccctttcactaaaagcacaaatctttactagtggtcttgagctaactggaactgctgtagatcacttgcaaattttccactaggatgctttggtgtatttggtgcagctattcccacaatcacttagagtaggcatgcagagggagctaacccataggaaattaaggaatttgaagaatctttgaaagttcatctcatttaacttctttaaaacaaaatttgtgaacatctcagataagaatctgtctttaaaaataagacatcttagacatagagatggaggttaaagttcaaaggttttttgcattcaaataaaattagttgttgtctttcactaggtggctctcttttttttagaatgagttcagtatttattcaagtaaacaatcaagttttgatgtgcctgttcagacagacagcttattttatgatacaggtggcatcaagcccattatgtgacttttcctccgcaagaagtttgtaacttcctttggcaattgggatgcacttccctataagatgttttatgtggtggttttgtccggattaaccaaaatgcaaatcttcatatcctctatagtgcctagcaaagggtcttgcacataggtgcaagttgtcagagttggctcagtttcactctgagccccttgtagatagcctttattcattcctgcattctacatgtatttatgcctttgactgagaggtaagatctaaaaaaggaatagatatatctgaattcatttgtaaaaagggtgctagctggcaatgtatgcaaaggtttggtggcagtgagtaaacaagaactggggatggccttgctcatcagatggggaagtaaggaggtcattggaagcagcagattctgggaatgacttgatgggagcatgttttgggaagttggatttgttgctcttcttttggaagctgggagagattacagtctggaaaaccagtagtcagggggtaggaggagctactgtagaggctgtgtgaggtgatgggaggtggaattggagttctgattgtgagatgtaaaggaaggcattatgcaagaaatactacagagggaagattgatgaacttagtgactgatttggatatgcaagagaggaaagaatggagattatttagatttcaggtgaggcgcatggtaagagtaaatgtcactagcaacagaattgaggaaggggaaaatagggacttttaattttttaaaaaaggtaatagtttggcttgggaaaggtgaccctgagattaaagtggactgtctaggaagaaaagccaggtataccgctggaaatagaagtctgcagtttttaggagagatcacgttagagacataaatctgtagttatttaagtagtagatggttctcgaaggataagtccatttagagagagaagcagagaggaccaggaacggaacttagccaagcacttatactctgaagatgggcagttttcatatgtaatagttattaaaaagtggtaccaagtcatttaagcaagttactgttttgtatattttcaaaaagaattaaaaccacagagctgccctttttatatggtggtactgctttcaattcttattctctttttaattcactctgtctcagttttaatgaagtttgtttgcagtccataccaatttcttgttggggtttttatcttctagtgcttttggtaataacatagctgatacatgaaagattgtgtagctctcatggatttcaaatctttaggcattaatgaaattatattccaggataccaggagaattgtaaataaatccataaacagctacagaaaatgattttgagaaatcatgaaaatgaacaaaaatttggattttttttttcaagtgggaagagggtgaattcttctcccaggaagatgggggaacttaatgcccatcctagaaaagttttaagaactgacaattaagcagattatatgggaacccagagaagaaggctggcatctaatgtgggctcagtaaggacaggttgtatcagaactcaattctgtctttggcaagatttccagactgaaaatggagtttatattgctttatcataatagccaaatggagaaatacaagctcagtgcaagtaattggtcaaatgaccatgctcctcatcaacttggaatgtgttggctctgcattttgcaggatttccttatttatttacttttttaatatttaaggtgttaactatgatgttttgatatacatgtacataacaaagtgattactatagtcaagcaaattaacatattcatcatctcacatggtcacctttatgtatgtatgtatgtatttatttattgtgaatagagttcttaaagtctactgtcttagcatatttccatcatacaatacaacattattacctggtgatcatgtggtgctttaggtctctagacttattcatcctccataattgcaactttgtaccctttgacctacatcttcccattagctcctctcctgactcctgccctggtaaccaccattctactctgtttctatgtatttagttttgtttgttttagaatccacatataaatgagatcatgcagtattttcctcgtgtgtctggcttatttcacttagtataatgtcctcttggtttatctgtattgccttaatggcaggatgtccctctttttaaaggctgaataatattcatatatatatatgagttttaaaattcatctgtcgatggataaagttttttctgtaacttggctattgtgaataatgcttcagtgaacataggagtgcacatatcttcatgaggtggtgatttcatttcctttgggtacatatccagaagagggattttttctgggtcatatagtagttctatttttaatttctctaggaacccccattctgttttctactgtggctgcagcagtcttacatgcccaccaacagtgtacaagggttcccatttctctacatggctacccacacttgttatctcttgtctttttgacaaaagccatcctaacaggtgtgagatgctttctcattgtgattttgatttgtatttttctaataattagcactgttgagcacctttttgtatacagtatctgttggttatttttatgtgtttttaggaaaaatgttcagatcctttgcccatttttaaattggtttattcatttttttttgctgttcagtttgtgtgttccttatatattttgaatattaaccccttttctgatatatggtttacagatattttctcccaacccatagacttccttttctatttttgattgtttcctttgctgtgcaggaacgttttagtttgatgtagtcccacttgtttatttttgcttttgttgcctgcactatcctattttttttttaatcattgccaagaccagtgtcaaggagcttttcccctgtatttccttctaagagttttatagctccaggtctttaattcattttgagttgatttttgtgtatggtgtaagataagtatccaatttcattcttttgcctgtggatatttattgaagagactgtcttttccctattatgatttcttggtgcccttgttgaaaattagggcatataatgccacataatgcatgtaatgccacatatccttgggtttatttctggattctctgtcctattccattggtctatgtatctttttttttttttgccagtaccatactgttttgattattatcactttgtagtagattttgaaatcagatagggtgatgccttcaactttgttcttattgcttaggattacattggctattcagagtcttttgtcttccagatgaattttaagatttttttcttatttttgtagaaaatgtcattgtagttttgatagtgattgcattgaatctgtagctgcattgaatcggtagctcccttttggtagtatggacattttaacagtattaattctttcagtccatgaacatgggacatctttccatttatttgtgccttcttcaatttctttcatcaatgttgtgtagttttctgtatacagatttttacctctttagttaagtttagtcctaagtattttataatttttgatgctattttaatgagattgtttttagatttctttttcaggtagtttgtttttagtgtatagaaatattactgatttttgtatgttgactttgtatcctgcagtttcactgaatttgtttattctaacagccttttggtggaatctttagtgttttttaatataaaagattatgttacctgcaaatagtaacagtttaacttcttcctttcagatttggatgtcttttattttattttactttttcttgtctaattgctctggctaggactttcagtactattttaaacagaagtggtaagaataggcatccatatcttgttcctgatcttagaggaatatctttcaactttttaaggttaagtatggtgttagttgtaggctaacatatatgacctttattatgttgagatacagtccttctatacctaatttgttgagagtttttaatcacaaaagaatgttgaattttgtcaaatgctttttctgcacttattgagatgatcatatggtttttgtccttcattcttttaatatagtatatcacatttattgatttgcatctgttgaaccatgcttgttttcgaggaatatatccccttgattatggtgagttatccttttaatgtgctgttgaattaggtttgctagtatttttttgaggatttttgcatctatattacttagggatattggcctgtaattttcttttcttgtagtgtccttgtctggctttgatatcagggtaatgctgacttagtaaaatgagtttggaagtgttccttcctctttaactttttggaagagtttgagaagaattggtattaatgcttatttaaatgtttggtagaattcaccattgaagccatcaggccctgggcttttctttgataggagatctttaattactgatttaatatctttacttgttacctgtctgctcacattttctatttcttcataatttattattcataggttatatgtttctaggaatttacttctaggtcatccaatttgttggcatataatcttcacagtagtctcttatgatcctttgtactttcatggtatcagttatgtctcctcttttatttctgattttatttatttcattcttctctctctttttttagttagcctagcaaaacttttgtcaatttttatctttcagaaaaaaactaactagtttgttgatttttaaatgtttttctagcttacattttatttatttctgctctgatctttgttatgtcttttttaaattaactttgtgcttagtttttttcttaatttttaagttctttgaggtataacattaggttgtttacttcaaaccattattcttttccaatgtaggcatttattgttataagttttccttatggaactgcttttgctgcatcctataagatttggtaagttgtgttttcgtttttgtttctctcaagatattttttgatttctcttttgattctcctttgacccactggttgttcaaaagcatgttggttaatttccatatttttgtgaatttttcaaaattcctcctgtttttgatttctggtttcatgccatcatggttagaaaagatacttgatatgatttcagtctccataaatttgtcaaaatttggttcatggcctaacatatggtctgtcctggagattgttccatgtgtgctcgagaagattgtgtattctgctgccgttgaatggaatgttctatgtatgtgtgtgagttggtctcatgtgtagctcaactccactttttccataatgattttctgtctggacgatctagccattgttgaaagtgggatattgaggtctcttattattattgtattgccttctatatttcccttcagatctattaatatttgctttatatatttaggtgctctgatggtgggtgcatatatatttacagttgttatattctctgaattaattgacttctttattattatgtaatggccttttttgtctctttttacagtttttgacttaaaacctattttgtctgatgttaatatagctacccctgctctcttttggttttcatttgcatgagatctttttctaccccttcagttttattctatgtttgtccttaaagcttctgaagtgagtctcttataggtagcatatagtcaagtcttcttttttaaattaattcaaccactttatatcttttgaccttttggagactctaatgtatttgcattcaaggtaattattaataggtaaggaattactatgccattttatttgttttgtgaaggctttgttcctttctacttctcttgctttcttcctttgtgatttgatattttttctagtggcatacgtcttgatttttttctctttatcttttgcatatttactataggtttttgctttgtagttaccatgaggcgtacatagagcatgttataattatgatagttcattttaagctgataaaacaaacttaactttgattgcacacaaaacctctacacttttatgccccacctcccagccttattttacgtttttgtgtcacaatttacttccctttatattgtgtatcctttaacaaattattacagctatgattatttttaatagttttggcatttaacctttatattatagataccagtgatttacacaccaccattacaatattagaatattctgaatttgactatttaccattaccattgagtttttacttttatatatatttattttgttaatttgctttctttgtttcaacttaaagaacaccctttagcattttttttgtagggcaagtctagtggtgatgagcactctcagtttttatttgtctgggaatgtctttatttgtcattcatttctgtaatacagctttgctgaggatagtgttcttgattggcacttttgttttgttttgttttaaatccagcactttgaatatattaacccattcccttctggttttaatgtttatggtgagaagtccactgatacctttatgggggttttcttgtatgcgatgagtttcttttcttttgctgctttcaacattctctctttgtctttgactttcaacagtatttttttttttttttgagatggattctcactctgttgcccaggccgaagtgcagtggcccaatctcagctcactgcaactctgtctcttaggttcaagtgattctcatccctcagccacccacgtagctgggattacaggtgtgcaccaccacacctggccaatttttatatttttagtagagacaggattttctcatgttggccagggtggtctcgaattcctggcctcaagtgatatgcccaccttggcttcccaaagttttgggattacagacatgaaccactacacctggctgacttttgacaatttgattataatgtgcctcggaatgttcttctttggattgatcttgactgggatcctttgagcttcattaatctagatgtgtgtacctcttatgagatttgtggagttttgagatgatttctttaagtgagctttctggtcccttctagctctgtttgccttctggaattcccataacttgtatatttgtatgcttggtggtgtcccataggccccttatcctttcttcgctctttttcattatttttccttttttccctataattggctaatttcagatgacctatctatatttgagtttgcacattctttcttctgcatgattgagtctgttgttgaagcactcttgaatttttcaggtctgttgtattcttcagctccaggatatctgcttggttcttttttattttatgtttctgtttatttattacatttcttattttgttcatgcattgtcttcctaaactcatttagttgtctaattgtattgttttgcatctcattgaacttcattaatatgattattttgaattctctttcaagcagttattagatctccatttcttaggagttgattgttggagctttattagtttcctttggtggcgtcataattgcctgattcttttttatccctgtcgtcttgtgttggtgtctgcatttgaaggagcaaacatatcttctagtctttttttggaaagagttttttaaattgtatgttatatattagacaaaattatttaaagccagtaaatttttattcaaggaatttcacatgtgattccttctactgttcatcaaggttaccttaattcctctaaagatgcagtcaagatttatcttcaatgtaacccttttaaaaagaactgagacttaatccacaattgtcctgtcagccctgtcacaattattttattttgccttcttttcttctagttttaatggggttggagctgggtcatgtggctgctactccttttgcagtggggcctgtgggtggccagcctgttaccaggtggtttagtgggcatggatcctgctgtttggtctctggatggactggactgtctccaggactttggtctacaaggctagttctgggatgaaggtcagctttacagtctgtagagagcaggcttgattactaggttcatagacagttgtgtttttctctgggtccctgggacatcttcccactgggtcactggttgggtccttgggcaaacattactgccctggtctatggttgaagaaggctgaaactgagttgcagggttgctttagggcccacagctgggactaagctcagcagtgctacctggaagactcaggaaggcacgtctccatcttgtctcagtgctgctggcatgacttacctctgaccaccgttgagagggactgtagccagtctcagagccatttcagggttttttgtgggactgaggtcagcaaccctgctccggggacttagagagatatatttctctctgggaccctagtagatcagctggactgatctcagaccactgctgagagggactgaagccaagtctcttggccatttctgatccacaggtagagctgaggtctgtaggtttatcatccatggcgcaagtgggtgtgattttttctgggtcccagggtgaatggttttgatagaaggacaatgatcaaacagagctgtagctgagtccacaggagtatggaagccatttttgggtctggagctagggccatggtaggagagtctgtcacctcggtgtagtgctgtcctatcaaaaggttctcctaggccttgtgctccaatattttctccactccattttatgtaaatttataccattacctgatttatcaatttatcacaatctcttacttggctgtttaagcttccataaaggcacttttgctgtagagggctctcaaattattgttactgttgggagctacgtgcatctgttccaccatcttaccggtgttctcttgtgttttctgcacgtgttttgccatcttactggtgttctcttgtgttttcttattcaatttttacattagtattttaggtagaatgccattataggtggcatggattggaactgagaattaatatgatgggtaatagtatcaggattcagtatctcagtaagttcgattaatgagctaaacatgattaaatttaataggaataaaagcaaaattcacacttaggtcctcagtctgctaccccagggcacatcaaatgatcaattaaataaacaaactagaatttagaggcagcactttgaaaaagcctcagtaacttcactcaggttcaacaatgtgatgtggtttataggctattatagttcatctgactttcacaataagtacgtgttaatggctatgaactgattacatccactaagtgattttttgctgttaaattttctctagtgcatggcctgaaaagaaaaaaaaaagtgattggagctggcaggtattttagagattattgagtttacccaactcactttacatgaagaagtgaagtgaagaagaaagagagcagagcttacttgaccaggttcgcacaaatagctactcattgttctgggacagcctctgggactcccgaattttaaattttactctcaacattagtgattttgtattttttatttattgaaggaagtgtttttggtaataattttagacatattttgtactatcatcagttactatttgtgcataatgaaacattttatgattggcaatatggtctgtaaaagttgatacagtaatttaggtttccatttgttttaatgatgggtaatgtaacagtttacatctgtttcctgcctcatttataaaagttttaaaggagaaatagtcagttttattaactttattaagtctttaaggcattaaatatatttttatattatttttattgttgaagtatcttttattggaaattctattgtaattatgaatatctcttgagaggaacagggaagaggaagccatggagaaaacgggagagaggagactgtagaggatggttcattatttgtattcttgtgggacaactgcttcctcccaaggtttcctttcttaaagaagcctgttattcaatatgagatttttctttatttttatgcatttttttcaatgaaaattcataatcataaattgttaaaaatgcaagtgagtttatgatgaaaaacactagttcactgattactatttcccatctgaagaagaaaccacttttacatcttgtagttgtttcattgggtggttgcttgcatattgctaaataatatatttttatgttttaaacttaatatgtctaattgttgtaaaatgtgactcatttacatggttcaaaaatgaaaagcataaaaatatatatactgagatatctcctctaaacacagaaaaatcatgaactctttttttttcttttttttttttttttgagacggagtctcactctgttgcccaggctggagtgcagtggcgtgatctcggctcattgcaagctctgcctctgggttcgcaccattctcctgcctcagcctcccaagtagttgggactacaggcgcccgccaccatgcccggctaatttttttatttttgtatttttagtagagacggggtttcactgcattagctggaatgatctcgatctcctgacctcgtgatccgccagcctcggccttcctaagtgctgggattacaggcgtgagccaccgcacccggcctgaaaaatcactgaactcttatctcttctagaaaatatttcatattaatgtataagcaaatacaaaaatattttctctactccattttatgtaaatttatactattacctgatttatcaatttttgtccttatttgttgacttcatgctatgataaaagaagtgtatatccctatgtcaccctacttcactaaattttcatttcccaaaacaggtctgtcagtatttatgattcctctgttggttaaattcttaactttaagcagtcaactgatactttgctttttgtattgttttagaccattcttgcattgctataactatctggcactgggtaatgtataaggaaaagaggtttaattggctcatggttctgcaggctttacaggaagcacagtactggcatctgcttggcttctagggaggcctcaggaagcttacaatcatggcagaaggcaaaaagggtacaggcatatcacatggggaaagtaggagcaagtgacagagagttgggggtggggaggtgccatacacttaaatgaccagatcttgtgagaactcactatcatgaagatggcaccaagccatgagggatctgctccatgatccaagcatcttccactagaccccacctccagcattggggaatataattcaacataagatttgggcagggacaaatatccaaagtatatcagttgtcaactgtagatgatgtctcttgattcctcattttgtgagatgaggattaatagcatccctgtactcccttcagctctcctttttgtcattcttcttccaattgttaacatttgtttttaaaatttttatattattgatgtcaataacatctacattttgttctttatccataattaagttatcagtgattatagtttaaaaagttgaaaactgtactttttacattatgatgaacaagtaaatattgttcactgaggagccaagtggtatacgattattgtatttcctttcctatgaagaattattacagtttctactagtcttttttgccctttcattgtctgcctatgtgaccttctgaagtttttttagtgtctgcactctctgatacccaaagagagtatcaaatcttgaaatcccttattaaagaggaatccatgattcttctgcctgtctgctactctcttctgggttgattgaccctggatcagctgcacagctgtcaccctgggatgacctttcattgatcttcttgcctgaatccagttttggcaatataatgcctttttctttctgctttgccatctagctttgagcaaaatttcaagttattcccaaaggaagagtgaatgaaaggtaaactttatgcattattagtcaatacatttataataatgtctattcttcccatagatatctgatagtatctttattctgtcctgctgattacagggttaacaaggtgtgacttctagactgagaagaatttccacattgtaactggaaggcattactcatgatcttttagcctctatgattctgatgagaagtctgatgccaatctgatttttcattttttgtagatgactatttttctctctggaaactcataggatcttctcattatccttggtgttctaaacgttttaatgcaatctaagtgtggacctttgaaaattcattttcttgtttatgtggtggctcttttcaatgagaagacttatgcccttcattttgatacatcttcttgtattagcctgagatccagaaacctggtaatttagcccacagtgatgggacaatggggaagaggagtcagcagtctgctctgtaacttatttcttagtccccactaattagtacccattgttgtcagcccctacttcatgcttagagtacccgggagttctgcacctggaggctatcttggtttctgcagggcaggtcagctccttcctaagctgtaggtcccccaaagatgtattttctacagagtttctttaccctgcttctttaggcactattttgtacctgcttttgtagaaatcttgtaatctttgtttgtcaatggttcttcttccattctctgcttgtgtgcttgtatgttatctttatccttttatgataaaggtattggagacttggtgagaaaagaaataaactcatgtgctctgtcaccccaaagtttgagggactcagttgatcacaagctcaatagggctgtcctatagccttgtctcagtaactggaggtagggaccttgtcttacttatctttttatatatcctggagcttggcacatagtcaacactgaataaatgctttcgtacctactgctgaattacagtagttatgaaagttgaattgctgtatttaggaatgaatgctaaactgcatcctaccccccgccactggaatacataagcattaaaaggacatatgaaaaataatgagatttatggtggatttgatacacatccaccttactttgtattaacagaattgtcgggtttagtaatttcattttttatatcatagctgtctgagaagtagttcttctaaatacatttctgttaattacctagttattttttgcaattagaaagctgctagaacttgacactccattttaatgtaagctaaactgaatgttaactaacttaagagtcttgtggtggcataaactaatgtttacaacagtactttttacactataaagtgctatggacatttgagtttttgttgatattatgtaggaatagccagaattgttttgtaagctgtgctattttgagcagagattaaggcactaattagcatgctattattatctattcttgtactttaaatggagaaggagtgattttataatgtgtagttgtgaactgtagctagcaatagcaaagatagagcaactctgcatagttttttgattattttcagatgcaattggctagctttagggaattatagaggagtgagcctgctgtgaagatctttggccgtatctcatatataaatgtaatatagcctcagtggtaaaaatctactgacccatgtctgtttctgtttggctagttctattgaagtaatcaatcaactctgcctgactggatgggagtgtggtggagcctgaccaccggcagggctgaggcattgagttatcattgaacataagaatcaagctctttgtgcaagtcaaaactcctggtggcatttgtacctgaggacctgtcctcctcccctttgtccactgttttgattttttttaaaagtcattaaacactgaatcaatttagcagagaaaagggaatataattcatttaaatctctgttcaaaacattatgtttgcttctggttttcatctgtgtgtttgtacactttgcattgttgtaaactgtgtaatatgatgtctaacttttcctacttagcattattttatatatggtttataaaactatgtgcttaacataggcactgtcttctattttgtggtaaggacatttaacatgagctctaccctcaacaacttctttcagtatacaatcacagtactattaagtgtaggtatgactttgtatagcagatctctggatcttaatcatcttgcaaaataaacttcatgtgtactttcttttaacattggtaaggcattcactgatatgacataacgtacttaacctttcactgttataaattggcttgtttctaattgtttattatcataaacagcatgatataggcatcttgatacaaacgattattttgctttgggattattttcctggaattaaacccaaagtgacattatcaggtctaatgttgcatacctcttgtttatgcagtcattttggacttcagaatgacagggcagtgcagttgttttattctgcatttcatcattaaggaggctaggcattttctcctgtaatgatttatcatttgtctttactgatggaatgggagagcccctagtttgctacttttagctgaatctgataattgcatggaaaaagttggaatgcaggataacaatgtcatccaagggaccccgtcccttttctggcctgctcatcatacagtggttttctagggagatttctccagctaaaatgcagacattactggtaagggtaacagaagtcaagttttgagcagcaaaccttgtggtaaggattactttatcagctcaatttccaatgcgaacagctggctaagagcagtgcctcccaacaacaggacacaggactggtagggcagtgggcatgggaagcttgggtaggatagaataatgagggagtgggcacaaggatgcactaggcagggttcactccctttcctgggcttcctcctgtttatgagaaagttaatcaggaaagaaggatacttactgcatgagggagtgggtgttactgaacactgtctgggtcagagacatgattattttgagaaaataacgactcagaattaaaaggctactttatttccaccaaagtcaaacataaaaactagtgataattaaaatgaaggagcataaatttattacatagtatattaattcaccgcaagaatagatttataggtgttgtcatgtcttttgtttttagggggtgaattttcaaaagagaggttaatgagaccacataaaatggtcgtatgaaaaatgtttttgccttctttggtaaaactgctctggggacagtgttcattattttcaattttccttttataaagatccaaatgatagggtcatgagttcaaggccaggaacaagttgatttttttcctgaatagtatgatttaatttattagataataagatacacgttaccatatgtagccccctcctctctttcttgctttctctctgtgtggctggaaggtaaatgaatgcatcagagggacttaagacctaaagaaattatttagggctgctgcttcctggaatatctctcataagaactgtaattaaataaagtaataagttatccccatgaaagattattttcaagtccaaagcagtatattctggtggcagctaattgatgattctgtttcaaagagtatagttttgtgaatattttgttctcttcttatgaaagcctaaaaagtgattcttttcccacgaagacacttttgcttcgatcctttccagtggtttgccaggaggtgggttggcctgcctaaccttagcctgcatgtccgagggaaggaagtaccagttcaggagctcagcagagggcagagctggggttagatttcatcctcaggtcctggagttactaaatgctagggttgaaaaggactcagtgaggaacttgaggcccagaaagggaaagtgctcatacatatgcacataatttttagtggccaacaagaacttttgccatttgattctacattcaggcacttttttggtgccatgtggtgttttcatcataaaagaggttgaaattgcagagtaatttctactgaactgtggtcagttcaccaaggcacatgcctgtaggactggagactcacatgaggtagtgtctgattgagagtcctggaggcagttagacttctttaaggatggatggcagagagatggggattcctgcttagttaatctgacttttatattctcttattattgatttgatagaataaatatttaaactttatgttctactaataaattatggtgtatcctagttaggaaaaaaggaaaaaaaaatcctaggtgtaagcgtagtccctgatctctaattctccaaataattgccccaccctcacctagccccaggttatggtcccatctatcctgcttgtgttcactgccatttaaaatacaaacatttactactttccaaacaactctcgacactaagatgctttccttttctcccagtttcagttaccactttttagtcaaaaactcaaaacgattatctaccctattcttaccataaattccgaatgtctttcatacacacacgatttaatcgtgtgtgcccagatctcttttttactttctcatccagaacattactttcaggggaatttctccatcagttaaaatggttttttgaacttttggattctgccaaataaagtaacgtgttttaaaaacaaagctaaagagtttcctctatacttcaaagacacatgaccatcatagtttcattcttgatggactgagccaaaaataaaaacaaaaacaagacccctccccctctttatttcagatgctaattaaactacagattaggtcccacacacctacctccttcagagggtatatttacagtaaaccatcatttggtatgaactaccattccattcaaaatgggggaaggaatttaaaatagtgtgatgaattttataggcctccctctgatattgtatgtaatactgattatgtatgttgtggtagtaattttttcagaaaagatttctcaaaagaccttcactcctctaagtggaaaatgtattgctaaaaataaaacttaaggtctcttcattttgtagctgtgtcaatggctcatcttggtaatttatattccatattgttcaaagggaataaaagtgccactgaaacatatcagtaaagttaaaagatggttcatgttttctggaatatttataatatccctacattatgaatttctagagaatcttgaaaaaaactatttaaaatattttatttctttttttgttttttagctctctgggtcctcattttcaaattatggggccttcgagtctgtctgcatttcatgttttgcagagattttttttaaataaaaaaatagagaaaagtggatgatgccaataaccctaattaagaggaaaccaggtcccacatggatattgtctgattcattataaattacagctttagaatttagaaaattgtgtaataaatcatgatgtcatttccaggtaatcacattcgagccatgtttcccctgagacagtgtgcctgttacaacagctgtgtcatccctagggctgcaggagaggtttgggcaattcataattgtagaatgaagtgtatgttgattgtatacttcttacctttgtcattgctcactgtgagaagtaaagtttacttacattaaaacatcagcttatgaataaacaaagtttgtttaaattaaaacaccattagtcaccatggcagttgattgtcctggtacactttctattataaaataaattcaaattagtgaagactcagataaataacaggcattgttacacagacgaaagagtgtgcatcctggaggtagacctggcctgatattctgccactgattaattagctatgacctcatatattttactttactttttaaacttaatatcactatccgaatgttggtttacttattcattcggcaagtattctttgagtctgtcttataaccagccattaactaggtgctggagataacatgatgagtaaaaaggaagtagtccttgatctcatagagcttatggtttagcgagagagccaggtgtggaacagagaatcacacaaatgatacaatgacagttgtgataagtgctgtgaacagaaagaatacagagctatctagtaaaattggggtaagattgcctctttttcaagattctgacacataaaaagcacagtgaatagtagtagtgattgttggaagtattattagtattattattatgtcatcctaaaccaaaacatgatcaggtgaggacaggaagtacggataacgagatgcaggctgtataatgagataattaaatatggtgaattcaggttgaagagatataatacatgactacgtgaattaaaatatagcctcctaaggtacagatggcatcttctgggggtcagaatggctgttatattgatggatctttgggtgttctgtggttaatgccctgttcctggaaggctgatgggtcaggattgctgtaggaaggttgcattctagtggttactttttaaaaaatgcttttaagctctttggcatttggaggcaacctatagaattatatatacatatatatatatatatatatatatatatatacacaaaaaatatatatatatatacacatacacgtatgtatgtgtacgtgtatatgtatatgtgtatgtatatagccatgtctttctctacaggatataggcactttggttataattatatgaaagaaggaatgtttccatgtcttcaatgtaaatttgaaatgcgtgctgccccaaatcccaaaatagaaattctctgaagagttcacctagaggtgagagaatccgtgagccctctagtcagttttcagaacagccattttctatgtgtgacctgcactttttggtatagcagggtgatgaggggaagcagtgtcccaggtgttctcctaggtctggagcgatcaccactttgtgatagtatgtcccccacacagatactgtgaacagcaagcatgtagactgtgggcttttgaatagccaggtttcctggagcatagaagttattattgaaatgcttgccctagttcaaggaattactggatgtaagagaactgagttctccactcaaatgatgtggaattgtgggtgtagaactcaatcaagtttctcttactaataatggtcatggtttattgggcatttagctaagtgattttcatctagaatctcatgtaattcttgagacaaggctgtgaagtaggtacaacagtgctcattttctagatggagacaatagaaggttatctagtaaatagcacagcaaagtctggaacttgggtgtgtctggttgtgaagctggctctttcaactggacactctgttgtccctgtttgttctcttagtgtgaaagctgcactgatacctactgacttgtctcatttgccattgtaggccgaaggctggtgtggtgcctaaccttgtgttaggtgtcttagtgccctgagtttgcaggtgacagaaatagaactcagactggcataaacataactcagactttattggctcatttagataaaaaaaaaactccagtggtgaggtgcagtattttagacatggcgggatacaggtggatagatgatgtcatcaggacagtctttctttccatcttttggctgtgcttccctccacgttggcttcattcccaggcagcttctctccgtggagaggcaattagagcaacccgcaattctagactactcagcccagaaataagaggttatctccttctaactgttctaacaaaagccctaggggtgactctggttagttcggtttaggccagattcccatttctgaaacaattagtaagctggggagatgatgcccctaacccctgaagttggagggtggaagagtcaacctcaccttaatctcatgggctgaaaatgggggagcagttgtttcctcagagatactggcaaaggagaaacctgtgttcattgcaaaagctgttgcataaatatttgtcaagtaaaggagtgaaggaagcaacgaatttctgctctgttctagggaaacttcagagagtacacaaatctaaaactatttcctgctggccttagtgaaacaaaaacatcctgtttaattgaatcttatcaatgttagaaaattaggttgaattgagaacagccaatatcataaatgtctaaaatattaaaaattaggctatttattaagcttgtagtacctttttacaaaatgaatgtgggaagaaatgaacaactttgagagggaagattagaatctgtgttctacagaagaagaagatcaaataaatgctccttctcagagtaatgcatatttgaaggggcttccatcaagtcctttctgcctatgttcctctgcacccctcagatattgggatcagtattgggataatggagggaaaggaagtccagcaatgagagaattatatttttcaagtgggccctccagctaagtctcctgtggcagagaggaattgtagacaccttgaggactcctgcaaagggaaagtcaagtgaaatttcctggaagtctcatgttttatcttaaaagtttatgcaaattttggattctgctttatgatatttacatactgcttttaataagttaatgtttaaagttaattaccattgagagaaaagcaaaaatagttcccactggtcttagtgagacagaaagatgctgtttgatagaatcttatcaatttcagaaaattgggttgaattgaggagagccaataccataaatcagtttcatagttcaggcatttccttcagtcttagtttcttggtatttcagatacccagatccacataaatacaaacttcatcatcatttagaagagaagcttaaaatattgccatgagggcatcacactccctgttaaaggaataagtcattactcagagtctcttgtccagcgatctctctttatgtgtctctctctcactctgtgtgttagggaaacatgttcaaaggtctctccatatcagaagagtactgatggtcatatgtgtcattttaccgctaatgcttttatttgttttgtatgtggatgaatgaaatgtcccaaataattcatagtgctcatgatcagcactcttcatccaactctcaaacttcatttttattgcagttgtcttgtgttgtgtggcagaaacactcagcttggtttttctttttttaccttttcagatgttgcttgagtttaagctgttaaggtaccctgactttgtgaaccactatatcattagggtgaagagtggatttttttcagcttgttcagatttatcttatgattatgggatttcccccctatgtggaaaaatatgtattaaacccttcattcaaatatttggattagtgctttctgctaagccaacataaaagtcacttacttgtgcattacagatttgctatagaagagaagtgttccatttacaacacacacatattgaaagtaattttaactgtctgtttgatcatgctgaaccaattgggcatcagactctttgagatctttgcaatgatcggggaaggggcagtggttttggcacgggctcttgcttctgcagtttctctgttcgtaaatttgtccacttttacacatgtatttatatgtgtcagtatcagtcttgctaaaaactcctaattgtatataagatttcttcaccaggtggtttcacttacgaattttaaggacggttgtcttcagaacacatcttcgttgtgaatacgtcagggagaggagaagatgacaaatcattgttgcgcatgctttcttccaaccgtggaaaaacaattagatgcgttttaatatagaagcagctatttgaaaactatttttctctttctaaaatgtttttgtttatgttcttatttttcttctgctgtgtgtacttacacacacatatatacacttaaaaatgttttcttgtggccgggcgcggtggctcacgcctgtaatcgcagcactttgggaggccaaggagggtggatcacaaggtcaggagttcaagaccagcctggccaagatggtgaaaccctgtttctactaaaaatacaaaaatcagctgggcatggtggcacgtgcctgtaatcccagctactcgggaggctgaggcagagaattgcttgaacccgggaggcggaggttgcagtgagccgagatcgtgccactgcattccagactgggtgacagagcaagatttcatctcaaaaaaaaaattttttttttttgccaggatgaggatcatacaagaattttcactcacaattttgaagttgtcatttccttgttctcaggcttccaacgttgatgtcaggaagtcacgtggctttctgattcttgctctttggagtgtaccctattttccactcagggtgatatttcagtatcttttttctatccttactattctgaaatttcacagttctgtggcttgctgtggtctctttgcctttattttgttagacactcaatgggatttttgcagtctgaaaccccaaaccctcaattctgtgaaatgttcttgtactgattctttgatttttttttttctgtctctgcctcttctctaatttttaaaaatttattcttgtccttcagatttggggccttctggattgagcttctgattttcttatttattgtttatcttttggcccttctgttcttaatttgaagggatgtctttcaactccagtattgatttactttaatttttgctatcatattttttagtttccaagagctctttcttgatgttctgtcctcccccaagctcttgttttatagatgtagtatattcctttttttctagtggttctagttgatgtttctttttcacttttttcttctccctagatagtcttcattctccgatatcctttcttctcttagtagaagaaaactactggtcagttagcctaattagtagtttggcttctctttcatgtgagaggctttccccaaatttctggtgatcattggctatccattcataatcatagaacataccaaaaagccacagagaccctatgtggatggctgagacttactgaatgatgagcttcgttatagggttatgggtgaccagctagacttctcacatccataggtcttttttgggcggtggtttggttcctcctggaaaagatcttccagtcttctgcctgggaaatggaagctttgctctggtgttctgggactgagtacaaggaaggagattagtggggagaggtctcatcattcagcttgcagacattcacttgatctccctgtatgcatctccatttctgttcatacctttttctgggcctggtgtctcccattcagtttctgttgacactagctgtgtatcttctgttcaggaggagtagtttaactgtagtattgagatggagacctggcaacctatctgctcattttacagactttcagacaatgcatctattttcagcttctgtctccagcctgattttctagtttttgagacttttaagtgtatttactctgcattttgaaaatagaagttaagaatgtctttcaagcacattaaaacatatcctttaagagtgtcattcaacaatgatggcttatttcaatttggttattctgattttttttccccttgaaactgttttcactacgtctccagtgtagaacttcaaccaattttctctaaacatatgaacttttcttctaaagagattctgtaagcagtctcaaaggcagctttgagcactcttcttatttgcttggtggagttttgtatcatattgctcctggctaatacatgtccttttttggtttcaaaaaattctggcagtttctcttttgattttgcatgattggttttataaaatgtcattctaaaatgaatggctgtgtgtacttcttggacatattttcacgcacaagagtcatccatgtgatccttattggcatctgcacataattaaactcatattttaaagacagcctttgcctttttgattgactgctgctattcactagggattcattcattgtggtaaggggaatcctacactatcaactcattctggggactctcagggacaatgaattccatgtctcagtcctcaatactttcaggttgtttttaattttaatcactgtcttggacatttgcatggttcagaaacctctatttctcatttcctgcttgaaacctacaattggtattcacagttgtaaatataattttaaactgttgcactttaaacaagtaaataaataatatcacacaagtgcaggcatcatgaggtttgctacttttgtgccgtggtgaattggatttgagagtagttgtatgttggtaaagagaacttttgatcagtgtcaattatggcagaaagttgaaccagtaggtttttgtatagtcaaaattgaaacacacaaaatcagacaaaatgcttcctaaggtgataagacaaacataattttcaaaataatagccctgaggggatcctgggagttccgagctgtcacagattccagccgtgggacaggtggtggaacagcactggctgtggcaatttcttgcataatataatcttattgaagtagtgcaccatttccactttaagaccatagctgtgatatttaaaggatgatacatttttcagtctcttctggctttcatgaagaaacaaaaagacccaaaacaaattagccactatgaaagaaggcattctgctaatcttggtgagcatgacacacatttttaagagtacagaaattcgaaacctgctccccttccttctcccttcagtcacagataggaagtgttgcattaatcggggcaactttccaaataattacacttcaggttaggacctattgtctacttccacatgaagggagcaggggaatgtaagatctgtctgtatcctctctttcttttttgtttgagacagggtttcactctgttacccaggctggagtgcagtgggtgtgtgctcatggctcattgtagcctcaaccttctgggctcaagagatcttcctgcctcagcctcccaaagtgctgggattacaggtctaagccaccatgtctggtctgtctatattctcaaattgttatcaaatagtctaaaagcatcatgtgataactaggaatagatctgcccaaacaaaacaatgcaaataaaaccacagaatttaaacccctaagagccctttctgcttatcaattagcagatgaaatccaagctaagggacgtgcacaaggtcccaaaactgccatattttactgattctaagatgcctacatttccatttgaacaattttgaaaacgagatggcttcttttagctgatggcatcttacagttactcagagccacacagtggttgtgatatagttgtgattgcctgtgcatgcatgaatatcccaagtaccagcagtgcaatttgcaaaatggaagaaatctcagagacaacagtgaaacactcttaccagatgctgcattgccagtgttcttcaaggcttagagatggtatgacatggaaaagcatgggcttgaatggtttggagtcaaaatataattcaaagttggattctgaatgtgaagaagggttagagatactgaatgaactcattgttctgatattttcttttgtacctaagcttaaaagtgatatatggtaaaaatatgtgtctgtgtataaaataacttccataataggtggaaaataaaaaaatttgaagtaataaggcaccgtgtcaatttaattgacagcttttatttctttcttagtccataaaataatggtgcatcttacaacacatggagacttagagttcattaattatggtaactaagagttgctgaaagtccctcttcttcatagtcttattccagtatggcctcatctcatggattatgaatataagttatgacactttttgatagaggatcagagaatttagcctcaaagttggactgtttacattatgatactccaatactggctttcagaataatcacagataggggggcaggggtcacatggccatttctatggctttcttccttgcaagctgaggagatctctccagagcacacctcaagaaaagcaaagtggtaatacatggctataatgaatgtagccaagacagtttcagagcaggattaacaatgactcatttcagccgtggaaatattttagtggtccacatgtctaattttatttcctgcaaaactctccccatatattagttgcaaattatccccctaaatgaattgttggttttaagccagttaatattggaggactgcttctcaaaattatggttttgatttcaaactgaagccattcttcttgatactaaatagttccatcgagtcaccaattgtctgtcaaactagtgaaactaaaatcatatcatctggaggttactcatctctcgatttctgtagtgattttaaatcagtaagttaaaagtcagaaagaaagggaaccaaacatctctttgttttacacactgaaatgttttctgatcccctggagatcattcttactgctcttccttaaactctggcatttggtgatagacacaacatcagcagtatctgggctcagtatggcccactgagcctgaatagagctgagtcaagtgcacagaatggaagaccaaggaaaggtcaacacaagctgcaaactgtcctgtgtttttctgaccgatctcccatgggggcctcaggggtgtcacagcgggagagtgcaataacctggtctaagtattttgctattcatggagaatgttagttagcctgagaaactgagccttgaactcagtttctgacggaaactcatagacattatgtttggcacacagtcatctcaattcgtttttttctttttcaaataggacagactcatgtaggaccacgtcggtagaattatcaaaaaattggcaaacaatttacctgcttagtcagactagaccttgaaatctgtggtggcaggaagtctccattgggctgatttaattggaagggttttttcgggtttttttttttttttttttttttttttttattgagatggtctcactctgtcacctaggctggagtgtgatggtgtgatcatggctcactgcagcctcaacgtcctggcctcaggtgatcctcccacctcagtcacccgagtagctgggactacaggtgcccaccacgcctggggaattttttgtattttttgtagagctgggttctcaccctgttgcccaggttggtaattggaaggttttaaacagtctctgtatgtgagagtgagcacatctagccatccagtgaggataggagtctccatgcaaccgaatgtgatttaatgttgttcctctctaggactcatctctaaactccactcacaggtcagaaaacttttccaagaccatgtctccacattttgagtttgaaaaaatgagatcagggtcttacagatgttttgggattgtagaagataaagggagtaatatgggtttggaagaccctgttattcatgacaatgcagaagggactagagcaatgcttatgtttttgtgtctgtgaaaagggggcctactggaagggaataaagtcaacagatgcataagagaccaagatcttcaggcacatggaagcttgtatttatccactgtctacaattcccagtgtaagcagagaccagtgtacaggctaagaagtactgaaactttctttgacttaggaaattgagctgcatcttgaaaaaaaaaaaagaacagttaattcagtttaaaaaggaaaagcaaaaccacctaatgaaccaatttcatattttctgaaagtaggaaactgcagtaaaactaggatgtcaggcattctcacattcgatcctgaactaaattagctttctagttgattcatgtctttggctatgatatgctaattgcagaccctttttatatatttattaaagtaggatctcacctttagcaattcattatgatttggttttaaaaaataactctatacttgaaagaattaaaatgtatttcctcagaaatattctataaatcagacttctctattttagtcagatgggcttttaataatatgaatgtgaattagtgaggcttgattttaattgcttcattttccttattctgatgaataacaggatcctatagcttttcaatacaatagctgataataaaaccacctcacctgttatttatgagtcatattctattctccagagtgccttcagctaatgagcaaacatcagctgtatccctgaaagaataattgttcttatagaaataattactgattgataattactgacttttttgagattgaaagacctgctctctatttttcttttatgctatactcaacaggaaaagtcagttggcgagagtaccaagtatttaattactcaaaatattaatttaattaatttcaagtaatacatattgagtgtatagtactgcctgtcagggggactttggtaagatatgacccacacacatgaaaagttacatgacaataaagtcaggttatcattatgtgtcaaatgaacacttaagacagtagctattgtagaattcaagaagcggaggagtcataagatcaggagtcactgaaggattcatcattgggggaggcctttttgagggcctttacttggggtaggattttttttttaactatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgtgatctcattgttcaattcccaccaatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtcttcactattgtgaataatgccgcaataaacatacgtgtgcatgtgtctttatagcagcatgatttatagtcctttgggtatatacccagtaatggggtggctgggtcaaatggtatttctagttctagatccctgaggaatcgccacactgacttccacaatggttgaactagtttacagtcccaccaacagtgtaaaagcgttcctatttctccacatcctctccagcattggggtaggatttttaagcaggtgaggagaagggtagaaaaatagagagatggtagcagtggtaccttgtgtagcataagcaaccataaaaggaaatgactgtgtttggaggggatcgttaagcagtctgctttgctctgccaaacaaggggcttatgctcatcaacactgtcaatgtcttgaaggacaaggaaaggctgaagaattgattcagatggaaggagactaaggcagcatgacaactaaatgcaaagtgtgattctggattggagactggtttggaaaaaaaaatttcttttctttccttctttccttctctccttctctcctctccttctctcctttccttccttccttccttccttccttccttccttccttccttccttcctttctttcctctttcttttttttggtgtgtgacagattctccgtctcccaggctggagtgcagtggcgcgatcttggctcactgcaacctccatctcctgggttcaagtggctctcatgcctcagcctcctgaggagctgggactataagcgcgcaccttcatgcctggctaatttttgtatttttagtagagatgggtttttgccatattggccaggctggtcttgaactcctggcctcaagtgatctgcctgccttggcctcccaaagtttgggattataggcttttccactgtgcccggctgggaaaaacatgtctatttaagacattattgggaaaaatttctgaaatttgaatataggttgtacactagatgccagtatatcagtgttaaatttcctgaacttcataaaggtattgtgattgtgtatccctaggtgttctgtagtaatgcaccacaaaccagggaccttcaaaaaacagaaatacattctcttatagcatctggggccagcagtctgaaatgaaggtgttggtgggaccatgcttcccttgacagctctagggaagtatttcttcgcctcttccccacttccagtagttgttggcaatccttggcattccttggctggcaactgcctcactccagtctttgcctgtgttgtttcctggtgttcttcttgtgtgcctgtgtcttcacatggccttataaggacgccagtcattgagtttagtccccaagcacatgtgacagcatcttaactaattacatctgcaacgatcctatttccaaataaggtaacattctgaggttccaggtgaacatgaatttttgggagaacattattcaaccccatccagattatatatgagactctcctagtttttaggagatagatgctgaagtatttaggggaaaaggataatgatgtctacaacatactttcaaatggttcctcaataataataaaattatggtcatatttatggagagggagacaaaatacaatatggaataatgttaacaattgatgaatttcagtgaagtgtatgtgggttgtataatttttggaaattatctagaggtttgaaatttttcataataaaaacattttttaagaagcaaaagaaggcggggtgcagaggctcacacctgtaataccagcactttgggaggctgaggcgggtggatcacctgaggttaggagttcaagaccagcctggccaacatggtgagaccccatatctacgaaaatatcaaaattatccaggcatgatggcgcgtgcctataatcccagctacccgggaggctgagctgggagaatcccttgaacccaggaggcggagggttgcagtgagctgagattgtgccattgcactcctgcctgggcgacacagcaagactctgtctcaaaaaaaaaaaaaaaaaaaagaagcgaaagaaaaaagaaaaatccacaaaaatgttgatcatataacatttttcctctgaacattgttatgtctggaatggtgccaaaactgctaactctatactgcttcaagtctaaggaggtagcagtatcaactagtcttgaaatttatactgtctctgttcttcctctatgggagattttttttaaatggcttaaacaggtttgactcaggattttagtttcttgcagctgaaaacatcttacctcaaacaatagactattgcaagactgtgtgttatattagccaagttaaagtcaatattagccaagttaacgtcaatatatttcctttatttgaaacaaacaagaaatccactttgatactttcatgctttatctatatttataaaaataggtgaacttttaaaaatcagaattccaaggcagttttcttaagtgaaatgtttggcatattgcccaagattttgatacatgatacctgtcctaattgtccctttgaatgtcccagataaaactacatttcttagagacaagttaaaaggtctagatttttttttccttgtgactttttattctttgttaagaaatagctctcagcaagaatattgggctttagtggggaaggtacatttctaatttttgtaactttatgtattaatactactcagataaatggtatactacacaggcttggggaacacatttaaaaggcattttgggttttagctgagaatacttttagaatataaaatgcaatgtattttgcatttcctgaaataaataaaacagagctgtacaaaatatacagtgcagccctttggaaaaagagatatcctagctcagggcaagccgtttgatggaaatagcattttctccaagcagatggggctggctccacttagtcctgcagagggccagggggacttgtttgtgtgcagagccttggtctaatgccaggagagccagcttgtaaagttattcccatagggctcattcccgtctgcccagcatcacccctgacacaaacaaaacagccacgggcctccttcatttctttaagatgaatgaatgctgccgtaaagaaggacttttattgaactgtgtgacatgatgcagaaagaatgctgtagtgaaacacaaaactatatgttataaacgtcaacataagagaagtagtttggggtgcattttctgatgtctaccttactataagatgttttgacggataagttatagtagtaaaaggctgtctccatagtattggaaatacctgctggatttttctgaggtcgtcttggttgtaaggacagaaatacattcaggctagcacacagctgagacgttaagtgaaacataagctcacgcaaatctgagagtgggaaccaggggacagggcctagcagtgctgggagcttgaggctttattctggatccagagctgctatctggggcccagagcagcaggtgcttctggatcttgcactcaaaggctgtgagtggatgtggcccagccaccgtctgcttgggtgtgctgccgccagctggcttccagccttctgctctgtttcatcaccttgcagtctccaccccctcaccatttctagtttctcttaatgctctccatgcatctctggctcattgcagtccctctaaaccatttactccctcttatccttacagcttctcttcttgcacctcaccctctcattccctcagtattttctagttcagccccctaaggagacagacaggcttatggcccagattgtctttgtgctctgggccatgtcactgtccctgaccctccctggtccaggtggcagtagctggcaagccataggggttcagtgggacagagagtagtcagccaaggcagcttccttcagcaagagctttggacatagacctgattgacacatctggttcaaccaaatattacaaaatagtttgggtgtaaccctctgatgccattttatgatagacactttaagatagatggtttaggtcaggtgtggtggcttatgcctgtaatcccagcactttgggaggcctaggtgggtgtgtcatctgaaatcaggagttagagaccagcctggccaacatggtgaaaccccatctctactaaaaatacaaaaattagccaggcatggtcatgggtacctgtaatttcagctacttgggaggctgaggcagatgaattgcttgaacctgggaggcagaggttgcagtgagccgagatcatgtcactgcacccagcctgggtgacagagactccatctaaaaaaaaacaaaaacaaaaacaaaaaaaagaaaaaaagatagcgtcagtcctaattcaggatctaagatctagatatataaccaggagtaagcattacacttaaactcttcatgccagagtcagtgcctctgtcttaggatgtttgtcataaaaggagggcatagagaagaatgttttcctttgagacagaggtggtgagatgagagaacttagcttcagcagcctgatgttatcaggtgtcgagtgggctttgtaggagaaaagcgggatcaggatgatggtggtgtgccgagtattaaatatttgactaagttgattggaatacgataacagctttaattggaagaacctaaggacatgcccataaatggttcaatttatgaagcccattcatggatctatttaggaggttgagttcatgcaaacaataacagtaattcttgggtctctactatagtaagtcaagcactgagccaagatctttcactggccaccccgtttcatcctcatggcagccttttaggacacttaggcttgttatctctatttgacaactgcagaaattaagttttagggaggccaagcaactttctcagggttgcaaggtgatgacctggctgaaattttgaattttggtctctgcctaatagacagacataaaaataggacactgggtctcattttttctggtgctgctctcatgccacctccttccacccaagcagcttttgcttagcagtgacaattcaccatccagcctttagggttctgtatagtggcttaagacaggaatacttgtcatgcggtgcagaacttgctgggaagagcatccaggagggaaagagacacttgggggcagacaccagagccttgtagggtgtgccagttgcctgttgtatgacagtctcctaagagactttactggtgcaagctggtggccctacacactaccaggtcacacacagtgctcagctagaaggagggagacggtgaggaggtcattctgttccttttaacacttctggagggtgtgtagaggtgtgctctcacagtcagggcaggtgaaccctcaaattttatgaagagcttaggtgagacaggggacatgtgtgaaagcagtcatgtctaaagtagaaattatttctgcatgcaccggcaaaacattagcacccataaaagtctctgctttttattgctacttcttcactgatgagtgtttgtgaggagagggtgcttccaaccgatgtttgcattaaaggaatttgttaggtctaagaacataccaaatacagtgttctcaaggtttggagcattaagccttctttaattcagagttttgtcaacgtgttgcaacaacctatgaatcagaggatgacagtttgaatccttgactcttcagcagtttccatgaggtagaagaaactgctccaccttctctcagaggacctgagagacactcttcgtttactacagctcgagaggtttgttgtttggtcccttggagctggaagaggtgaatgaggcagactggaaaaataaaacagttattatacaatacacttggatggaaatttaattgtgtttagacatgaacacacttttttaaaaggcagatacaaagttattatgcttttcaaatctttagaatgtatttttgaagattctccttctcttcaacctttaaataagaaccagtagaaatagtgcaactttttgagaaaacaatggttagtattcccctgatatcacagccagcttatttagcaagcaagtaattcccagggctgtggtgacttcatcaatgcatctgatgcacaaacgaaaacatccttcacttctgtccaaaaaataaaacgattattatacttttatgttgataataaagtcagccatcagtactgttttgtgtgtgtgtgtgtgtgtgtgtgtatgtatgtccccaggccttgaggattacttgatttgttgttaaatcctaaccagaagctttggatttaaaggaaggaatactgtatacacaaaatgcatgaggcttttttcttttgattggtagcaatgatatactacatatgttatatcatatcagtatattgaaaagttcccaatattacaatatttgaatagaaagtgatcttggcctatctaatgcaagtgatagggcagaatttaagttaaacaggattcctttgattccttccaacaaacaattataaaatacagaatttgaaaaggagaaatgaaacaaaccaaaaattctattgaccatgtgctactgttagttccaactgtagttggagtaagtttccactgggcgaggcatagaaatcgaaatacttctgaggtttagatcttacttctcttatgctgtcctgttggcctatgacttagccaggcttgtggaatgccatggcatattctctgtctttaattaaaagaagttttaattgtggtaaaaaaaaaacacacacattacacaaaatttaccatcttaatcattttcaagtatacagtcctgtactgttgggtatgttcactttattgtgtaacagccatgccatttctcttacttttacattttttaaaacctttttttttttgcctgaaagaagtggggaatgaaaagggatttttctaaaaggtgcctgcgtctccaagggaacttatttctcagcagtataacctgttgggccatgtagatgaatctgtttgggcaacccttcccttgagataatattgttcatgtgtgcgttccccatagagcaacatctattctgcttttgatgattcttaccttggggctgtggatgaggctacacaaacaaaattaccccatagttcacctcatcttagtcatgaagacctaggccttgttcattcagtatgcccaagtcagccactgcataataaacttgaaatatttggctctattattgattgatcatatagataatggccccagattcaatcagccatccgaaatactgctgtggttgtgcttggtttttaatttttttaagtcatttaaaacagacatagtcttaaatgctttctcttgaaaatctgatttaatagagtcattataaaattgctaggtggtttagttttattggacttttatatttggtggagaattttcattacaaaaattacctatttttttttccaatgttggactttttatgagaagaggaaagtgcttatacagatttatataatgaacaaaggtgagagagttaagtttctaattttctggaacagtaaaagatggtttatcccctatctttgctctggtcatagatgagaggatcccttccacgtgaaatgccccaaatgaagtgtgatagtgatactcggtcatggttagggagaggtgatgcttcctgtgtcactatactgacagctgtgtgtcaggacacctctgcgccattcgataggctgtgatccctctggccagcccaccaagagcaaaccttaatccagttgtgttgttaatcacacagatatttagggacttggctttaccttcaacagtcttccaaggagttcttagttctaacatttgcgtgatttcaatagctgatgataaactctctgcaggcatttagggacgtcgctttaccttcaatagccttccgaggagctcgtagtgctaacatttgcctgatttcaatagctgatgataaactctgagcagatgaggtctcttttttgaagacctgccgatttccacatttatctttgtttcctacagatactgtctcctgaataattcatatttttcttagtttcctttcctggctcctttcctctatccatccttaaatgctgctgcatcttggccatcttcttttcttttacactgttcttgggccatctctgccacttctgtggtgtcagataccactaataacatatgtatgtgtgtatacttggaacagataacatcacctgagttctaggtcccacgtattccattgcttcttagatatattacaatttctagtcaccatagacacataagatttcatatgtccaatatagaactcattaactttcccttcgcttccctccctgaaccaaatataccacatgagttctcttgtctgtgttcctgatctctgtgaaagcagaagtctagacgccacctttggctctttcattgccgtttttctgcatctgtgtggtagtctttgttaatgatgttcctgttatttctgaaattgtataataacatagcatggcatctgttgcttcacatttcacttcccattctgtgattataaagaggtcatttttgcaaggatgttcaaggccgtcatcagcttctcaaggatcctccaagtcctttgggagacagccatgcagtcctcatcccagttcactttaaccccttacttgttcgctggtccctcccttgtcaacaatgtttttgtgatttgagcagtttttcagcactccttacattgcctttatgaaatcttatatctttgtaagatttgtgaatattttcattgcatttgctttctatccttgaatacctacctcatttgaccatcaggaagaggctgggtgagggtgctgggttgatgggtggaagaggcccttgcatgaggcagggctgtttcagttggaagtcatttcctcagtacttagctcacccctgagtgttgcattcttaaggcaccattcgcttccccacccactctcttaaccgtaggtcttggatattcacagacaacgatctcttgcatattacctttgaactgtcccttatatattttgttatatttttactttagaggctataaagatttttcaatagcaaaggatgtgaaaacttagggagagagtggacaacttagtttgctatctcagagcacaacatagtttgcttccagaaggagatatagggacatatctctgttgatgaaaccgttcttagaatttgaaaagcaattttatgcctaccattttattggatttgttacttcattttgggtagctggtgatgttctgctgtttattattattattattataattggaaggggtctcaccttgtcgcccaggctggagtgcagtggcgtgatttcggctcactgcaacctccgtctcccaggttccaagtgattctcctgcctcagcctcttgagtagctgggattgcaggcatgtgccaccatgcccgacaaatttttgtatttttagtagggatgggatttcgccatgttggccaggctggtctccaactcctgatctcaggtgatctgcccccatcggcctcccaaagtgctgggattacaggcatgagccaccgcacccaagcttattattttcttcattggtggctcctactagtcagcaactgctaacttgtagggtaagaaattaacagtaataataggaataacagtaagacaattgagtgtttaccacatgccaggcagtatgctaagtgctttcgtcacatttgagtgtacaaattgactgaatgaatcagatcatcactgcaaaggatcatgagttagcatgctatagcccattctctgtccatctaagttctcagaccacttttatggggcattcagtgaatggaatcagttgttaggactgcaggagtccaggaagttaacatgaatggagaagacattatataaatgtgtctagagacatgtttggaagaataaagctattatgacatcctttggctattcatttgggtttaagtcatatagtagttggtataggaaaatggtcttaagagacaaactggagtatgtttgttttcatccttcctaaatctcagagacaatcagctttggtaattcctgtggattttttccatgcttaagaatgtgaggaaaatatttcctatttatacattatatcaattaaagccctcaaaatgtctctgttacacaaaatgcaactaataatgccacagcgattttcccattgtcatgtcactaaataagttggcttatgcaggcttacacaaattgtcattttgcatgattatagtattacaagaaatttttgtggctttaaaaacctgctgtagaccattttgctttgcttggctagcctttaggataataatgccatttactagactttgctaaacccctaaaatagcaaaggtagataattaaactaagccacagctactgcaatggttgtttctgtgcaatagggagaagacgggaagcttggtaatgttttgagcagaaccagctcatcattgaaatgctaagaatgagctggaaaaatattttaaaataggaattatatagtcaaagccaatgaaactaacagaaactcctaacagttggtctggtgttagtccacccaccctaaatttgagtttaaaagatgctttgggactaagcatatgttggaaggagttgatttaagccaacaggcctctgacttacttcgcttaagataatgcactcaatacaaacacctcgtttggggcactcagtctaattctgtggttcatggtttagagagccatacttttgtagttctcagagataaatgttttgcttgtttatgactctagggaagaggataatacatttctgaacagcaccatcagagctgatgaagtctctacacttttgttgtttctattctggacagggtaaattcttctgaaattgcatagatgatggatcatcctaagatatcatcctaagataatgctgtgcttgccccttagacttgtgggatgaaggaatgtagccagcggcttcatataaacttgcgcaatagtattacagatcctacttttcagaactgagtacagatgggtttgagaatagaatctggtagagagatggccaaggaagcagaagtagaatgctggtgttagttaggattgggtttggccacatgtaagcaaatacttaatataatgatggcttcaacaagttagtttatttatttatttttcataaaagaaatccaaaggcaggcaggtacgtaggtaggtaggtaggtagtccaggattgttatggtggtttcaccatgtgatcggggaaccaggatcctagttttccactctcaatctttattactaggatcttaccttgtggctcaacatggctgctacactccagtcatcacactacatctgcattctagcaaactataaggaggaagtgacaaaaaggataatcttttcttccctatgaggaagcttctaggaagttacatatctctttagcagaaacttggtcaccttaccacacccactgcaggaaaggacagagaatgtaggcttttagctgagtagcagtatacctcacttaaagtccagttcttactactatgtaataagaaacaagtgaatatcaagagaagagttgcagaccctggcacaactgctagatactatactgtttatgcaaatatcagagcggcacgaactttaaaagatggcatcataagtgtgggttatctttctcaccatggagaaaaacaacatatatgttgaagctcttattagaatacaaatattgggtagttgattgaaattgcccattgaaacattgattccctcttagtagtctgacagtcttatgcaagccaaaaggaaagatgtagcccaggaacagagaaacggaaatgattaaatgccagctccgtgacttttatagcagttcattcagctgcctacccacaaagcacttcccaaggaagttacagccaagaattcacttggctgggcttgtccatttttcattcatttcaatgaccatctccaggaataaaaaacattctgaaagaagaaaacctattgaaggacttgggaagtatgaacacagttttcctttaaaagaaaattttaaaaagaagtagctttaaaccacctatgtttgattaggaattttagggtcccgttttcctctgtgtgtttgtgtttgtgtatctaagtcactacaaatatatacatatgtattcaagatcaagttatgaatttcatagaattaggaactttgtcggttttcttgttttaatgatgttgagtgaaaacagaaaataggaggacattcttttaaaatagccttgccgaaaacctgaaaaggactctagcattcaataaacagtacatttctccctcattgggggtcaatgaatgtttaatgcatggggcaagattttggtctgatctgcaaaaaaaaaaggaaaaaaaaatggtaaatcacagacacaggtttgcaacgacttcttggatagatcccatagctctccagttgctttcagggatttaaaaagttgggtccggttttcttcatggcaggtaccttgatcactttggagggttcccttggggtaacacttactcagcttgaggtaggtgagtgggcaaggtcagagcactgcttatgcttgtgcattgcttgtgcctcagagaatctactagcaacaacctctagtctcttacagaagtgtggctgggccaaggagcagtttcagtatctcaggaaggtctgcggtgatgtgttcaaagttagggtaatttgtgatctactgccctcggttttgaactttagcgaaaatttggaggcaacaggcaaacttccattccatatccagtcatacatgtagtaagttttatattttaggtattttttactctctcatttactattcacccatttttgtagtctcctctcaattcattgttcacttcattctgtgtttgttggagtagtttatttgcttatctctagtattttagaagtttagtgtaatttagaaaaggaggttagtaccagctaatgtgtggcaagcttttagagtatagtcttgtagaaggttttctaggctttaacttatgctgacaagttgtttgcaaaagtaacataagaatatatatatacttttccatcattatggagtttatatttttagcagtaaagtggggattatgaaacttcagacttatggtatggtgaaaaaaaagaaaaaaaactgaagccaggggtaatttgccactggtgttgtgtttcatgcctattcaaaagaatctgaaattaaccccctctatttttttgtctaaaaatgcaccacattaggaagattgtttaggatattttcactcactgcttaaaaaaatgtaagtgaactgctgcaaagtggtaggtggtttcaaaaaccttaagcaattgcttcaaattctgtagtcttctgaaccatctgttcatttgccaggtatggacaattagggaaagccgtttgaaccaatgttgaaataatttaaaatctcattggaagtaaatggctaacagcttccaaacggtctcatcattgattccaggaaatgctgtagtcatttgaaaatggctttgttgttaaaatatttgaccatttagtatgcaaatcaccagaattaaataatttgcttaactaacaataatttagatatttctcaagtcattttttttcatcaggatttgctaaacacttaaagtatacatagaattatactggacattttatgaaatagaaaatggaaacaaggtcttgctcatgtgttgggttatagcatatttaagttagttatgagacataactgtagaacaactacaaaaacagccatatttattcattcctttcttcctttattcacatattatttgccgagcacctacttctgcatcatgaatgctgggttacagtggtaacctataaattaagatgctgttctcatagatctgttattctgattggaggagacacatggtgtaaacgtaaaagagtgaatgaatgaatgaatgaatgaataagatgtttcaaatagtaagaattcctatgaagaaaataaaatgctgtatgctccagagagtaagtgagcagagaagggggtgggtgaacaaagaaagtgccctctgattcagcccaggaggcagaggctgcagtgagccaagatcgcaccactgcactccagcctgggtgatagagtgagaccacatctcacaaaaaaaaaaaaaagctctctctgatattggaaatgagattggaacgacacagggagccgagagagagagagagagagagagagagagagagagagagagagagggagagagagaactgtaaacatgtaagcataaagtaagaaaaatcagcgtgggttggctgctttatggaaactttttttgagttattttgtggttgtgcccaccacactatacatcttgatgtagtttgcatatatttttaaagtgggttagcatcatcagctaatgcttattgaactgtcagcaaatatttatggagagcctcctgtgctcaagaacccttattaagtgcagagccctgaattatgagttacaaggattttcagaaggtagaattctagggtttaagggaaatatttcaaaggaattacaaattaatttgaaaaaactccagggccttcttagagaagcactgtacattccagacatagcatctaaagccaaaagattaaaccagatgggcaatcattttctttctcattacccaactaatggggactgtgaagatgggcagggactcatgtctagagcccacctgaagtcacagtggacctagaatgaagttaacgtcgcagttaagattttcaccggctactttgcttccccaggattttatattttttgaggaaacggaatgtctctgtcatacacagagaggtgctgacttccctgcatgccgtgtagacacaggaggagtggtcacagaggggacatgtgccatcagccttcttcttgagctagtggcacccttaaggatgcaggcggggaatatcaatatattattttggaaaaatcagaagcaaacattgtataaagtttaaacagtggcgacagaaggtgctggacactttaaaatgttcttgtgtggataaatattttgtatgggagaaagcacaagctctgaaaacagccagacacatggttagatggatgacttatcatcttggagtctgtgtctactcatctttaagatcgtagtagtaacgatgatagctgtcatttattaagcacctgctaggcatttaacgtacattatagccatgctgagctggacgttttaatctctattttatagctggaaaacaggctcagagtgagtaggcaacttacctcatgccagatatttagtatgtggcagacctggactcagacccagttccctctcttccagggtcttcccacccacactgcagtgtcccttgcaggcttgttcagattagcaaccttgaatgctaagtgctgctaagcaggctcacagagaaggacaacgatgaggcatgttccctcactgctttttcctcctacatcccaggacctgggatcaccttgagattgtctgtgaacaaagaaatcaatatgactcaatataattctctgtacaattacattttaaaattgacagcctctttcactgttgcttcaccaaaaaataaataaataaaacaaaagcctaggaattatgtttatgtgttttccaaatgaagaaaagaaatttgggatcctaaagagtatataaaatatgttgatgtagcatgtaagtggaaatggctaaaaggtaacagaacataaccaatgttgtaggaatttaaaatattagtgtcttgtttaatgacatagataacacacaacaatggtgctttgcatgtgaagtcccattatagtatgatgagtctcagtacaggtatggaagctgctactcaatattaggttaattttggtcttcatcaagacctttaaagatgatttcctggattttagttcttataatcactgttctgccttcagcaaggacttggtaatgataaattgttggtgtagataagtcattggcatgaaagttgatctcaaacagcttctttcggcatttaataattactgcagtgaattttcacctgaatgtgtaagaactgtctcaccctgaactgtcaaatctaggaaattataagatgagacacttccaaataacgaaagacctgattcatatgactcccatgagctaacttttctaagaaggagtttctttaataagattttatttcaatttaaggtaatttaaatcaaactttttacattcctggtcttgatgctaatgtaacttaccagaaattgactacgtgtcagcgttttgattcatatagaatagaaaggaaggacataatgttatatgaaaccagccaggcacagaaagacagctacttcatgatttcactcatatgtagaatctaaaaaagctgatctcatagaagcagagaatagaatagcggttaccagaggctggagaggggaaaggggtgggcaagctgggaaaaggttggtccgcttatataggaagaatagttttgggttttctatttcatagtagggtgactatagctgatatcaatgtattgtatatttcaagatagctaacgaagaagatcttgaaagttatgaccacaaaaaaataaaggtttgaggtgatgaacatgctaatcaccctgatttggtcattatacaacgtatacatgtaccggaacatcacactgtaccccataagcatgaacaattattatgtgtcaattataaacacgttttttgaacttgtcaaaaaaaaaagaatagaatgggaagccgctttgtgtattattggtatcagaggacatgaatcacacctgtataaaagacattcttttatgatggagggatgcactgtttattcctaaattaccaggaggtgtggatttgactcatactaaaccaaatctatgaattaatgtttcctagaaagttgtctcgagatggaaaaaaggtgtctatataataccttagtttctttgtcaaatcatgcctacctttctgagttgctttgcactatagcattataaagttatctagtgaatcaaacagtgtatatgcacattttaagcattcagtattgatacttttgtgcagtatgaaggtggtttctttcttcctaagttatctgggtaattacatcaactggtcatttggtttttactttataaatatcggcttaagtaaaatagcataacagttgctcagagagtatttactttacatccacttttatttttccttttattctcagcagcatgtctagtttttttagccaaagtctaaaaatatcactatagttcagaaaataatacctcttaagtagaactagcaaaaatatttcttcagagttaagaggtcatctcttaatgctaacaggttatgacatgagcagaactgagaattacccagctgacgttgctcctttagcatagaacaaaagcatcttttctgtgactaatgtaaatcccaaaagttagtgtttttcaggtatacagaataaaacttgggcagtaatgactgaattgacgatattgtcagtcagtggtaatatcctaggtgaccgtaatcacaggattggttggcaatcaataactgtatgtgtttcttggaagttatctgggatgtgcttcagcaaaataagggagaaaattaagaaaggaggtgaggaattcaggaaaaatctatctacagatagtggtgaaatattccattgaatgaatacacgcaatggggttaagaagtcaaatagtttaacagaaggctctatgttaaaaaacagtggtgccatgtcccaccccttctcagttgatttgcatgtagtattacaaagttatctaatgaatcaaacaagtgtatatgcacattttaagcaattcagtattgatacttttgtgcaatatgaaggtgattttagaacgcagtggggttaaaggagaaccaatagcaacagggttaaagggagagccagttcagatgacagcaggaggagtcagggctcctggagggtggactctggaaaactcaagaaatatccatttaaataaagtgtttagagatgtggatgtcactttagaagaaagtattttaaagacttaaagcatgctttttttaaacataaggccttctgctgaactatttgactttttaaccacattacatgtattaatttaatggaatgtttcattaaaaataatactgtgattaaaaaaatttaaactgagctggtaagactggtggaggaaaaactttgccattcttattaaggatgcttgactttggcctgggccttggcattttctagggatgcctcaggtatggtggaaaaagtgtaggctggggacccaaagagactgattgtcagtcctctccctgccctactagttgtgtggctgtagatgatggcaatgttgtatttcctacacacctgctatgtaccttgggggttggtgttatctttatttgataaaaaaaagggagcaccagaagctctgtgaccccaggcaagttatttaaaactttctgcatcttcgtttctgacacagatatgagtagtgcctgtctaataccgttgctgtgatggtcagagatgtactctatgggcagcagctaacccaatgcctggattataaacactaaacaagtgcttgttattgttactaaagtgtatggtttcagccatcctcctggctaggtatttgacttagttcctctcttctctaaaagatgaaaacagtaattccagacttgtattggggtgtactttaggagtatatattggaagttctctcaactctgtgataagaggatctagcagtctaagaaaaaagatgagacaacatcatctacagataccatctcaaacatggtttcttccagaattaagatgttatctctcattgatggttaagatggagcaattgacatgtaaatatgatgcattttattctcctgtttagttttttggtgagattatcaatctcactggaaaacaagaagggtctgcagatgtctggtaaggaaaacattaacatcagttgtacattagacatattacttgctttccagatcttgttaaggtatcaggaaatccctttatcctttggtatacaaagtagtacttgaattcttgcaatatattttgtacttcctgttgcaaaagggaagatttaactaatttttttctactagggatttgtagtaggatatgagaataaataaagcagtttcattgactcacttatgcagctgaagtttgtaaaaaacctcacctagatatttcaaggaagtaatagctaatttttttatccccttatgtatgaaaccttttaacatacatcatctcctacaatcctcacaacaactcttaaggatactatcatagtcaatgcgtgttatttttggtaattacattctacacagtcaccacaaacactgaataagggaacactgaattgttgcttctagtgaaatgcaggattagtttcctgggagcctctggccacaatatttttgtcaatggatcaacatgttaacttgttttatgtgtgtttctgtttaaagacaccttacttaatatttatttttgattagttaaaattgaactcatggccgtcagcatgactattaatattctgtgactgtatgaagcttagctaacacttatattttccttgtaaggcacatcacagatttcttgtacttaggaacactagacagcacttcaccactaccttgggaggcattttaaacagcgacatcaccgtcaaaagcacaaaaatgtgaaagacctgacactaaatagaccgtagaaggccaggcacgatggctcatacctgtaatctcagaagtttgggaggccgaggcgggcagatcgcctgaggtcaggagttcaagaccagcctgaccaacatggtgaaacccctgctccactaaaaatataaaatttagccgggcgtggtggcaggctcctgtaatcccagctactcgggaggctgaggcaggagaattgcttgaacccaggaggtggaggttgcagtgagctgagattgtgccactgcacttcagcctgggcaaagtgagactgtctcaaaaaaaaaagaaaagaaaaagaaaaagaaaaaaggacacttgtttatagtatgagagctgaggcaggaaggcagagcatcgcctgttcaacagcagctgggaaggacaacactctgcacatgaccaaggaagtactgcaagtattgatttgggggttacaaataaatttcagagagtaggtgaatttgtaaatgcagaatctgcaaataatgaggaatgactttattactgtattatcatcgttttgtttgtttgtttttgagatggtcttctttggaggggtctcactctgttgcccaggctggagttcagcagtgtgatcacagctccctgcagcctgaccacctgggctcaagtgatcctcctgccttagcctcgtgagtagctgggaccacagatgtgccaccacatccatctaatttttttgtttatttttagagatgaggtctctctatgtaacccaggctggtcttgaactcctgggctgaagtgatcctgccagaattttcaatttcaaataaaaaacttaatttgagtgacttgcctaacttccacgcaggtaatagatggggaaactgatgcctatacttttggactttctttgttcagggtatgccatctactgaaacactcccttccacccagatctcaggggcttaccacaggtcagcagggatgtgggactgcagcaagccctgctccatacagtcattcagggattcaggcacctctatcccccagcccttcccagaatcccctgcatcccgtcggctgactcacaggaaagagggagtggcaaggcctggatgtagtttggggacattgctgtacgtctatccatactgcattgcccccacttacctgcaagggagcctgcagaatttcttttcctatgtgcccaggcagaaaaaggagtggggtttggtgagcatcgtggcgttttcttccttccaggagcacataatgatgttttaatcccattcttatattccttacgccatttttctgtgtccctttgagaagtgttcgagacttacagcttctacctgttgggattcaatttaagaaaagagtggaagtggaggttttgttttctatgcagtaagtttcctgaattccaggggaaatgagctgattattttcttatacttagctggatatttcaacagagtcttttccaaaattgaaagagttttctaaatgaaatgacttgatttaaaattaaaatagatgcagagatgtatttttccccctcaataaattttctgagtcaggttcttgcctcccataattgaaggcaaccataataacgaatttgattgcatggcttttactcttacttttgaggtaattgccagattggcatccacagtaatttgtatgtgagaggtgatcagatgtgaacatttccattcagtcaactccctggaattcagacacatcactgcttctggttttagaattaggaccagtaattgcagctgtggggtgagctgcgcatctgaaataggctgtgtttcatgtgtgatagtaatgttatcagacttgcttagggaggcagaggtgagcagattcctattcttctccatatcctaaagtagtagtggtaataatagtagtaatagcaagagcagcagcagttgttgttgttgttcttatgaaaatacagcaggaaatgtgcagatgggggtggagttgggggtgcccagcttcaggatgtattaaaacaagcgtggagacagaatgaagactgatgaaagattaagatgaaaatatacaagtttcttacttttacttttaatcctaaattagatactgggttaattttttcttcagtagaagtggaaacacatttttcctctactatgcaaagagaatagtggctattcttcagaggatttaaaaaaatcatgtgaattaaaggttaacaagccatatggctgtggatctacgcttccttctggagctgtcttttaaagggatatgttttccagcttccttactcttataaaaagcactttcattctcctgcttgtttttaattagttaatatgcatttgttgaacttccgctgtgttcacagcattgtaacaagcacttctggtggatactgaagacatgactaagacatttagatcaatcctacatatcttgtagggatttataaagttggttggccagtaacatcttcatgctgcaatcctgttaccattgttttagacatactgtgtttgatatccgtaagagagagaaaactgctgagagttataatctgctttttttcaagttctgacttgcaatttattctgatttcttttagatttggcctagtttctttgaggcttgggcctgaggtccatgctaatttatatgattgatgagctgtctttcattttgtgctgttgacagaaaaggaaaattaacctcaaatctagtcgtgataatgaggccacagcttaactcactcacatgtcctgggggtcagtttctttctctgtctgttgtccagtcatgcgcaggcaggtggcacattagtacctgggcaaagaaactcttcccctggggatttgtccttgaggacaatagactttttttttttcactttcacctaccctttaggggctgtgaacttggtacggagatttaaaagaaaaccctaaatgctttgctgtagagtattcaagatataaacacactaatatttgactggagtcttggtgttaccatgactctttccctttattaagaaaggaaaccatttttaaatggtagaaaaactcaatatccagccatattccagaaggaagagaattcatctgtacatatgaattgcttatgaggtcttgtggttatttcttttcttctttttcttcttctttcactgcttctcttgaatggccctggtttctgtagacctggacgatgtgtgattgggtgacagctccaatctgttaacatctcatggtgtaggatcgtacagaagatgaagattaaatattgttttaatatgccctttccttagctgtcagcagctttagtgattcacaaatagcttgtggtttataaatattaaatcaaggattcattatggggaggcgtcagtgtgactaaccaaaccccaaaccccagggatctagctatcacgatgccatttgtgatgagaaattcagggctgaaaaatagtttctattctccttagacatttaaaaacacatgggaaatattctgttattatcataaagtagtctggaatctacgttaagaagactctgttaataaccttgaatcaacactctcgagcattttatggtgaagaaggcaatataataatacaacatttacctggggcggttagacttttaacaccttattctttgaatttgtagagacaagaaaatgaaacacagtaaaaataactaagcactgagtaaaacagttgttacaaaacccatacattcctagttagtagaagtcttacagaaacacccttagaccttataactagggcccattttgttataattcttctatgaaaacagcaattctggtttgataagtttgattctcaatttttcccttgaaactcttaattcaagtttatatggacaacatattatatgacacatctcaccttgagatgagacaattgagcagcagacagcagaatcactaacaataatgacatcgagatcttggatcccttattgaatgggtgagtaactctgcacatctcaccacccctgaaggcattctcgtactatattgtccaggatagtgacagatttttataaagatgaccccaagacacgaaggagatattaaattatgctcagcctactggggaaatgtattgttcttttttaagagcccgccactgaaatattttttaaaggccttggtgttctaggaagaaagcttcattattgggtaattcacatgtgtgaagcccatatcatctaacagagctggatataagaagcattggaatattttctagatgaaatgtaacactacccctgctttccatatttgcatttattaagtatgtttggtccaaataattactatgtcactgttattttattattactgtgatctcctctttagttttattttcctcttaacatctgtctttccaagacagaggcatgtcaggaaggaatgtagaccatctccacgcctcctggaatatgcctttggctgggaggtcctgaataaaacatttagcacttaccagccagtttaaggatgtgactccagtccccgagaagtccaagtctgtttcagagcctgccttgtcagcctcacgtcagcatggcccagtcacttctctgctcctgtcctgggtgcctgggagaagtctccaatctcagggagcccttgtagccttgtctacttgactccctatcttagtccccacccgggctcttccaagccatttccacactccccaagcccccagccctgagcctgatcctgccactcttagtaaataacatcacctctggtttggaagttctaatctacctgacatgagctgcttcctgctttttattctcccactccaaatttctggagtccttattaccctctcttcccagctcaacagaagagccacccttttccttttccaggctggacgcagcagccctctccagcactccaccaccctgaaccatcagctttcccttctctctggcctgcctggctcgctcctctgctctcctctagggtgcctctcccccattccattgcctgaaccacctgccaagccactgcttccccctgccttgcccctgcactcacctcccactctgccctttctgtgttgccgttgcccctgccgcctctactttatagatgccttccctccgggtcattgtctactcccaggtcccccatccttctgctgttttggagttcatccttcttgcctgccgtctttatttggtgcttctgaccaccttttccttctggaaccctctttccttggagccctttgctattatcataattctcactatccttgcaaaccattctaccttgcaaggtaagcttctaccccgccccacctcaaatatttcaaggaaattgatgccctacagataggctaagatttcattaccattttgcttgtctctgtaggtcccgggggcacccacatctgaattctggtgcctgggcttcttgatccctggcccagtcttttttctaatgcccacattgcttgccaggaacaggtgggcattcatctcagttcatttctcagcttttttcactgtgctttttccatttaccctttcttctgtacccatgactttaactaccatccttattaatacgacttccaaacttatctttagctagatcctcctcctccagtctttatatctgagtttttatcaggtacctgataccacaccaatgccttagaattaacacccacatcaaatcacattcataaagcattttgagattcacaaagtgctcccacattttttagcttatttagtcctcattataatttagagaggacgttattatcagccacctttttaagatgaagcaattgaagctcggaaaagttacaggattgctcagaatgacacatggagaaaaacaagagggttgggtttgtgagctgtaatccctttgctcttttcctgcccaggcagcctggggtctgttcccaggctagttcaaggctgaaattgccattgtccctcctctcgtctccttgataacagtaataaaataacagaaacaaggtgcaagccattagcagcctcagactggtgctggtatgggaacgtcttagctgcagagaccccgtctccatcatcactggacccctgaacacagggtctgttatataggagttcatttaagaagcatctgctggtttggattgaattgtttagtgttgagttcttgtctaatgcacccagacttacagccttacggtcagtcacgttggagtccctccttactgttcttcactaaatgcataagtccgatatatttttcctttttcaatgctgcgggcatttctatgttgctcccactttctgcttcagataccatactctggtcctcatgttgacatgtctcttgtactgtgcctgtagcctcctccgtagtccttaggcttctggcctctggctccatgagtgccagatacatctcctgaaaatacagctctcttcctggactcagactttttcttcgagtgtgtgggaattttagagattgtctggcccagcctccaaggaaagaaaaatgtcaaaacacagtcccagagggccaggctcacccctgcgggtggggagcaccactaccaaccaggggcttcctgacacccagtcccgggctcctgcctctgtgtcattgtgcatcttgtcagtccctccatctgaagtctgcaccaattctccccagccaaaaatgaagtccaggtttctttgtccagcattgaggccctctccatgacccagttctaacatgttgttcgaattatcgctcactaatccctaaatcgatgtcccagccaaagtgccccactcactgttctccagcaagcccactgctctctggcctccttgccttttgtagataatcctctctgtgcagaatcccttcatcatcttcctctcatgccatcctttccaaggaaaatttcctgattatttgtagttgaaaagaaagggactctcccatctctgagagccccatagcactttgcttctttagtccggacttgacttggtctgacttgcattgtatttatttttattctcgtcttatctccctactgattctaaccatctttagatcaagcaagaatttcatttgttcaccattggtatcccttagcatccagcatagtagatctgcttggcttggggctggtaccaatttggtgatgggtagttgaagacatgacagagagacggtgctgtggagggcttgggcccacattttgggagcgttggatttagttcatctccaaaagaactctaggatttgggctccactgagttaaaattaggttaaagttttgaaaacatcatagagatgttgagggggagaaatgctttgcttctgccatttcttgccccacccacagtggttgctcagtggtgagaatccatcagcttttattgcagtcacacccttatggctggttctgtgctttcttgggagaaacgagtgttggtgttccaggaaggtgtattatagttcacaaatactgcggatatgatgaaatgaatagacatcgccagggctgcagacttctcttcacgtatgtaaatgtcatccatttgtctacttatacgacatagatttacatggaaaaaaatatgcctaaccaaagggaaaactcactgatttaaaaatacatatgcactctaaatctgttagctttggtgttaagtgaggtcaatgttaagcagaatatgtgtgaatctgcaataataattaatgcattatgtatgataggttgtattgtccagatttgttttttgcaattggcaaacagaggctcacttgaacttggcttttcctggcgaggtttttgtgctcttctcttctactcctttacttattaatgtgctgcaggaaacttactggacgtgagagtttgcattgttcttacctctgtaatgcgggaagatgaaaggatgtaattggtcttcaccaaaatttattgctcccaggcagtttgataccagcaacttacactgtgtcggtatgttgccaataattcaacattttcactcattttcttcagtcatctcaagaaccaaattaaccagacaagttgtacaatttagttatgaagcaaaccaaaaagcagaccaattaccaatcatttgctgtctaagttctgggaatatagcctagacacaggatgtaagttgaattatgttatttcagcgtcagaccctggagaaatataattttcagaatattatttgtctggggcctagactctaggctacttccctccaggagaaataaaattagagcttcatatgtatttaaaaattttctggtagctgtgttaaaaatagaaatagctgaaactaattttaataatatattctgttcaactcaatatatcaaaagtattatcatttcaacatgtacgcactattttaaaaataattggccaggcacggtggctcacacctggaatcccagcactttgggaggccaaggcaggcagatcatctgaggtcaggagttcgagaccagcctggccaacatggcgaaaccccatctctactaaaaatacaaaacttatccgggcgtggtggcatgcgcctgtagtcccagctactcgggaggctgaggcagggagaattggttaaacccaggaggtggaggttgcagtgagccgagatcgcgtcactgcactccagcctgggctacaggtgagactccatctctaaaaaaataataattttaaaataaataaataaaattaattgatgcgatatcttacctttttgctgttgttttactgactctttggaatctggagtgtattttacacccctcaatttgggttagctacaatacattccaagtgtaccctggtcgcaaatgcatggtggctgccatattggacagcacaggtttagactggttgggatgtgattgtctgagaaggaaaacaggtaaaggaacaattgtatcattacccttaaaaaggggacagcaaacattttcagtaatgggcaaattgtaaatatttaggttttatgggctgtgtggtctctgttgctctgctgtcatagcacaaaagtagccatagacaatggctgtgttccaaaactttatgtacaaaaacagaaggcgggtgaatttgacttgcatgctgtagtttgtctaccctgttcttaactttaaaatacattgctctctcatagaaatcaaaataactttggtttggaattgtttgtatttttaataattgtgtatttagaaaccatcaatacagtaaatgatagcctctgtcatttatttcctctcttataaagtgatgggtgattcttactatgttttaagtgttgtttgttggttggtttagaaaatgaaagtgtttttacatcactattgattaccacttttctctttttttccccttctactcttcatcccttctggctggaataacatgtctggatggtttggctactgtattcctactcatattattctgttacaataggtaagacccttttctttccttttgaattattattctgcctaatgttataatattaatatgtatggttttgcttttaataagtgttcaaggaaatagcatggcatagtttccataaatttattctaaattaaattattttcagctacaaggaaatgtcattggtacagagtataagtggagatagattccagtcaactgtggaatatcctcttaaaatattttataaaacatggtttacactcaatacacaataaaaaaatagatatgtgcaggattttactgtcttatttttttcattctcaaatcggatataagacagacataaacccatacacgcctttatgtttgttaatgtggttatgtttaaacatttttttgagctttttctcacattagaagcgctggcaagagatgtttctttgtgttatagccttgggtagcatgctggtatatagtctgtgaagccaggagagtaactatataatgaattgaccattaggttatgtaatggggatgactatctttatagccttgggtagcatgctggtatatagtctgtgaagccaggagagtaactatataatgaattgaccatttggttatgtaatggggatgactatcttcagatttattttgacaacttgatgcgaaccaatggtagacccgctcatcagggtgtaataggaacatttaatgaaagaagatataatgaagatctttaggtctcttcttgtcatgtaattttattgtgtctgaaaaaaaaattattttaagatttgttctccaccatttaaaacaacaacagcaacatcaccctgaacccctccagggtgaggtctgactggttccactgctcctcccatgggtgacacagtgaccactgatagaatcctccccactcttccccagaaacactttacccctttacctgtccctctgtccctctgtggctgttacacattacgaggaagaaacagtgctctgaaaagagtcccctcagcttttctcttctctctctaaaagaccttctttctcttaattcgctttctctttctttctaatttcatggaaaaaaataatccatctttcagaagctgaactttgcccttgtcactcccgcctccctcctctgacttcctctggtacctatttcatcagttaagtctcgccctgtggcatttgatgttttttcttctccagcagatccctgagcccagagtccagcctgcagacatcacagggcttccttgtgcctgagagggacagagaatatcccctccccttgctcctttgtccttcctttcctcaccacttgtctgaagagatgttatcacctccttttccttccactcctgactccctgcccctgccgcagcctttccactagccatgtcctcccagacaccgaattcagtggcgccttctcaacctcggcctcaggcctctgcagcatcttcctccctctgccctttggcctccttccctgttctcctctggtttgccttctccctttctgacttcaccttacttttgttcttcttgggcttcttcacttgttcccagtccccgaatgcaggtgttcttgaaagccctccttgtgatctttcctcctgtcctcattgactcctgagccacccctaactcttctctctcatctgcactgcagcccacacttccagtgcctgcctgggagtgctttgcatggaatataccccagacacatccatcaccttccttcctcctgttagggccatggtcattcccttggtcttttcctcacctgtcccagctgtcatttgcgaaggcttagatctgcctcagccctgacttttccattcccttctccataaccagtgtggcctttgcagggtcactgccagattccccgctcgccccttcacccgttgctgttagattcatcttcataaagctctcatcccatccctctcctgctccagaaagtgtccttgacttttcatcactacttagattagtgcctgacacatagtaagtactcagtcaatactaattttcctccttctcttcttcctcatcatttgtattctcaaattcttattttgccatttaaaactttctgtgatctagaccaaccttctttttgactttatttcccaccagtggaaatagagtgggaaagacagaactgcaggtagttcctccccagggtggtaaatgggggccataggagatgaggctggcgagggggcactggggacagatcagggaggggggctgtatcaggttttagaacttcatcctgtgggtgccatgaaggatttcaaatagaggtgtgatatgcctgtgtggtcatcaatacagaccactcatcctgctgacacattgtctgtcccctctcctgtgtccctattgaaatcctacctttttatttatttatttatttattttttgagacagagtttcactcttgttgcccaggctggagtgcaatggcatgatcctgggtcactgtaaactccacctgcccattcaagcgattctcctgccccagcctcctgagtagctggatttacaggcatgtgccaccacgcccagctaatttttgtatttttagtagagacagggtttcaccatgttggccaggctggtctcgaactcctgacctaggtgatctgcccgtctcggcctctcaaactgctgggattacaggcatgagccacagtgcctggcctgaaatcctacttttaatcaaaggtggatttggaatgccatcacttttaagaagtcttctgttctctctccagctggtaacaagcattccctcctcagagtctcctcattgccgtgagcatgtccagctttccagcttgtagtacatctccttacgccccagtcatatctccctccccaacctgcagggcccccgcctgacacagcctccagggccatgctccacctagcattgtgtcatgtgctctgcaggtgctctgcaagtgtttgttggaatgtaaatgtgcctagatgtttttgagtagtttcctttttttttttttcgattacacagcagatttattcaggctcactatttttagtgatgttttcattataatatttagcctcggtaatatttgatcaatgtcaataacatctgtttaactaaaggaaataaaactttgctgggtcaatgagaggtctaccaagtttgaatcgtttctccccaggcaaggaggatactctgcctggttccttcctgttcacctgttctttctcatgcctttccatatcaggctattgtctgaacaactttggacccataacttcttctgggcatggcagcataccaggatggatctagtaaccttcatttgacttttgagggaggataagaaagtaattagttttagttatttgtttcattttgctgcactttgctaattccttctgtgtgtgacacacacacacacatacacacatacatgctgtaaaacatgatttgtaggctgggtgtggtggctcatgcctgcaatcccagcactttgggaggctgaggcgggccgatcacttgaggtcaagagttcgagaccagcctggccaacatggcaaaaacccatctctactaaaaatacaaaaattttctgggcatggtggtgcaggcctgtaatcccaggtacttgggaggctgacgtaggagaatcacttgaatctgggaggcggaggttgcaatgagccacgatcgcgtcactgcactccagcctgggcgacagagtgagacctctgtctcaaaaaacacaaacaaaaccatgatttgtagaccctagcaatgaaatgccagcttgtgagctttttttacttttatttctgttttttgagacggagtctcgctctgtcgcccaagctggagtgcagtggcgcgatctcggctcgctgaaagctctgcctcgcaggttcacgccattctcctgcctcagcctcccgagtagctgggactacaggcacccgccacgacgcctggctaattttttgtatatttgagtagagacggggtttcaccgtgttagcaaggatggtcttgatcttctgacctcgtgatccgcccgcctcggcctcccaaagtgctgggattacaggcgtgagccactgcgcccggcccttcgcttttatttctaaggcatggaaggatggcagatatttgagcgaaaacatccccagttttagtgtattcgttaaacacatacgaaataaagatacaagtgtttacaagcgaggaagatgacaattggtttatgctataaacattctcccaggacaaacttgctgggtttgtttcccctgtcagtaagaaaaccagcactggtggactccctccaccgtcatggccttcctgagaagagagagaggatggccgttttcaggggatggatgagtcacggctgggcggtgagaacttctcagcgggtcacagtcaggcttcggcagctcggcaggtgagggagcacccactaagagagtaatcgtggtaaaggaaggaaatgcactcagacatcttggcgccctgggagaggcaattcccttcccactttactccctaaaacagccctctgggaaccacattcgcgagcttgccgtgggatcacgcacgccgtgactacaaaatgtaaagcaatagaacacacagaacacactggagcattaatctgaggttcttaaatgccattatgcattatttatacttcctgatacgataatatatcgcaaatgaatttacatgagagagataatatttctgcttttcccctgatgatggattcagaatggataaattcctttattttatttcaacctgtcttctaaaataggccagcatgttatagaaataggcttttctctttgaggtgagtgaagtggctcaactcaaggaaatttttctttggataaaagagttttttttttttcttaaattggctttctaactgtgttacattatctgctgatcagctttggaaatgttagaaattttgtcatttaaagctctgaggtgagatgaatagagccacaaagctataggtaaatgatgagaaaaagatgaattgtggtatgtttctaaagacttactctgttccctttaacagcatttggggaaaataacatgggagagacagcacagtttgataattatttgtcacaggagtgcccattagcctacactaatttgattgctgtgaaaaaaacagattaaaatactctgtagaaggcagagtcataacattattgagtgtccagtaggtttcttacttatttaattccctggatccagtctcagaagttggcattaatatcaccttgtttcacagtgaaacaaacggaaaagcagagaggtcaggcaactgacttaaaagcacagagctcgtaagagaggagggtgggctttgaacacaggcagtccaatgtcagagcttgaactcttaactataattctataattaccgcctccccatcccaaaacagcactggcctaaggcacacagaatccataacttcccctttatgtttacagacaactctcagttaccttaaattgaaacattacttttacagccatagataaataggagttgactcttttcaacaggagggccaaaggtacctggcatggaagatatcctgtccacaaccataaatgttttgatgttagcaacattgcagatgatagacaggtgaaagatagatgaatgaatggatgaataaacacaacgatagctagatggatagcgagatggatgaacagacagaaagacagatgaacaggaagaaagaaaggaagatagaaagatggacagaaagataaatggatgaaagaaagatgatagaataatagatgaaagagaaagaagaaagaaaagagagagagagagaaagaaaaagaaagaaagaaaggacatagatggacagacagaagaaagaaaggaaggaaggaagggaaaggaagaaaggaagaaaggaagaaagatgatagatagatagatggttagatcaatggataaacagctaaataaatggcagttcatagatgtggaaatacactggctgttaaagttcatgctttaagctttgtatgtgttaggctttcatgtaaacaacatttgctgatgggaacagcaacgtaggcactcaggagatttgtggcttgatactactggtatttttactggaatgcatgtgtacccgtaaggctggtaatacaggagctaacttttttattgtgccacatttttttctgaataataacagatgagcaaagtaaatcctattttcccattagattccaatatttatttaactaagtatttattgacttgaggaaattctcatcctccatgtaataaaatcatgatgaaaagtaatatcacacttaaaataaaaataaaataaaatcacacttaaaatattttaaaaataacttgattataagcaatactgtaaaaatatttgaaatattaataaagtcttaggctcaacccaacaaataacagaaaataaagcctctacttcccaggccataccgggttggaggcaaaaattaagttgtacgtatagtctcagaacaatttccctgtcccacctgctctggggtaacagggttctgcactgttcctggtgtccctgaagtcaacatcatgtcttcttgatcttaatcctctgttttggtctattctcacgctgctataaggacatagccaagactgggtaatttagaaaggaaagaggtttaattggctcacagttccccagggctggggaggcctcaggaagcttactatcatggtggaagggaagcaaacaggtccttcttcacatggtggcagcaaggagaagtgcaggggaactcccctttacaaaaccatcagatcttgtgagacgtattcactatcatgaaaacagcacaggaaagacctgcccccatgattaaattaccccccactgagtccctcccacaacacttggggaattatggtagctacaattgaagatgagatttgagtggggacatagtgaaaccatatcatcctcacatattctggtcctgatggctgctgtcttccaaggctccagcttgctgcagtaacacctctgcttgcaatgaatctctctgggcttcaggttccatgtctggaaatgggcatcagaacagtgatggtgactgctgctgagacttaaataatcagacactctgacattgctgtcctgttttttcctgagaaaaggagacaaaacttagagctttaaaatattgaggagggaaatagactatttggattggcattgctatctgttccaagaatgttgtttttgacagaaacgttgaaaacttttaaaacaatgttaaaacaatgggtatttaggtggttagcaagttatttttaactctttacaatattccagaaatggttttgtgcatcacttgctatattaggtttgccttctagtaacacctctagtccaccgtagaattcgtgcacacttgcagagatcaccagaagataaactgctacctgtggttgaattactgaagagcaaggacttcccttgtggacacggatgtcagctcacattttgttggtagctttactacccatcctgatgatccatccatcttgcgaggcctacagtttctctgattcccttggttctccctgcttttgcaaaatgagtaaaggactgtgctttggactttaatttttctcatctgtaaggcatccatggtctagtgttaaggagtatggactttgggttatcctgcctgcccccagccctggctttgacacataccagctcagtgatctcagacaaggtgcttctctaagcttcaggtgtccccatggagaatcaaatgagataatgtaaagcttctatcacttaggtatgtctgagggaaagggatagtagtttactagcttagtaccaactccagctgcttggtactctgcttggtttacaatccttcagtattccttgaaggggtgtttcttggggtgctcttgtgagctgagtattgttctacgggctaagggtgcagtgatgaaccagacccctacagttcctgccctgggattagagtcagcttagaccttttgtgaacagatctcactgtcagacctgcttttgagctcaagattctgtgatctgggtgtgacagcttcatgggtacagggttttcttttggagtgatgcaaatgtcttggaacttgatagaggtggtgatggcactactaaatggcactgaatgcactaaatggcactgaactgtacactttaaaatggctagttttatgttatgtgaatttcacttcaatgaaaaaaaaatgattctatgatcaactccctggccttcactccaagctgtgattcatcccgggcctgattcatcctgatcttaggtaatttcttctctgaaattttatttccctttatttagaaatgcctttgaaactcatggatcaaggccagaaattagcctatgtaatgtgtcatcagctatcttgcagagtgttttgcacatgtaatgagttaataataattaactatatctcccaggaatgcctgctttctacttctgcttccattatttgagccagggtgatgattcttttcccagatactctttggagggctcccagggaagggaacagaagagctgaaagtgctgaaggtgaacttagtttcagcttgagtttcctagggctgccctgccacaaaaagtgtaggtctttgcgttaaaactctgctaaaggcagaacagaaaaatagcaggggctctaacagaaggccccccaaccttgtgccaatgttctcctttctctacactcccctgagctagaacagttacaatcatttcccataaaactaaacagctgtgtgtctgtcctattgacaaagcgtgcttgagggccattcaggtggcatggctgaagcaggtgtgagagaaagcttgattgagttagttgtcttaaagggacacaagtccaccattctaatgggaaatccatttgattcaggcatttggcatgagtctgaatgcctgaaaaagaatgccttggagaaagtctgaaacagacatttgtctcctcgtggctggtatggctgtctcagattcagtcaattctgtggggcttttctattccattttttgctctgtggtgagaacgcatggtgtggggtggggggcagaaacagagggtgggggggaatgagtgacagaaagagaattaatgactgaggaaaaaaagagtttatattcggctggatatgatttatgctaatagaatcaaaacagtacataggagaatgttgtccatacttaatggtagtaaataaatcagttagaaataaggcatttaagtgcttatgcaatgtagaccagaaagactgaaaaactactggctcaggcgctgactcaaatatttaacttctagttttttgtctcaatagcaccagataatttattataggaggtttgagaaattccactctttccccttattttcttcaaaaagtataatgaactttgtggaatatcagttggttgtagatatgtggctttatttctgggttctctgttctgttacatttatctgtgtgtctatttttataccagtaccatgctgttttggttactatagccttgtagtgtagtttggagttaggtagtatgatgcctacagaaaaaaaaatacacaaaattcaaaacccagtacaaaatttaatgtaaaaaaatgtagttcgatattcacttaaatcacccagatgctgttttgcctcctagtgcaggattttttaaacttgggttaatgagcatccagggcagtcactttcatattctttaactccaatcaatggtaataaatatattttatatcattatctagaatacacaagcaaatcatacagttaaatattcttgtgatatattcagatattaaaaataatttctgagacaaaattttcacaaaatattactaacccatcttatacgcatgctgtagtttatattgttcaatttggttcttctttattctatcattttctatcttgtcctccaatttcatgtcacaatgtacagcatacaacacactgctatagggaacccatggactagctttggggtccttttgaacccctgaaccaatgtgctaaatttctactaggtcatgtgcatttttccaggaagagcatttgtggtacttgtcaaatatttcaaaggtagcttcagtgacccagaaaagctgaagaactgctactatagagggtcttttgataagttacaggttattttgataagtttgtaatgcacttaagttccaatttaagatgatattaatgcaaatagtgacttaaattctttccccttttggtgggagagtttcttttttcccccaacatgactttttaagcaacaccatcactctatgtgaaatgaggtgttgggttagattattcttaagtctctcttaattctaactttacccaaatactttattagtatcaaaaagtaatacatatttattgtagaaaatttacaaacacagataaacaaaataggaaaataaaaattgcccattaaactaccacctaaaaaaaataagattaacattttggtgtctatccttcacgtcttttgtttatgtacaaacatatatactttataaactatatttttcatattgtagtataaactattttgtaacattttgctcactatagcatcatttctctgtgtcatcatatattttctactgtattatttttaatgcctgaagatacctataaaatatttaattgtataatttaaccaatagctaacactgagcagtagtttgcttcagtttttctctcataagcaacattacaatgaccatcctttcagctttttacattaatttgattttcatagtctaaattaattcatataaatggaatagctgggcctaaagttgtaaatgtttttgagactttgatacctgttacagtttgcccacctaaaaggtgtgcttagcgtaagttctaggtaccgcactggtcttccagatgcaatgctcctgtggccgcatgaactctgagtactgtgtagcatccaggtgcaactttaggcaagagagtcttttaagtttcccttcatagggaagtgttcaataacatgaggatttcatttggaactgaatctgtgtgggtagtaagttgtttacctgacagtaatcgaatccaatccttagctgaattggatgtgctggtgatacctacctaagggaattgctgcaagtcgagtcaataaagcaatttcaaatgggagaaaacttgaacttcctttttaataataaatagacaaaggacttttcttttgaaacattgttaattacaatggagtttgaagaacccttgagctgtgagaagcagatttggtatttctcagaaatcatcttttatgaaatgtgacttgaatttctattttctgcctaatctgaacagaagcctagcagcagtccctccccacccccgcacctccacccctctagagaagtgggtttcacatgggactcaaggtaaatggggaaaccatgagtacataagctgggaaatgccatagtatgtcactaaaaggaaatttagttagcatgatttggcttggcttgatgatggaagtagtttcttacctcacaataactgaagcaacattttacctttctccaagtgtaaaaaaaattttgtgaagtttagattttctgttgtttattagtatttttatttttaagttccagggtacatgtgcaggatgtgcaggtttattacataggtaaacgtgtgccatggtggtttgctgcacctatcaactcatcgcctaggtattaagcccagcatgcactagctatttgtcctgatgctctccctccccttaccacccaccccccgacagggcccggtgtgtattgctcccctccctgtgtccatactctttggagggctcccagggaaggcaacagaagagctgaaagtgctgaaggtgaacttagcttcagttgcatttcctagggctcccctgccacaaagagtgtaggtctttgcgttaaaactcttctaaaggcagaacagaaaaattgcagaggctctaacagaaggctccccccaacttgtgcctatgtcctcttttctctacactgctcccacttgttcagctctcacttatgagtgagaacatgcggtgtttggttttctgttcctgcattagtttgctgaggataatggcttccagctccattcatgttcctgcaaaggacatgatctcattccttttttatggctgcatagtattccatggtgtatatgtaccacattttctttatccagtttatcactgatgggcatttgggttgattccatgtctttgctattgtgaatagtgctgcaatgaacatacacgtgtatgcatatttgtcatggaatgatttatattcctttgggtatataaccagtaatgggattgctgggccaagtgatatttcggcttctagatctttgaagaatcaccacactgtcttccacaatggatgaagtaatttacatttccaccaacagtttaaaagcattcctatttctctgcaagcttgccagcatctgttgtttcttgactttttagtaatctccattctgactggtatgaggatggtaaagaaaattttgtgaagtttggggttatagaaaaaaattttctaaacttttcccagtacgaataataatgctaatgatccagatgcctctggtctgtccctgcttataacttaagtgagggtcacactgacagtaatgatattacttactcttgcccatccgcataccacgatcttagctgcagaaaaattcccctcagtccctggaagtccctgggggcttgtgaatgtccctatgttactgagagccccttatcaaaaaagacctctttggttttcccatgtccgccttctcttctcaggtcccaggcctaagccataggtctaggcaggggtggacttgggccgtctctgccatgctgtgttcagaatcactgtttgtctccaactctgggtcaggttggtggcccagctctctgtcaccttaggatagattcagttgctggaaggaccccaagtatctcatgtccaaagatatttgacagatcccccaaccccaagtccaccaaatatgctcatagatgttggaatccagattcaggctaccagccgagtgagttaactgaggaaataggcacgtttttggtgagagactgaggcccagagaattgaaatgacccaaccaactagtaagtgaagattgctctgatcctaatgttccatgttctttttaaaattcctgtacttaattggagtccggtgtcagccagtatagtgccagggctggtgtgtttaccaacttataataaaagtcccaccctcagcattttaaagccttacctgaggcattagccaccctctttagaacctggtcctcccctcgaggaaggatatttttccaatggaatcctctgggtgcaattgaatttcattgggtagtccctgaaattctaattgcagataatggctacacctcagaaattacttatagccttaaaagtttactggagaattctctccttattccccgatacagaactaaagagaggcctgagagaggctgttttcactgtgaagactttaacctcctcggctttttgggggccaaattgatccagtctccaagtctttttagacaattgctaatagctgcatgtttttgatggaaagtcagaagtcatttttttttctttttcccttatctacaatgttgcttgaaaggcatttggggccctctccgtgactgcgatgattaattcagagtctgagggagcaagagagccactcaaaggggaagcatagcatttatagagaggattgaagccctttaaaggcaggatatgggaaggttttgagacaaagttataccttaaagtgacccctgtgtcattggccatcttagggcgacctggctggagaatggcaggcccctcacaactttgtcacaggctgctgtttgctgaagacatgatacagcccacaggaacacgtttaaagattgctggcgcatgaagcacattctttatgttttgaaatgttttactatacttccttgacttgccttatttccataaattttgctttctctgaggaaaatttgaacacctttcacttttcaaatttcagtttttatgaggttgacattttccttagtgtattgttggctataaattattaagatatatttaataaggctctgcctcctaggccccaaacaccctataaaatggatggaaaataaatgatttaagaagattctagctgatctacagagcccgttacaaaaataatgaagctcagaggaatgcaaaagtagaaaatggtcaacgttttaaacttggtatttgcacccaaaccctgagttatgctttacagaaatttttagtcgtagaattctctagtaacctaaaagtcatatccaggaagataaaaagattaagattgtatggtaatatttgcacagaaacatattcctttttcccttaacatattcctgctgttctcaacccactccttgctattttagctaggtagcctttctggtgtggacctactccaagatggcccctgtgatccccacctcctggtcttcatgcccttgtctaatcttcttcccttgaagtgagacctgtgatttgtttctaatcaatgtaacgcagcaaaggtgatgagatatcacttctgtgattatattacataagactgtaatgtttgatatggaggttcctcaaaaaaactaaaaatagaactaccacgtgactcagcaatcccactgctggctatatacacaaaagaaaggacatcagtatatgaaagaggtacttgcacttctatgtttaatatagcactattcacaatagtcaagatatggaatgaaactaaatgtccatcagtggatgaatggataaagaaaatgtgatatatatatatatatatatatatatatatatatatatatatatataaaatatatatattatatatacacacacccaatgaaatactattcatctagaaaaaagaaggaaatcctgtcatttgcagcaacatggatggaaccggaggtctttatgttaagtgaaataagccaggcacagaaagacaaatatcacatgttctcactaaaaagtggatctcatggaggtagagagtagaatgctggttaccagtagaatggtagagactgggaagggagaaagggaaatgaagagaaattgattaatggttgcaaaactatagttaaatagtaaggatgaattcttgtattcgataatacggtaaggaaattatggttaacaatatgtatttcaaaatagctataagagatgaattgtaatgttcccaacacaaagaaaagataaatgtttgaatgatgtatctaccagttaccttgatttgatcattacacattgtattcagccatcacatgtacccctaacataggtacaactattatatatcaattttaaaagactgtcatgtttatcttgctgacaaactctcttcctttctggtcatgttgggaaagcccatgtggtaaggaactgggggaggcatccagctgacagccctcgttccagcagcccacaaggaaatgaatgctgctaacaagcacatgagcttgaaagccaacccttccctagatgagcctcagatgagactacagccctggccaacaccttaatggcagtttgcgagaccctgaaactgaagacccagctaagctgtgtttggattactgacccacagtaactataatacatttgttttgtttttttttaagccactaagttgattgtaatattgttgcacagcgatagataactaatatattttggtacagatgtatcccctgagacttacattcatagaatcgtttaatcatccaattattaaaaattccttgagcatccactacaatgccaggcttggtgttaggtgccagagaaacaaagaatacgtatgtcatagcctcttgaaactacattagtaatgattgttgtttaagatgctggagatgtagtggcaggagtagtccaagtatcttacaggagcaaagaggcaggggacctaacccttcaggtggtgaaagatgaagagtaatgtcaggaatgacttcctagcagcagagacacttgagctatgccaacagtgacgaggagataaccaggtgaggtgtgagaggatgcagaagtgaggagcgcccagacagagaggggacaacattggcaaaggcattgaggttctgggaactgccagcaatgaagtgagatagtgagggatgacatactgtacataagagatgggaagggtgagataatgaaggatctagtatacactgttaaggaacttgggcttatcctataggcaaaggggaccatggaagaatttaaagaaaaggatgaggacatatttgtactttagagggacaactatggcttcttggaactctgaatttggaatccagctagttctgctattttgccatagcccactaatgagctaacagatgtctaaattaggactacactagaatggaggagaaggacaagtttaaaaaatacatatgagaggaaatctagtaatttgttagtgattatgctttttggagtgagaggcagaaagaagtcatagataacccctagtttcctagcatgagtaactgggcagatcttacaaattaaatagaaaatacaaaataacaggtttaccatggaggaagatgaatcaactcagttatgaacatgttggatttgagtgcatgtagctcatccaaggtgaagattgctgttcagcagaccgcaagacttcttatcttttgccccactttatggcctggcagtacagaagctatggaaggatatgtagatttccttgattggagctatgggggaagagttgtcctcagagaagagcctggttgtcattaagacatggatgtggggtgggtttggtggctcacacctgtaattccagcactttgggaggccgaggtgggcgtattatgaggccacgagttcgagaccagcctggccaacatggcaaaaccccatctctactaaaaatacaaaaaattagcagggtgtggtgatgggtgcctgtaatcccagctactcaggagactgacgcaggagaatcacttgaatctgggaggtggaggttgcagtgagccgagatctcaccattgcactccagccctggcaacagtgcaagactccatctcaaaaaaagaaaagaaaaaagaaaagacatggatgtggagagattgttctataaaatataaaggagaagggtggtatgttttcaatgagaaggaatgtcagggagcccgatagaaaaggttatgagaggaagattgatagtggaaggcacaggtaagcattaggaaatgcaggggttttgattgagatgaatgttcttcctttgcacagaagctatgccatgaagcactgacttctccctgcatgcctgtatttatagactctttatattaaggcatacaggcccagcttattgagtaggataatttgaaatttgctactttcttcaatttagagttcgactttctttcattatgtcattgttttgaacagatggtgcagaactgcttcttcttgacctttaaaaaaactattaagagtagagtcagtcgcttgtccatttctgcttcttcatgcctctcataatgattccaccagcttaactgcaactgctttcatagccggctcagcctgggcatgcaccatggcctttttcctgaagccactgggagcacgttatattctcctgacagacacactttcatctgggggaagccattattcattcctacagggtcacctaaattggaaacataactatgatgaactgaaatcttttatatctgttattggctatttttttctagtctgaagccttggttctccatgtatttcattaatacatttgtgctctggacaaacagcttgaaaaagtaactaggagaatggctggacggcactaaagaagtgagagaacagagttctaggcttctcccccacttgcctatgacaaggtgattgatacattctgctatcctgggcaagccatttaacctttatgggcctcggttgctttcttagtaaaatagtataaattaaactttaccaagcttaagatagtgagctcaaccaaaatctctttaaatcttttaaggatctaacacccttccaaagccaagcccatgggacagtgttactattatctactgctgtgtaacaaacaaccgtgagatttagtggcttaaaacagctgccttcttttcctcctgttgttgtgaatcaggagttcaggaaggatttaattggaaattttgtgcctgatcctcttggcagtcatgttgatgattggggctggaggatccacttccaagacggtttcttcacttgcacatctgatacctccatgctctttggcatctccttccttgtgctggctcatcctcccaggcctttctatgtagctcaagattctcacagcctgggggtcgcaggtggacacttcttacatggcagctggtttccaagagtcaggaagaagccacaggtctcttaagggcttcacatataaccagcaccgcatcacttcagccatattccatcggtccaggcagtcacagggcccgcctcttgatggcaacaccacattgcacaagagcatgtgagattgggacattgtggccacctttggaaagtatgacttgtcatagccagtgattccctcccaatgaatggagaaaaagcttgattttaggggtcatgtatgtaaagcacttggcacaacagcaagtgtttaataaataatacctcttactagtccagtggaaacaaaagacaaacaggaatgagagccaggacatatctcccttatacagggaagagggtgttttgcttaagagacagaatggatgaataagaacataatacagaagattgaatactgggtgtgagattctcaaaatagactggctgaaataaaagagttgaatgtttttaagattaaattattcctgactttataatatttgtctctaggttttgtagatcttggttgcttcacttaaaaagacaattcagaaacattttcagacaagatttttaatatgtgatgcttgtcctttctgcttttgcgacatcatggtttatgataccatagtgggtgattccagggcataattgagattgctgctgcctgttttttggcagtgattttttgcccattttatgaactaaatttgggtatttacattcattaggatacagtgtagccatcttcacttaaaagtcctaattcaggacataacttggaccctttaatcaacacctctccatttcctacctcatttagaaggtacgtgtacatttcttttaaatattttatgtctttggtgatgtgcgaggttcagcttatgaagaattctagctttgaagttggtttagaaagattgccccttctatgaatgcataaaaatagtttaaattatttatagttctagaaaggctgtgttattttatgtgggacacaaattatgggagattcggaaggtttcccattgcttcctgtccaaaactgaatctcaattttttggttgcagattttatttttaaaatttttatatttaaacttttatatttggaaagagaatgcatttatatcttttgcatttcatttccttggtgtgccccaatgttttccctggatatgcagttttagttcttgtcactagtcactctgaattttttctagaaccatggaagggtttacaagatagcgatcaagatgttgaaagtaaatggaagaatacataaagaatggtggttaagaacacttgacgtaagatctgctctcttagcagagtttaagtatataataccattttgttagctagaggccctatgctctgtaacgaatctccagaacttatgtatctggcataacttggaccctttaatcaacacctctccatttcctcctccctacaacccctagccactaccattctactctcagcttctatgagtttgcctattttattaacaggttccacatttaaatgagatcatatacagaattgtctttctgtctctggcttatttcacttagcataatatcctctatattgttgcaatgggaaggtttcctcatttttaagcctgaataatattccattctatgtttaaaaaaaaaatggttaatttactgaccagcctcctttgtaggaacatatgtacttaactggaggttccttataactttagagtctaagtaatattttaattgaacaatttcttgcaatacctgcctcccagacctgtgttttataagtaatctcaaaagtaggtgaattatggaagtggtataccaaataaaaacgaagctcttaaatagttaagaggagcttctttgtggtttattgccacttgcaatgggaatgacagtcacagaagagggaaaggaatactggaacagaagccatctccttctgctttgaaatctcccatgtcctgttccccattgggccagcttggttggctcgcacatgggacaaatacgtggaactcacatcctgtcccccgtatgtgtaaaacaaatgaaatgcaacaaagatcatttattcactttctgcttctaatcgtgcagcttgtcctgagcttgaattggcccatgacaattagtattgatcatgacagtaacagaaaagaaatgattggtgtgctgtagtctgatttgaccataatattaggagactggaacctggggttccatatttgactgtgtgtatttacaaccccctgattttccttggattaattaacttgacaaaagtagatagtccatctcgatggttcattttctgaggacctagtctgttgctgtcacatccagaaaatgtgcaacctggcatgagtcttaggagaagtaccctaccttgcagctgtcatctgcctggaaggtgggggaccatgtgagcacaatgcatgcacgtagaaactgattggttttctattgtggtaaaatacatgtaacataaaatttaccactagcgatgtttagtaaattgacaacctcatgcaaccatcacttctatgtagttccagaacattttcatcactacagaaggaaaccttgtacccattaagtggtcactgtccattcttcctttctcccagtatctggcaccactgagtggtgttctgtctccatggatttgcctattctggacatttcatacaaatggaatcaggcaatctgtgaccttttgttgtctggcttttttcagcgagcataatgttttcagcacgactaatttttactgaatgcccgtgatgttctgggcgctggatctacagagaaaaacaaaaccaacgtgttatctgccctcatgaatctcatgtcatagtggtagaatcaggccaaaaaccaagtaaaggaactaataagatgactttaaaccatgctaagtgccaacagacatcaaagagtgtgccaagcagtaaaatatgagagtgaagaaggggtttgctacttcacagaggggtcagggacgacctctccaaggagatgacatctatgtaaaaaatttaaagtttaggccaggtgcggtggctcatgcctgtaatctcagcactttgggaagccgaggcaggaggattgcttgagcctaagagttcgagaccagtctgggcaacatattgagactttaccaaaaaaaattaaaaattagctggatgtggtggtgtgtgcctttattcctaactacttgggaggctgaagtgggaggtccacttgagcccaggagtttgaggctgcagtgagccatgatcataccactgcactccagcctgggcaacagagtgagattccatctcacaaaaaaggaaggaaaccaggtctgtgaagaatgggaggaaggaatgttccaatagaaggaataacatttgcaaaggccccaatgtcataaagaatcttgcagcctccgaaagaaggccaggtttctgaagcagccggagggaccagagtggcagggaaggctctgggttttactctgaaggtaaaggaatatcagtgaaagattttaagcagaggaggattatgagtaaactcacctggtgctgtgtggaacactcaatggctgttccagtggtttgcagagggcagatagcactttcctgagattcatagccatatggggtacacagctgggtgtggcctgccgttaatgccgagatagccttcctccctttctgatttagactctgctctctgccactgcctagcctggcctggcagtcattgacaagccttatgctcagaagtctccatgaccagaagtctccactgacattccacccactagcacaggctgtctctgagcctcattctgcctcctctgcagaccacttagcatccagtgttactcatctagaggggttctgctgagttcttcagatgaactgcttcatttcaagatgcccagttctcatggcactgaggaggcacaccgtgggcccatataattgacattacttggatggggttcagacattctgctcagttcctggaaccactcacttctgatggacccataagcccttccaacacactcaaaccttgtctatgctaagaacatatgatactttggtccataagaacatatgatactttggtccattataaccctgttagaccatagcccttgtagaaacaatacaaaatttgacttagtttaagtgaatgtttaaataatcttttagagcaccagaatatgcccatcatcagcattagcttgaaatcagtccacagaaaggagaatctgtattctgtgtgactagtatctcatttgtccctttgtaaagagataatgcagtttctttgccaaatgtagtcatatttcttgctttaaaatatggaagactctctgattatgtcattccatatctatatggacaggttttacaactattgaaacagttctaatcaactgtaggaattgaaattattttctatgggaagtctgacttccttccattcagtggcctgcctgatattgaatgattgacattctgatggagtggggagatgtggaaattgcagtcccacttctcattgctctcttttcttcctcactgtgacgagtgtttttaacccgttaatatcccttgaaatgggtcatgagactgtgtgttaggaaaaccagtttctcagtgcctccaggcaggagtaacatgactagtaaaattatgactgcttaatctttcaagaggacatacttggggtaaaagaatacatctaaaccaatgttaagttttaagttagatggcaaaaatgaatactacagtcaaacataaaggagttctagacttaaaattataccaatataccttttcttcttgaaattatttttccttaaactatattttttttattatttattaaatgtttattgcatgttagattctgttttaaaaatttaaatacatcatctcatttaattctccagtagtcctttgcagttcgtatcattactgtccccattttttaggtcagcagactgtggcttacacactaatgccagatatattttaacccactcttaaactccgaatttcaagtcagcaaattctcatggatcacccagtgctaggtgccatggcaaatttaaaatgtaaatgacataattttcttctgaggcacttttaaaaacttaaaggtgttaatttttttttctggagaatcaacaaaatataacgtttaatatagatcaagatggtttcatatagaatatttataggtatgtgtatatacacaggttagtatacatacatatatttctttccagctgagagggcttacaagaaatgatactctagtagcaacaagcacatctagcacccatatcttggtttctgatgctaggactggtggggggcaggaagtatataagatgagcctggagcatcttgtagtgcctgaaataaggaagtgctacaaaagaaaaacaaaaatccacaatgggtggagtctgttaaagggacacagaagccaaatgaaacaatccccaatgtccaaagctaaaacaatttagcaccaaaagaaataaaagtattggattataacctaaagtgcaaaataaatatccatgaatccataccaatacaaataaatgactgaataaattaatttattcaggagaagagacaaatttcacatgcaaaagaattttaaataaattatgtagatactccatcctagaagggggagaacatagccccctccttaagtggggctttgcatagtgatttccttcctgcagcatagaaaggggagaaaaaagagtaacttcacaggggagaaacctggtaaatagtacccaagccatgtgaccaagggcaatttcagtagttgcaaaccgttgatagtatgtagacttgagatgatgcaatgaaaatggcactttacatgtgtgctcttcctacccatgccataatcccagtctaattgtgagaaagacaccagacatagccaatagcaggaagttctgtaatatgccttgccagtactcctcaaatctgtcaaggttatcagaagcaagcaaagtctgagaaattgacacagaaattgacatgtgaggaacttaaggagatgtaacaacaaattataatatgataccctggatagggtcctggaacagaagaagggtggtagtgaataaaaggaaatttgaataatctgcatcaatattggttcattaattacaacaaatataccatgctaatataagatgctaataatggagaaacgttgcgagttgatgaagtgtatgtgaacacaattttccctacaattttttaaaacaatctaaaactgttttaaaaactgaagtttattaatgaaagaagtgtgcgtgtgaacattttactgtgattcatgagacagggtcactggcttggttcttgcccattcattttcataattcatctgtctaatttatcctgtgagtgtaggatgaacatatgaatttattaaagtggagattgagagataagtaatttttgtaaaaggaagtcgtataaagatcccttgaacccatccaactttagaatatggacagttcagtgagaaaaaaaaaatctgtaggcaagaaatgattctctaattttaatctcgtaaatgtccacataaaggtattaagattgtttatgtacagaaatatatttatttttgtaatagttgtattaatagattttaaattagcatttggtcttttctattttgcttcactaattacgtaaggctttgactattaaattaggttaatttatctctattgcatccatccaggattgggtagaaaaggtaaaaaggccaagtgttttcctaggatcactcaggatcaaaaccaggcttcaggcctctcaattcctggtttctgtgctttgcctaccataaagatattggttgaccttcaaatcgcatactcctttaatcatcttttctcttatgactctaattttcattttcccttgtgattttacaaggcagattttattatgaatgtactttgaagtgagaaatgtgaagcccttttcccgtctctttccctctaaaaagaattagattggccaggtgcagtggctcatgcctgtaatcccagcactttgggaggccgaggcgggtggatcacgaggtcaggagatcgagaccatcctggctaacacggtgaaaccccatctctactaaaaatacgaaaaagaaattagccaggcatggtggcgggcgcctgtagtcccagttgctccggaggctgaggcaggagaatggtgtgaacccaggaggcgaagcttgcagtgagccgagatcccgccactgcactccggcctgggtgacagagcgagaacccctctcaaaaaaaaaaaaaaaaaaaaaattagattgccagaacacaatggcatcttcacatttcttgtgatagtgcttaacatagtttgttgttacatctgattgctggtttctttccaccacactacaggagaggctgtgtttcctccttagcgtaagagtttggcatatagtaggtggtcaataaagggaatttcaataaatagcaaagagtgattcagcagaattgccaaatactgtaagttatttgtaacaaagacactttttccttcagccttttactatccggttttccagactcatgtgctttactggaagcccaaggtttcactgggggaatgtgagtgtcctagaagggaagaaagtgtggcaagactggaaaaccacataagcagacacggatatgacctcacaattagaaaaccatggcaccaattaaagagtctgtatacctttgcctctttgacaaattgtctttttgaattggctttgtgattcatgggctcaaatttgaaacattagtgtttaattcaatgaatggaaaatacttttcatttgactcacgaatattgtcaccatcgttatgtcacctggcatttgagattgtgatgcaactagctcactagttctaccacctgtaacgaatactgcaattagctgctttctctttcctagcctcagtgggttcataatccctttagttatcatctaaagccaaattgcattttgcaaaacatgtactccctgataaattacaaatgattccattacaaaggctcctgtagtcaaataagtttgagaaatgtcgtgttaacaaagttaaagggctgtctctattgggagacttctgagagtcctgaccctgttaatgcatgcagaaccctccaagtatggcattcatataacaagttttttttttttttttttttttgagacggagtctcgctctgtcacccaggctgaagtgcagtggcgcaatctcggctcactgcaagctctgcctcctgggttcacgccattctcctgcctcagcctcccgagtagctgggactacgggcacccgccaccatgcctggctaattttttcatattttcagtagagacggggtttcaccgtgttagccaggatggtcccgatctcctgacctcgtgatccacccgccttggcctcccaaagtgctgggattacaagcatgagccactgtgccgggcctcatataccaagtttttaagacttgcctgaacatgggcttgttgataagtacaacaagaggttaagaactctagctgtagagtcatgttcatctggattgtagagccttagggaagccctgtgattaagcatcggtttcctcggcttttgggtgggtatactaataacagatgaccataaggttcttatgaaaattaaatgaaataattttgtataaaacacttggcacagtgcatggcacctgggatgtccttagtaaatggtagctaatggtgatattaatgtcttggagaatattagagttctgcaaaatacagttttggaaacgctgatctgtaatcatataggttgttcatttcatccagttttacagataaggccaatataaattcctgtgattaattccacggtctaatccttgctctatctctagtgcaaatgccagatcttcagtcttacagaacatattgtgatgtaaacattctaccaaaaggatctcatttcgaaaccaggccctgcttgtgactttagcaaccttaccactggaatatgtggggttttgatgatttggtcctagaggtgcggtttagtctattcagttgtattgttatggccatcaaatattatctagtaccccttaaatgagcataatagtatgtagtcatattgcatcaaggtgtaatatgtggctcaccaatggagagaaggggtatctggctaaacttgatgcttgtgcttaatttagatgtgagtaacgtttgtgctatcttaacagatgtcccagcacatggtactttgtttgtatttattaattcatttattgatttacagatatttaatgattgcctcctatgtgctgggtatggggactgcaaagatgagtaggaagtgggccctgtctccaaggctgtagagtcaccttgtggagctgatcctgagtgtgaatgatcagagtacagtggagggaagtgtcccaaggaaggacagagagatgtctagagaaaacgaggcactcaaactcaggcagaaaagtctccaaggtagagtaggaatatgccacacagcttataaaagaaaagagctttggggtctttcaagtggtctggtataatgccagcagcagtgggcagtagggaaggggctaggaatgccaggatataagatggaagtggaggcaagagcagaccatgacgaagcctcagtgacagggcaaggggtgttgtaggagtttggactgtgacatactgattaggttgcttttaaggcagatacctggaagcagtatggagaaggacccggaaggaaccaaagtggatgcagggagagcagttcagagagatgaaccattcaggtctgggctggtgcatttgtctgggtgcaggacgaggtgcatttgtgtttaggaaaaagaggcaggtgcaagtttttaaaaactcaagcaacattgttctaagcacgtgaagagggacttatgaggcaatggctatggagatggagaggtgaggagaggtttaagagattcttaatatgcaggattgacagaatatggagacagtctattgctggcattattttggtagacgggagggagaaaggacatcgaggatgactcaggtttctggctttgatgattggagatacagtgagaccactgactgagacctggaatgcagtggccagagagaaagaagcagtttgttcctgaaggatgggatccagtgagttggaagtacctgtgaggtagtcaggaggatttgtccagcaaaaaatgcaaatacggccctggcactcccacaagctctgggttggagatgtgaatacaggattcatcagcctatttgaagagaggggaagtcatggggggaggggagtggttcaggctgaattggagtgagccaatgagaaggtcatagctaggataagcctagtgtcattgcacgttgattccttctcagtcttaagagcatcctggcttgggtgctgaatgacgtgattatgcttgatggaaccctaggacacatcaacatttacagggagaaagagagatggaaactaatagccagggaggtgaaagaaaatagcaagaagagtgatgtgatagcaaggtggggagtgtagacaaaaggtggatgacagtgcctttgggattaaaggaaagatgcagaaacatcattcctccaagaagtttgcctagaaggaaaaaaatgcacaggtagctggagagaggcacggggttgaaggagagctgctatttattttaaagtggattctacagaatgttttagtggactgaagggcatcaggcagtgtaaagggaaagatgagagatagaggagagagaaatgatggacgggatcgcagaggaagacaggaggagatgaagggtacaagtgggagaagtataccttaaagagaaagtatggcttttgctttttctaattggaggaatcataaaaaggattgataggaatacgaataaatttggaagtagctgggaagcaggcctggaagctgagaaaatagattcctcagtggcctctatactcactataaaggaaaagataaggtcatttgctgatagacaggggagaaaaggcaggagctaggtgcttgagaaggtggtaaaaatttggataaatgggaaagggagctgactggatgcctccctcacagaaatatttttggggtgtgctgaaactggaaatcacaaatttatcgctaacgcagtctgcatcatttatttttcttctgcagcatgtggcaagccctgtgctggtgagacatccatagatggttgggttgatcctattctgggaataggctgtgtgtggtagagagatgagggctgaagaactaaggctgaaggtgagcaagccctacggtgaaaagtaaagtcaatgaggccaattggaagaaaaaggacaggaagaggaatcccaatagatgacaggtgttggtatgactggaatagatgaatgaaaaagagcaggaatgttaatgggttgctgttggatataggagtatccaaatttaagattacagagatggaacaattcccagtggcaacaaaatccaggatgtagacatagcaaattattgcttaagtgaagtaaaaactgtttgtcaagtgaataacatgatattccttgaagcttttcacttgagcaacctttccaatttattagtttggaatttgccattgttggttggattttttttttttttttttttttgatacggagtctcgctttatcgcccaggctggagtgcagtggctctatctaggctcactgcaaactccgcctcctgggttcacaccattctcctgcctcagcctcctgagtagctgggactacaggcgcctgccatggcacccggctaattttttgtatttttagtagagacggggtttcaccgtgttagccaggatggtctcaatctcctgacctcgtgatccgcccgcctcagcctcccaaagtgctgggattacaggcgtgggccaccatgcccccagcctgttggttggaattgtactgagaacctgaatctttctatgactggcctagacagaatgctttgttggcggtaggcaaactgcaggactgttttcattggtaactcttgggaacttaaaaagaacctgaagtttgccagttagacaccgtggctcacacctgtaattccagcactttaggaggccgaagcaggtggacgatttgaggtcaggagttcgagaccagtctgggcaatatggcaaaaccccgtctctactaaaaatacaaaaattagccaggtatggtggtgcatgcctgtaatcccagctactcaggaggctgaggcaagaaaatcacttgaacctgaaagatggaggttgcagtgagctgagattgcaccactgcactccagcctgggtgacagagcaagaatacatctcaaaaaaaattattgataattggtcattaataacttgttcctatagttgtgttagctctgttggattttgatttggccaatggttacactaattttgaataagcttattaataaagacaaaaattgaagaatgaatttggaataatcatttggaggaagccaaagggcactgtcgtatttcaaataaacgatgtcatcaatgaaatggtagtttcagataaatgtggtataatgaatgcaacaaatgtttattttcagttgcctagggattcaggtcaacatcctgaacagtgaagacagagcattttaaaggagactttgtagtggtgcttgggataactagagagagaaaaaaaaagccaaataaatctagactggacccgttttgttgaattatgtcgtttcatagtcatgtagatttctcatacattacctaaccatagagggttaacgttttgggaccaacctcatctggtgcacatttattgtgttactttaaatataatctgtgacttgatttacatgtttattgactcagtatgcatacttgagacacttcccaagttggttgctatgttgctagagtcatcttttttttttttaactttgctatagtaaactttcttacatagattttagacccataatcatgatttctaagtattttacattgttttttattttttttttcatttttttgactatggtaaactacacataacaaaatttatcatcttaaccatttttaagtgtacagttaagtagttttaaatacatccatagtgttgtacaactcccatcactaccatccatctccggaattcttttcattttgtaaaaccaaaactctatacccattaaacaatgtccccctcctcccagaccctggcaaccgccgttctactttctgtctctaggaactcaattactctaaatatctcaaagaagtggaatcacacagtatttgtccttttgtgactgatttatttcacttagcatcatgtcttcaggggtcatctatatgaacttctttacttttttaagactgaataatattccattaaatgtataggccacattttttttcttgcctttattttatactattctttttttctcctgctgaatataactgcatctctatggagaaaaaaataaaaaggccctctttctcaaaaacacatctgtcttccactgagtccaagatgtgttaaccaaactaaagagggtaagaaagagagagctatgtgtagaaaagttatctttgaaatttagtttaggaaacatttccatatctcacaagccacaggagtgcctctatgggaatgtgtctgccttcatacctctctggcagctgccccaccttctggtgttcccaagagtatttttagcatggcattcgacttactggatgatgtttctcaattttttacttataaggttattttatgttaattttgttattttaaagagttttgctaacttttttaatatcctgaggccatatggaagcatcttgctccaattaaagctaatgaaaaaaaccttttacaaaacctttaaatccgcatcacacattttagaacacccgagtcagctggtggtgtggaggtggtggtggggatgtggatgtgtcagaagtgaggaacacacctgctgctcttatttcttctgatcaattcatttgcaacctctgtgcaaagaaagttgcagaaggaaatctgaagcactcacctgtaattctagtcttgaaaatgttcttgtaaagcatccacatctgatatttatgcctctgtaagtggcagtgcctagctgttttctgagtgggagttgatttctgctgttgagtaaatagtaggtgtcagagaagcatttgtaatgaaatttagaaggagaaacacgtcggtgtggaagtaataatagtatttacaggggagcaccttgaaaataaggtacgttattttaaaattactttttggtgctgctgctgtgtccttctctccagattccctttgagcttcgcagtataaagtctccataactcctaaatatgagggcatgtcgtggagcaattgaagaagaaataataaatttggagtcatcagggttgctgtagggagctatgatccaggacaagatattttaacatgcattgtgatgtaaatggtacccctggatttgtatagcctggtggccctggctgtggcagaagggtgcacctgaggaaataatcatttattcagtggtgtgttttgggcttactttgaagcaacttgagttctttatgagttatgcctaaaattaaaatcttgggtctcatggtgaaaaaagaaaacagtctaagacagccctgtccaaatagcactttctttgatgagggaagtattctgtatttatgctgccaatatggtaacccttgtcacatgtggcttttgaacacttgaaatgtgctagtattattgaggagctgaatttttaattttattcaattttattttatttttttgagatggagtctcactctatcaccgaggttggagtgcagaggcatgatctctgcttactgcaacctccgcctcccaggttcaagcgattctgctgcctcagccccccaaatagctgggattacaggcccatgccaccatgcctggctaatttttgcatttttagtagagaggagcgttcaccatgttggccaggctggtctcgaactcctgacctcaggtgatctgcccgcctcggcctcccaaagtgctgggattataggcgtcagcaactgtgcccagctgattttattcaattttaattagttcaaattggaatgaaaacagcttcatgtggctcatggctacatggctaattgatagcacctgtgtaaaaagagccccttcctgagtttctgccccgctctgtgttgttgttgttgtttgtttttgagcaggaggcaggatctcactctgtcacccaggctggagtgcagtggcacaatcatggctcactgcatgctggacctctctggctcaagcaatcctcctgcctcagcctccccagtagctgggagtacaggtgcacacaaccacactcggcaaattttttataaatttttgtagagatgggcgtctcactatgttgctcaggctggtctcgggctcctgggctcaagagatcctcccaccttggcctcctaaagtgctgagattacaggtgtgaactactgcacctggtcctgattataaaccctctgcttcccacacattttagaggggataacgtttagcataaggaaagctgcatatggcatctggaaatggtgtttctgtatcggatgcctggtcactggccaccctatcattctcacattccttagctatctttggaactcagctattgatttcctttttgaatcactagctggggtctttagaggaaggctctcagctttcctgggttacctctacaaatatgagtttgaatagggctacattgggagaatttttgaggccctagataggccaaggaagccaggattgaaggaaacatgatgggtgattcataagaaattaccagcatcaagtacccttactagccagatgacctggagtcattcacataccctcctagaaattcagtttctcacacataaaaggggaggaataatagctgttctgcctacgtgtgtggttgttaggaatcactaatgaaacaatgtcaactgcaaagtgctgtttaaatgcttgtcatcatccttggccaatggcctgtgcttacagctgttttttgtatccattcactgactcctttccctgttaagtagaaataaagctaaaatggaaaaaaaaagaatttcagatactaaaagaaatgcctaaaaccatcaatgtcttcaccattggttcaaagaaaaaggcctgatgtctgttgggcaaaggttcccaatcctcttttgaactgacaagtgtctagagaggctggggttctggcatggctaggactcgggcagcgtcaccaaactcagtgtccctggtcagaaggccccacacacagagggaatcttggccttgaggggaaagttcttgcttcaggagaaagagggacccttttctactttctgtgatccaggaagcagcagcagtttgcagattagttctgctccttgccaaacacactcgcatttgtccatccctttctgggttccagttttcactctgcaggttgtgaaaactgcttgctcatttttccacccaaatgcatagccatggcccctctaggccaatggcaacacaacattagctgccttcagaggggaaaataatatatgaagaagtagaggaaatgatatcctcatttctgcacagattatgagcatttcctaaacctagacactaaaaaacatggttagaatctgccccaactaaatagttgagtgacttttttcttgtattctatttctcagcatcaaaccatttcttctaatgctagactgcttagacagtggtagaatccaaaatattccctccctctaaatgcaaaataaagtaagatatttatatgtacctctcccttctggaaaaaaatataacagatttgtttctagggtttcaaaggattgtgctcagctgaatagaaattgataaattattaccttttgctgcatcatgttcagcccactttattatatatttgcatttaatactcttgattatgtacctagggagaatgtaacattggcactgaattacaactgagcagaaaagaggagaaaaaatttctattttgatacaagaatatgattcaatttgattgtgaatatgactactcaagtatctgacctaaaaatattttaatacctgattattatacatgtgtcaacatgggatcttgactcatgaataaataatcccaagtcactcattcaaaaaatactttgagcatctcttgtgccaggtactagggatgctaggatgtatcagacacagccccttctttctaggaacctgtaattaggtggaggaggcagaattgtcagcaaacaatgacaaaactgcatgattagtgctattataaaggtatgaagagactgatggagatatatagagggagaaattactagttttccaagggagtccgtcagcaaagttttcatggaggagattgtattttgatcttgatataaagacatttactgggcaaagaagggaagaagagcaagccaagaagttctttctatagggcttgggtgagtgcttgacttatcctaggcacactgcaagtgtttaacttaactgtatacgcttcttctctgaatgtgatatgcctgtccccagggatccagctacagagtatcagcctgctttgtcatgttcatcttttatttaggccagtttattcttgtgtactgaccatactctatcatgaggttggatgccagcccagcccatatgccaaaatgtgtttgttgaattcaccttttccttatctcatccaacatgttcctcatgtcctgcatagctcagagcttggcatgtagtgggtgttaaggaagtactttttttttttttttgagacggagtcttggctctgtctcctaggctggagtgcagtggcgcgatctcggctcgctgtaacctcctcttcctgggttcaagtgattctcctgtctcagcctcctgagtagctgggattacaggctcaggccaccatgcatgactaatttttgtatttttagtagagacagggtttcatcatgttagtcaggctggtctcaaactcctgacctcaggtgattcacccacctcagcctcccaaagtgctggaattacaggcgtgagccaccgcacctggcttgaatgggtaaacatagttgcttatttcagagtctacatttgtgtcctagaactgtcataacaattagtacgatcttggtggcttaaaacaacagaaatttattctctcccagttttagaacctagaagtctaaaatcaagtgtcggcaggactgtggtccctctgaaggctctaggggagaatcctttcttctttcttccagcgtctgatggctccgagagttccttggtttagggctgcacaactccagtctctgcctctgtcttcacatggcctctgtgtctcaaatctcccttccccttttctttaaggacacgagtcattggatttggggcctttcctaaattctggatgatcttattgctagatccttagttatacctgcaaagacccttttgttttttttttcaaataagatcttattcaccggcactgggggttagaacatgcacatgtgtttcgggaagggtatcaccattccaccagctacaggatgcttgccaaggcctaaggctgagtagggtatagtaactatagaaagctttggtcaaatagctgtttcgattgccatgtttggatggggagtggagggtagtgatgaaagaagatttttaaaggtgtctcatatttccctctgtcttatctgcctcattttgaggaagggtcttctggaagcgcattttagtgagtcatctaggccatcccatgtggctgttctatagctcctttgaccccaaaggctatgcggtagtccacagtagctcacttctaatcacagctgacttgagcccggttggtgacctgtctcaagatcatccaatcttctaggctgtccagtggctcgtggctgatggtcttattaggaaattgagatgatccacttatatttttgcatggcaacttgagttttgaaactcaagagactgagttagttggtagtgaactctgcaactgaagggtcccagggagttcctccgagccgggctggctactgggccgagggtcagcaggagtgtcaaggaagccggtcagtagggagagctgactcaacaacgtggagagagctgcagaggcaccatgatggaggggcacccgtggcctctgaaaaagaccagccttggacctcagccaccttcgagtttacatgaggctgtgattttgtgtttcctattcttgaagttccacgaaatataaagatacacctacatagtgttgatgtgttaagcatgcgctctatattaagctttttatgtgcattatccgatttattcctcattgaatagatgctgagatggaggcaacagagagtaagggacttgtctagagtcagtccactggtaagttgtagagtaagcctcaaaccggggatccagctccagagctgtgcccgcagtgaccccagcacctcctctatacccgtgtttctgtcccagcttttataagcctccctggttttctcccaaaggaactgggtatgtcccaatacttatatcccagagacagatcctgaattgattagccaaattagtaacagactaaaaagttcgccaagttttttggtgtactcttcattgggttaatgtgaacatgaaggtaatctatgataagccatggagatgtagagtttttgtgatatacattttttggaatgtatttatattcttcataataaatccattatagtttttaaaaaattaaagcaaccttgtgtttgatggatgtcatgccatgataccctagcaccttcaactcaatcagccagtctagtcggtctgtttcacagtggctgaaaacactgccctgactgttttcctggccattttcctgtactgggcagacatggccactgtaatataataaaactatttcgagattggcatattagagaaatgtgctcttgcctcagcttactttttcttcaaaacgaatggtcttcgttctttggaaggctttgtgcacaaaggtatctgtaagggtttaaagtcctaaaaatattacaatacattataatttagctacaaagtcttccaggataataccagagattcagattctgaaattctacagagaaccgtctgagatatctgattgtgtttctggaaaagggaatagatttgggtttgaataaggcgtgtgaaattataggttatcgttttttttctatcatccacttatataataatgaaaagagaggctggcagaagataatacaccctattgagttagtaatatagggtgtgattttcaagtgcccgctacagaaatgtgatttacttgataatttgaaacaggtcctcaggtaagcatatatctttccccaaagtctgaaatgtccctaaagaaacactgtttcctgatgaaaatttaggttcgcaaagtaaaaatctgaaagtattccatctaaatcacataccgattgtcaaatcaaacacataaatacctgaaaattaaatgctctgaatagaggggttttttttctttttttttttttcttaaaggcctgcctgtcagtcaagtttgatgcgggtggtattcacatgcagccttgcttttgtgtataagagcaagcatctgcccagttgggcatctaattggtgatcaaggagtattaagttaattatttgaatggagactataactgatataatttctaaagctctggattatagaacagtatttttatagtgataggaagaaaagggacatggctgtgactacattgccaaaacattggatcgtacacatggagccatacatagagtcacattagtggtggttttgttttcctaggtgcttgaagggctcctgagtgccaagtcattgtatatgtagttaccaaggtaaatgtaagtaattaagggaacagagtgcagtggcttccactgtgctatttctcactttgttttgcatattgctaggatccagagcgatatgattggcatttgagggaagataagcaccatacttgtgttgcttattttctttttaattaagttgccgtctgacaatcatactttctgacatttatttagcctttacattttataaatcactttcacatatgctgtttcatttagttctctcaacatcagaaggtagtgtgatttctcttccagaagctaagtggagggagagatgattcctgataaacattggggatgcccgtaagaggggtggctggcacactgtttctcactggatgactgcctacccgctgcgcttacctttgtgctaccagagcagggggaaggagacttgcagtgagatggcaggacgggggtcccgtgaggtaaaggagtctaagacagccttccatcctccagttagccagatcccagtttccgagaagtatggcggacggttccccggtgcttgccggtcctggagttgggcatgaacaatagaggaagtcaggagacacagtcttgctgaatcctctacaacatgctgggcagaaaggcactcgccaaaggatgctacgtacaaggccacagacagtggtctgcctgcagatctgccgcatgccacaagcgaccaaatactttttatcttttctttttttctttttttttgtttcgctcttgtcacccaggctggagtgcagtggcacgatctcggctcactgcaacctctgcctctgggtataagtgattctcctacctcagcctctcaagtagctgagattacaggtgtccaccaccacacccagctaatatttatatttgtagtagagacagcatttcaccacgttggccaggctggtctggaactcctgacctcaagtgatccacccacctcagcctcccagagtgttgggactacaggcgtgagccatcgcgccgtcttttctttttttcttttaaagaaaatctcatctggattctttctgttaaagaactaaacccaactccaataacgcctttactatctgcctatttgcagttatactcaacttgcacaaaatttgtatgccatatacaaatatacacacattctctttacactatatgcacatgaatggaaatctgctgtactaatattgtcttttaatgtgtatgtttaatgtgctgtttcgattataagcatatcaaaagctgcaattgcctctttttttctattatcattcttcttggtctgatattgattataggcttggtacattttgttgtaagaccagttggtacttcagctcgacaatggccagttataattgataactgagaaaaagttgttggaagcgaaaacagaccaagaaccacacagattgttcccgcatactcttaaggctacttggtatttaaataggaaaagctgtgattatacattttttgatatgcccatagacttgtacgtgtatctcctgagatgcagattaaattttgagaaaatgttttgagcaataatttaatacagcgctgtggtagtcttattgtaaaaccacagggcttagtggaaatttttgtcgtatcaccatagataccaaaatctaatttgattactcttgtgaatagttgctaactataatctgatattgactgttacttttcatcggctggaagtagtctgctaattgagctggaggcaagccagggaaatctttcaaaggagtagttttatatacagcagttttaataagcaattcaatgaaaccttttataaaaacaacaaaggcaagaagggtctggacgctctgagcgtgcttgacacatctatgactgaacgcaggacaatgccggatcatgtcggtccctcagacctggctcggcaaggttaaataagaagagcttaatttattcagcaaccgtgagtatccttatttgcttaacaactctgtcaaaagcaaccctctatgtccctggagttgaataaatgagcaaggtgcctcttgcgtcatcaaattatgcacgtctatagtactgtgaggagggcagtttgctgcttgatttttcaatcacaattaaagtaatatcagatacctttactgggaagagagttttttcaaagaggcagccatatctttgcctgttatcacctaggagctcccaaaacacagtgaatgttgtttttttttttctttttcttgagggaagacaaattccatagggcaaattgttagaccagttatttgtgcttgtttagtttaacaagtctctgctcctggccatgtggtggggtgtgctatatttgttgagcttttcctacgtgccatacactactaaactctttacatcccttctataatttcatccttataacatacactatcatctcctacttttgttatgaagagactcaatttcagaaaatttaataactggcccaaatatacacagttaatatcaggctgtacgtcctggtctttagtcattttaactgtactgcctcccaccagggcttgatcattagatgggaggtgagtatgacactatttacaggaaaaaggtgtaaaagtgctgtttcattgggctgaagtgattggtgtaccacttctacttgggccattgaatttaaatgaattaacatttatttgtctatatggttgcgtgtaatggagatgccctatggaaagcacttgacaggtattaggtgctagtaagtagtcgtttttgtcattggaattgcttttcagtatgtttggcatgattttgcctagtcctgtgtttctcaaagttactgtgcttttcggtcccccaagaatcttgttaaaatgcagattctgcaagtccagagcagagcctgagagtctgtagttctaaactgttctgagccaatgtagtgctggtggccccaggatcactttttgagtagcaagggctttgtctttgagtgcagcaatgaatttcccatgagatggtgtgtagtttttaactgagatacagcaaaatcaccagcccagagcagacgtttgtccctggtctcagtaaaaaagtgaagagccagttgaactaactaggaattaggcattttaatagaaatgagaagaagctggggagggaatagaaatgaaaggaatgctccaagtcaaggaaatacatcttcctaggaaacacgaaagtagttggaaaaagttgctctgaagtgtgaacaggttatcatggaaagatcttggtaggaaacctccaaagacaaactgtctcaatcccacattgctttcatcatcaaggcccctactaatgaggcaattaaggttgctaggatacagactttaaggaggcgcccactctcagggcccatcctctgtttgcaccaccctgagagttagtgcttcattaaattttgagccctagagactttattctcctcacccctgttctatctatctaacattgtcaaactggaagtgatcttagtaatcaccgtattcagccctctattttatagatacagaaactgggctccaggttaaatgacttgttcaatgtaagtaagagtgaaatcatatttaatggattccaagatgcacatttctcactgacagttgaactgacatcaggattgtcttatcattgatggcttttgactttagtgtcatagtttgattggcagtgtttcacctttcttcgtggtataaaaataatgatggtgcatcttaccgtggatgggttcttatgtaccatgaaacacagtattagagagtcaggtcctctgcctcctgattcggtgctcctctgctgcacacttggtgacaaggttatcctgatgtctgcatggttactttggtgattttagagacagcttagcattgtggctgagagcatgggatgtagaaccagacttccctcccacataccagccatctaacttctgcccaagcagcttacttctctgtaatcaaaggtggcaaaagtgttaactacccagtagtgtccttgtgagaatgaaatgaattaatccacacaaatcagttggaacagttgctgacacatagtaagcactcaataaacatactgttgttgttgatgacagtctcactgaccaagtcaccctggacccccgatggtgtctgtacaataacttgaaccaaataggtattcctctatgcatgctatatgaatgtaactgtattgagagtcctgttaaaccctggacaagatttctgagtatcagcatatttcacttcttatgcttactaccaagggaaaccatagcatttccacccataaagggtgttaaaagcataaattgacaaagatttgtcttgactgatacagatgttggcctgtctgcaaacagctgtaccaggtgaaatccatgacagttctgtaatcttctgttaagtgagacccgttattgttttagtactaattccacaatggccagggagttctgactagattgcagttattatgagccttgctcagatgagacatggttggccactgtgccttcctttaccctgcctccagctctgcagttatcattcgtattagcccccttgtgtgattgcctaatacagttgtcttgaaaagtgatggatatagacaacatgattgttcttcacacttattctcaaacttttctccttattttttctttctcctcttgtgatcgctgtgtttaactaggtgattggggaatctgggttaagcctctcctaaatctcttcccttcaccaggcaggatacagtttctcctcctgaacccccaggggactctgcagctgtcttctaccatttaccacaggcttcggtttatgtgtttacttgttttgtctgctgctctgctgcttggttatgaggacccttaaagaagggatcttggctcactctttatcatcctgcagcagctgacatagtactttacggttcttagtagacattcactgaatggataccttttgggtttctgagtagatctgggatagatttatttcacccagttcatatatattctataaatagataatagctcatctggggttatgccaacctccctaattatctgccttataaaagcagggcaagttattctcccacaacatagcaaattttatccaacttccataagccgcattacacattaataatagcagtaatgctataccttggtagatgataatagatgacttcagaccaatttgcttctaacacccagattccatacaatgaacctcacgttgtactgatgctcagttgtcagggagaaaatctgttctgttggtggtgagagtttcaaggggctgagccttggaaggcaagttgaaggaggcacttactttctgtgatgtagctgtgaacaagaaggtgcaggctatgcagggctcctggccccagggagtctagcagatctcatgaatgggattttggtcttccagaactgacaaagtagggaatgcttttggtgaacattttttggtgaatgctctaaaagacccctcagactccctgccaatcttcaggtaacatttactaagtttgcaacgaatctgtcttcttaaatacacttttcattgatcggtggacatatattgggaagggcagagcaatctgatattgaagattaaacagctatatctatttgaaaggactctacagttcagatgctcagggatgtgtcttgcttcgaagttcttgtaaacattcttaaggaaggtaggtgttaaaagttcattcattactgaggcatttcactgtctcttatttatgtctttcacctctaaaagtgtcagccacacattttggtttgccatgttactttgcaccagtttaaggtgaaaaaggctattcctaactcagagagttgggaagaagcgtgaacagaggattggattaggaaacttagacaaatttccagcttctggcagagtctttatttggcaacttaaaaaaaaataatacttgcagtgttaaaaattatcaggatataaatcataatctcaatacaagataagaaaaataacaggttttatttttgattatctgaataacttctcttcagttttcatgagtacttataagttgattgtacttaaatcccctttgtaacaatgcaaggtaagtaaataattaaaacatggcaactgtgcagattagttcaagcctacagatatatttttcgactgaggctttagaatcaatttttctaaggcttagacaaatgcaaattttaaccagagagaaagcacatagttatattctagttattctttcgtgaggtggtctttctttgcaaacagataaactaaatgtatagttggtaatgcatatgagaatcacagagaatcatttttcacaggccggaggacttttctttgtattcctttgcaatgacagctgggggcaggtcatgaatgtatctcctatttccctgtcttcccatcttacctcactatgcttacagcattcatgttatgggctaaaaatggaaggaataaaaagcaaaagagcctaaagtacgatccacagatgacctcagctgactttgttttttgtttgttgttttgcttttttgttcaaagtgaacttttacgttcataattctctagcttctcaactcatagttgctacagatcttcagcagtttgccattcagtctcattttgtctgttcctttctgaagttgtccacaccttagtgaccccagaaaaacccttcctgatggcatgcagctaacttaagggtgtcaaacttcctattgataggagctgttgaacttgacagcctcgatagagggtgagtatgaggcatgaataactcaatttgttcttcttgatcacttagggggcttcatagcatagttctctctattagcatcataaaataaatttgcatgaaaatgtctgtgcattgctcttttggccttttcagagaaagcagatttactcctgctttaaggagctcagtctctactttcatttgacttgaggcattatagaggtcagaggacatggtctatccttagcggctaagatcgcaaggcattctgcatgactgtagctggcagggtagcatttcaggccagtgcagtgttcttttcaggtgtcatagtgattgccttccaaagcatttgaaaagaaaagttaacattaaccaccataacaagtggtagcgtcattctaatgttgagatcgttatttcaacaaaacaaatggttctggagtgatactatatgctgaagaatcaaagtttaacgttagtcttgagtttatttgattttgaagttgcttcatcagaaatgaataaatagacttaaagagagaaataccacaagctttaaacataaacactaagtagattgacatcttgtctctaacttcaaatcacagtaaaatcagcaattcacaaaggaattatatatattcctcagccattggtaggtggattagaagatggtaattcgggctaatgcaagctaatcaatagaattttactatccttagaagacactccaatggccattctgttgtagtcattataagaaacaatcatttacccagtaggctttattctgagtagaagctgaaaccacatggtgggattagcttgatcagtccaaactgactgaccatgtatccccgctgcccctgccccactcaaccatttgatatggcatagcgatctcactgatcattgggtaaaacactagtacctagctaacaaattcatgtgcagcttgcaaagctaaactttatgggcctgtcttctgatgttcttatttgggcagtgatatgatgcgagtaacaaaagatggacttttataggctacaggtgtatgtaggaaatttgtcatatttctctcactcctttttttctaggttgcttttaaatgtatcattagcatctctatatattaatgagttactttttgaaatccagttcctaataacaccatttttcataagtagattatatctttagtgacttgttttgctggagtttaatggcagtgttgaaggatattatttattttttgatttgggctaagatagctataattggcaacagtatgcgttaaaaatgtaaaattagcaaagcagttgagaaatctaaatgtaccagatctatgcatttcattaaactctacatctggctcaaaaattataaggcagccgggcgcggtggctcacgcctgtaatcccaacactttaggaggccgaggtgggcagatcacaaggtcaaaagtttgagaccagcccggccaacatggtgaaaccctgtctctactaaaaatacaaaaattagctgggtgtggtggctagctcctgtagtcccagctactcgggaggctgaggcaggagaattgcttgaacccaggagacggaggttgccgagatcgcgccactgcactccagcctgggtgacagagcaagactccatctcaaataataataataacaataataataagtctttggatctttcccttgaaactaaaaaatagagtgggtttagtttttttttttaatcagagcataaaagctattaattaagtttacgtttactaaattgaacaactgtggttaagacagtgttaggcttagaattttcttttctttatcgaggtcttgttatgttgcccaagctggattcaaactcctgggctcaagggatccacccacctccacctcccaagtagctgaaactacaagcacacagcaccgtgcctggctatgcttagaattttctctctttcctgactttagggtggaatataattcagcaggatgcagaataaatgtattgcaagagtttggaaaagttaagatagctgtgtgttggagaaaaagaacagaatgttttacaaaaaaagcaaccggggaggcattttggaaagggagaagatgaagatacataataatgctaatcataacatgaagaaagtatatttttcccaagaaagattataatgcttgttgttttgatgaaacaaaccaaagaagtacaaccaaggattcagatccacttttcctcccaaaagtaattggaaaggttcttgtctataagattctattctattacaggagaaagaaatttttcagtatattcaacttaatattatgcagagtgaaatacatagattgacgaaaagagtatcctcaaaatttgtaggattttgtgtgcattcaataattggaggttttccagctattcgtagattgtggtatttccaattctttttgtttcataatctcaactagtaattatgagaaaataatttttaactgtcctctctgacctaattagtattacattgtgctgtggactactaggtgataagtttgaagtctctgacaggaaaaaactgttggttgtttgtttcaggtaacattcatgatgactttgtcttgcatgaattattacttagagtattactgacccatattaatgggatcaagacaaatacatcttctgtaagggagaagttttgcatcactgaacaataaagcaggacagcatagtttatggaaaagaagatttagaactacatagcgcattatttcactttctgcgacataatttgtagtgaaatgcaatgaatgaactcttgaacttgtaggggatatatgcaacattaaggccaaagaagtaatgatattttcctccatagatgcaatgcctaatgtcacaatgccaccgcatcaccacatcagctgaaaaaacatttggggaaagtcaggtctgcatgtctgacttgtgaattacattaactaagcctaaacctaatagcccaagtatgctagagggaaaggataaaagggagacttaaaattgctttgaattaaaattgggaaaaaatgagaacgtttgtagaaacttaaattatcccaaaaacatgtctaccaaaaagtagcacttctaggcatagtttgatatctatttcatcatgactgtcatttgtttgttcagcaaatgcttactagcacctactgtgagtcagctattgtgttaggcacttgggatatggcagtaaaaggtatgggaaagagtcattctcttgagctcacatcctagtagaagttttgaacaatagacagtaaacataataaatgagcaaatgctatagtatgttagaaagtggtaatagggaaaagaaagtatagaacagaataatagtgacttggagtatgtgtgggatgagctagtgtgtgggcagttgtcacaagtttgatttcctagaagatccaatccatatcatggcatctctcccccgccacacacactttgtagaataaatctattttaagatataagccaactgcttctcaaaaaggttaagtaacttgccctagatcaagcatctggtaagagagaaatctgtttaccctaaaatatttttatcataccctgctgcctcccagctcagtggctccctgctcccctgtttctgctgctttctgccagggatatctttggctcaaagggttatctcaggatggtatgctgcagatgttttatcggacacttgctttttctaggccactcagggttctagtgccagacgtagttcactgctattgttatatccttggaaatagcagcttataataactggaaattagacatgcatgagagggtaagaaggctaggatcgaaatgttaagatgtagaaagtaggttagaggccagagctgtataataggtgaagggagataattacttaacaagaaaattgtgtccagggttgatgctgaggacagtaaataaggcatgactcataaaggaagcaaaatcacatgaagagttagtgctgctggttcttaaaactcacatgcagtatctcattcagtccttggggcctggaaagtagggcttatagccccacttcatggatagctaaacttaagaatggaaaaaattaggtggcttgcctaatagtcgtgaaggcggatgagaattcaaatgtaagttctctggttgcaaagcctctttctttctactacaccagagagtaagattagaagagaaagaaacagaggcaaaaggaacaaatacatcaatgtctgccctttggtgtcctccaccaattctttcttaagtaaagattgagttctactcgagttctgatttaagaaatattgatagagaggcagcaagatttatttccaccccatccaccagttttctgggacagccttcctctcggtggaaactaactcacaattctcatattgtctttacagcaacttctagagctgcagcttttagcttgctgtggacaagaatagctagcttttattaagcacttactctctgccagacagtgttctaaatttaattcaattaaacttcataatgtgcctatgaattagggtctggtattttctacattttacatatgagcaaattgaggtatagagaaaggatctttcctgagatttcacaagtaaaaggaggacctgtgttttaaccacaatgctatgctccctctcaactgaaagatgagtagctaccataaactaatagttgccagtgctttgccggtaattgaatcattgcaacaactctggaggcaggtccttttattatgatgattttattttacaggtggggaaactgagtcacagggaggttaaattatttgcccctagttacacagctaccaagtagtggaattgggattcaaatcccagcagaactgagccagttcttgataaaattgcaattatatgaaagtctattattggtctttaaattcttaagatgttagtgaacttggaaggtgaagggaatctgatcatcttttttccatcctgcttgcttattaattgagggctacagaatcaagattgtatggactaggtgtagaactgcttttttatctcaggcaaataagtaattacactcacttgtggaagaaaggagtgagattatatggcatctcttgtaactgtcactaaagaatacctctgtgtttagcatcaggaaccagcactgtcccacaattgctccttcacagcagtggttcccaaagtaggcacccacaaaatactagcattaaatgctgaatatgaaaatactaaatgctaaaagaaaataatggtaggcctaacttgcagaaaacaattatgcagatagaattttcttcattgagtatttctttctcatgaattcttgaatctttggagcctggcttgtcagcgagtgacaatataaatgaagaacaaacaccgagcattagaaattgcctgctctgctccagctatattttgggagtatccaagagtgcagtttcctattacattcataacatggatcatcatctttgggggttcctctaggagcaccctagctcccagatggaggccgtaaggtcaagcagccagcatggagcaggacatttgatggaaaatgggtcacacaatctacatggcttttctttctggcatctggtttagtatagacaaggcccactcaaggaaagcttgtttcaaagaaaaacgctcaagtaggcgttcagagaagctttgctgttgcattgcaccaattggaatgggagactttttttttcattttattctcaaacgtagttcacatcctggtcttcctccttcctccggccccacaactctcattcagctgtgttgtgaaggttccacaacccctttaaggtttatggtcttatgaagcacagctggatagaggttctttattcttaagcctttggaaggcttccctttgaaagtttacgaacgccccatctcttttctctaggtaggaacattaggagcagatttagtggaagtgaggcatgctcagtatctaccaacacaatcaggtacatggaagtcattccatttctgactgcagggattgtttcccattcttttacttaaaagcaagtaagcagatggattggagcaaataacaatagtcaaggtcctctgcagactggtggaagcactcaggaatggcctcccatccctgtgggccatgaagtcattacattctcctgatgttctgccttcgctctgtggtcttccagaccagttggaagctgcagtgtgctgtgcttctctgcaggagctccccttcaactcccacccctgaacaaacacacctgcaagctgctttagtggctgttccatctgtggctttaaggatagataaaacaatcaatagcagataagtggtatcatgctgcttcaaatacagagggaaacatagggtcccctttagacagttaagacggcagctgcaaaaatgaacagcaatgacttgggggagggaccaatctgacatctgttgaccatttggccagtaggtagtggtgaaccaaagaggtaacttaaacaagttcagaatccaagaaaaaaaggttgaattgatttggatatcagaataggggaaaacattctatcgtttggcaccattttgatcagagttagacgatagacatcaggctgatttgtcagaatcactgtagagatgatgggttttgtgtttttgaataggcagctttggggtgctttgtacaccttcacatagctggccatttcaccttcagagattgaactacattgttcccttagtcttcctcattgtcatagaacagagaagtttttcatttgctgtgcttgtgaaaccttaaggcttttccattgctcttccaccctcaatcctgcatttctcactcctcctctggcaaaaggcttattgaggcccatgtctgggtgtcattccatgtttcacaagcacttagggcttgtaattcgctgctgtggccccacactcttgttaactgccccctgtctggggtctatttttcaggccaaggctctaccagtccatgctaatgagccagcggcagataggtcagcaagggcatctgggctatctgaattggaattaagggagaacagatttgttgttgttgttgactgtcaaacaactctgttagctgtggcctaagtcttttctaagtcacattgacaagaacgaaaaatgtcgaaaggaaaatctttaatattaaatcatatttatttcatatgcaaacagccataggtgtatttttatatgagggcttttataaatagggaaaatagtatcgggttttgaatgattaattattttatatttctcttattcaagcttctagaccgcttacagaaaatgagaccttcgagttcttgcagttaagatttcctcataaccttgagcactgaaagaaactaaatcttgatatttcatggagtttttatcaaaactcaataattttgtaaagagaatatgattgaagagcggcagtatagctgatccatcataaattaacattaactaagtactcatgagggatttgtgctgtgtctttaattccttccaaaacaaatgacgacattctcagctttgcattgtcctctgatatagcactgaccttgctgtaatagaatgcgtgtgtgtgtgtgtgtatatgtatgtgcttatctaactcatagactgagcatctaagatgagtttacccagctttcagcacagtggtcgataatcagtggttaatcagtgctgagcaaatgaatagctacacagtccagcaattgcttggatgtggttcttttaacgcaggcagcccatattcaggccaactctgtgaaaaggcactggctcctcccaggggtcctgaaacatactagggaagccatggggggaccacaccgagctaagactcgccaaatcccttctccagaaactggaaaccattcaattaatagcaatagctgacgttttctgagttctcatttcattttatccttacaacaatcttacaaggcagattttattaatcccattttacagatgaagaaactgggtcttaaggaggctaaatttaagttgggagccagttggattagccttgtgctttagccccagacattctgggttcacagcctgtgcctcacctcctaccgactgtgtgaccttgagcaaattcctgtcatctgccagtgcctcagtttctgtttctgtagaatgaataataatagctgtttttaaaaatctgctgcaaggattaaataaaatgacgtaaatggaatatctagtataatgtctgagacagggtaaacatttagtgtttttattataattaattattgctattaggcccacaggaattcagacacagacctgtcaggctctgaaggaggtctgtaagcaagacttggcaaggtcaggtctgacttcaggaagtgcactggggtcacagagcaaaggatggcctggcttgggatagctattgactgtgagagaagtgggcacttacctaacaactccaggctgagctgggtctccagcagtgggataccaagtgggggtggtggagttgaacttgagatacctttctgaaatagaattgacaaaatgtgttatcagttaaaaatagggaatgagagacagagaaaaattaatgacaagggagcctgaggaagggaggagctacctttaagaagcagaataaaggagagagaattgtcagggtgaacgtgagagatgttaatgtgttgttaatgtgttttgtatggtaaaggtatacacagggttgtgtgttacgttcaggttaatgcggacagtgggtttgaaatgccaactgcagcccagctccgaggtcagggaatgcttctcgatggaaattgaaccctgagtatgttttctaagcactctgttcatcactttccttctctgtaaaaatgtggctattggacaagatcaggtcccttctaactctatgctttttctggattttttaaccttttgttaattatttcaatgcagtggatccctttttaactggcatcactgatgacaaacccctgagcctggggttcagagccctcatcccacgactacatcttacttttcattctcctatcttgttgcctcagccatcctaatgtagctaacagagtgactcaccatcccccagatacaccctcatgctttttttccaggttctgctcacaatgctgcctctacctggagtgtcttccagctgtctctcccctgacaagtttgttacacagcaggcactactccctgcaagctcccttccatgccagaccctgattaccatttgttgaaccccccctgccctgtgccaatcccatgctttacaagtatcctatctaatgccctaatggaaagtcttgcaagacggcagacttcttatctccattttatgtgggaccaaactgagtctgacatgttaaaaagcttgctgaagcctcagagttgagattccatcttggctcactctgattccaaattccaagccctttctacttcttcaagctgcaggccttgggccacttggtaaatctttcttatggcttttatctaatgttgacttctgctttagtggattcagcatagttttattgagcatcttctgtatgccagacacctgcacaaatgataactcatttaagggtaggttttatgtcttacttcttatatttttccaagacttaacagaaagatggtaccaaggtagaaattgagtaagtttgttgagttcaactgaaatgagtagagtcgctcatctaacatagagagctatcatcaaattaggagtcaacaaacataccctcccgttagctgaatgatctggttacctgtaggatgactgccagcttcattgggaactctgttaaatagatcagttgaaatttataagaggtgacttgggcttttttttttttttttttaactctttgttcttaaggttagtagctgttttttagaacatactttagataattgttagtgaaagcaattaaatggttccttaaaggacaagatgaatttatgtcaaaataaattgacttatcattaatggacatgtattttgacataaattcctaaaatcatggtgggattactactatcatcatcaagatgtatttaagttgaatttgtacaagcttttgtgttaagtgtatgagaaagaaaactatagagagactttatttatctcctgttgcaggggcaatgaagctttcttcatacctaaatatttgagatagctgaagcttatgctaccaagcgccaaggccttttattttaaacataatttataaacatatttcttaggcaaaatgtatgagagaaaaattttctaatattcatgcattgtcataaaattcatgacgtggaatgtgttcaacaaactgagcccacttaggatactaagtgatctaagtgccaggtggtgatctaaattccaaggataaggcaataaatgacacaggtacttggtctcatggaacttcattctaacaggaggagcatggaatcaacaaataagcaaacacagttgtccctcggtatagaggagattgattctaggattacgccccttatcaggataccagaatacatggatgctcaagtccctgatgtaaaatggcaatagtatttgcataaaacctacatacatcctcctgtatgattgaatcatctctagattacttataatacctaaggcaaggtaggtgctttgtaagtagttgttatactatattgctttttatttgtattattattattttttcaaatatatttgatccacggttggttgaatctgtgaatgtagaacccatggatatggcaggcaggctgtaagtgagaaaggtaacctcagatatagtgatcacagctaggaagaaactacaacaggatattaggacagggaattatttgctttgtaccaggggcaggggaagaggcccctttaagtagagtggtcagataaggactccttgaggagggacattaaatctgaaactagaagaatgaccatcatgtgaagaactggagtagagcaaaggtcctgagatgaggggagcacagtgcgttccagtttgagctagtttgttgggcctgaaatgctcatgaaactttcaagaatataggttgggcaggtctatgaccatgggaatcagaagcatgggagaatgatggcataggagttaggactggacagtcctcaggttcctggagataattaaaaccattgaacaggatcattgtttacaagaactattatggaagttgcttcccttctctgacgtatctctcagtgacagtagtaagtcctgtggggaattattgtaaacatattacaaatattaactcatttaaacctcaaaacaaccctagaaggtaggcgctattactttccttccatttttcaggtaaggaagctgaggcacagagatgttcattttcccaagatcacgtttatttagtggtggagattagaggcaaacctaagtagtttggttgaggagtccatgattttaattgttatgtcctgcagcctcatgcattatccatcaagatgggatagataagaccttagagaaatcagagataaagaataaagaaaacatcatgaggagatgggaggggagtttagtacagtgatatattcattgtctgctgggaagtagatagggtacccatgtttgaatttggttctcgtgagtttatcactccacggttgcataactgttgttctctcacattcgccatatgctttcctggaccagtagctagaataaactcattgtttataataacctcttcaactagctaacagaggaatgtgcgttaacaacaaacaaaccagaagcatgaaaggagctgacaaaaatgagcaacagcaaaatcaaatgaccacccaaagccatctttagcaaagaggaagagcactggttccccaggctgcttttgcgaagcttgcttcaagggctttttatgtatttatttttatttattatcatttttgagatggagtctctctctgtcacctaggctggagtgtagtggtgtgatctcagctcactgcgacctccgcctcctgggttcaagcaattctcctgcctcagcctcccaagtagctgggactacaggcacatgccaccatgcccagctaatttttgtatttttagcagagacggggtttcaccatattggccaggctgttctcaaactcctgacctcgtgatctgcccgcctcggcctcccagttgctgggattataggtgtgaaccaccgctcccagccccagggctttttatttttaagaggacacaaaggctgtttgaagtcctggtcatggaaaaatcccaccttcttttcaaccagagcctagcaccctaaattttgcctattgtacttggtagaagacaccagtactgccctctcctgttattttcatctcttaactcatcctggggtttgttgttgagacagaagagttacttggtccccttcacagaacttaggacaggggtgtggcttgcttacaaggggtgtggttcaaaccccttgtggaaggggagcacacaagcaagtgggtgccagggctggggtgagcacttttgggctctggccccacagtagcatctagggttttgttattacaattaatgctcttttagcagttgctgtctgtggatggctaagtgttaaccagctcagtagagggtcaggatgacagccttttacaccttgccctgttggtccctgggtccttgtctggcatccaggaagaagcaggtcacgtgcacttgaaggatggtgaatgcagagattttactgagtgatggaggtggctctcagtgggatggagagctggaaaggggatggagtgggaagataatcttcccctggagtttgggatagctgaactcctttccgttcagctgcctctttgacattcaattgtttctgtcttctctccttctctgccacaccactctgctcctctgccagtggagtttggggtttttatgggtagaagatgtgggggggtgggtggcacgtggcaggccagggtggttttggaaaaagcaacattcaggcaggaaaacagggatgtgaagttctcatttatggccgcgggcccaggcttgtgagtggggcttttgcgaaggaactgccctcttctgcccaatatttctctgcctcctgtcagtatcactgtggccactctgtgatggcttctgtagaatgtctctagatgaccctttctggtcctttacacaactctgagtttgcaaaggagaaagtgtcaaaagaaggacttcctcctgttctgctcagttctccttgtccccagaaggagcctggttgtattcaaattaggagattccagtttatgttatgcctggaggagtagcactgccctttcttgggagagttaaggaagtttccctggtttgcctttgacctggaaatccctcattgtgattgctgtcactctgccttggtgtactcacttactttcagtgtattctttggtgaccacctagagttcctatggcctccactattgtggcagtgccaggaaattttaataattattaaaacctttaaagtgaaatgtgaaagaggctgcaaattcttctgtcacagcttcaattcccctgttagttgttagcaccgctgagcgtgtgaccttgtttttaatagcatggttattttcctttgttactttcatactctatttctttccatatttaactttgctcttctatgatctgttctaaattatggttgcattgtgtattgtgtattgctccttaattataaatcctggtgtcacactttctcctgtttttcccccatttgctttctgattatctaatttctcctctttgactggatttatgctcattgaatgaaccatttattttctactatctctttatgtatcaaagaagtaagattcttcagaaaatgtgatcaaaactttaggaataattttattaagtaagaatagttaacacctgcagtgtttacatggtgctagactctttaataactcatttaatccaaacagtcaggctttgcaatcatcttctccattgggaaactgaggcccagaaagttatataacttaacaaatttggccttgctatttcccaagatgtgcttccccaatgatgtgtattattttatgacataaataagttgattttcaaacatggtatttcttctttgtttgcatacattaggctatttacatgatgttctgttagttttttctacaaattgattaagaatactgttatgtttgtttttattttcccctaagtatgggttaatacctgattaacaaaatgaaagaaaatgtgattgtttactaattctgcaaactcattatttgttcagaagattgtaataaactctacccttgtataatgtcgagaataatcattacattttttagtcatctgaaaaagttctttaggattattatttcatccatatttaagttttcaggaggattttttaatgaaatataagttgtaaatgtgttaaggattgtcttacagaaaaaaatggaggttataatccacaggaggacacacctgtgcacaaatgctttcacacactatgcacatgtactagaagcatggttgaactattacagctacaaaggcagttgaccatttcactccataggaaacttgaaatcaaatttgctgcagacagtgaggtgagggttgagtgtctttaatcagtatttttttctggcctaagcactagtcttgcaattcctttagctggcatggaggctatggaggtgacatttatcccagccattgtcagattggaagccactactgggattactggctcttgggcatattgatatgccaggtggacttctcatagatatctgtacctgtttgcaacttggtatttaatatttacttacttactttctttgaatgattaaaaagattaaaaaggaactgaagagtttaaacgtgagcaacgtagaccattattctactattgcactaaaaggagccatggaaagctgaccatagattagcagttccatgggaatgtgaaagggacacctaggattttttggagaaacatctttaagacaaggtgagcttgtaaatcttttaattctcattccagactttggaaacagttagaatctgagttacttcctttgttccctcataagaacaaaaacatacttgcttgattattagacacaaaataaactgggtgacatttagattatgaaatttggttacagacatgtttctgcgtgtttgtgattaggtagaaggtgcagagcattgcattctctggttaagtacaggatagtgttaaggaaacatgagtagatagggactggttgataaacacatgcaattaatgaaactttgacatcatagcactttggctgttgtcagtgagcttgctggcctctggtttctgttcattatttattctatttccctagttgaatcattcctccaccctcacacaggcaacattattaaagcatggattaaaatggagtccaaattgataagaagtagttatccagtgtttctggatgagtttgtgacttgaaaaaagtttcaagctaaatggagtgatttgaaatgtaaatggattccttttcctttttgtagataattgtactaaatgctaatttgtgggcagctaatgtgtccttgtgttcactgataagctgtgtggcttgaaacaaatttataaaaggggacaagttgtttgtcagcaaaaactctcaacccagtcaactctgtatgtgtgatactttttgtgcttctgtgaacaggtatcccatctacgttacctgcctccacacgtgcagaactccccactcacctccccagtgataatgggtgggttatcactggctctctttctttgagatccattttaaagatttgggatgaaatgtccacttaggataggctagacaaggggtccccaaagtttatctgtgaagggcttgataacaattcattttgtctttgcaggccatatggtctctgccacagctgctcaactgtgcctttatagccctgaagtaaccgtgggcgatatgcaaatgaaggggcaggggtgtgttccaataaactttcatttagaggcactaaaattagatttttatgtgattttcataaatcatgaattattgttcttcttttgactttcttccaataatttaaatattttttccaataatttaattttcttgtagctacagggccttacaaaaacaggcagtgggcagattcagctgggaaaccctgggttggatgcgtcgtttctgctgtgagtgtccaagtccccttctgatctcttctctttttagctttctaaacttatcccagtactgcctccaggatctttgggttttgtggctttgcatggaagccctgactagttttcgttttgttctgtttctcctgttggagaacaggtgaagaggaggtggggtgggggggggggcggggtggtggtggcggtgcaggggaagggaacaggcaaagctttttttgtttacaggagtgaagagaagagtaacagtgatttatactgccctactacaagggtgaagagtttagacatatagcatctgaggctgcttctgaggcttttttttttctattacaagaaatttagatgcaataatttagttcatgaaaaagatcatgatgaaatatgtgtgaatgagtataatgcatttgaaacttatctatttgttattgcttttgtattccttaaaaaaacacgcagatccaattgtgaaaagacaaccaggattgactgcagtgttattgggctctggctgcctttcagcttgaagtcctttctaatgagagcaaagctgaatcgggggtaatcactcgctgtcctcaggcactagttagcaaaccacctctggtaatttgaacgatgcaaaacatttttttgtcctacatagccttataattactgatcttttgaacctgtcgctttggaataaattgggtcttatgcagctgagtcctgtaatattattttacttgagggtgaagaagttaatgtataacctctttggctagcacttcagatacttcgaaaatgcctttgatatttaatcaacataaaaacaaagtaaattttaactgtatgtcctttcctaggaatattttaatcaaataggctgtgactcttttattaacttctctgtttatttgaatcctctcttttcatttgaatgaggtggtgtcacagtcgaagggaacattaataaaaacctgatttgcctattgatctgcttcaggcattagagagtacatgttgaggtcatttgagaaacacgtcaaagtttggctcaaacatctctttgcacttcatgttggaggaaacagtgctggattttggaggcttgtgggtgggatgtacaagttttgctcatccttggctatgtgcagttgaggttggcaggtctgtgggaccccagtagcagatggaggaagcccagagagttctgctgtgcagcaagactggcccaggaagggcatggacctcaccttgcactcccttatctggcttgttcatttctgtatcctgctctatcacaattcttaccattaagacctttcctttcattggcataacataacatatttctttctttgtcaaagaaagattgtgattttcataaaaaatgagatgcttgacatacagccaagcaaaaacgtgtacacaaatttcatagcagcgttactcacagtagctgagaaatggaaatcaaacaaatgttcatcaactaatgaatggacaaatcaaagatatatatattcgtacattgaatatcattattcaggcataaaaaggaatgaagtacagatatcttgctacatggataaatgttgaaaacattatgctaagtgaaagaagccagataaaaatgaccacatagtgtatgattccatttatatgagatgtccataataggctactctacagacaagaagtaatatattaattgttgccagaagctaggcagggagaatagggagtggctgctaagaggtgtgttatgggatgatgaaaatgttctaaaattagtggcgctggttgcccaactctgtgaatatattaaaagccactaatctttaaaaggctgaatcatttgagagatgtgtattctatttcagtaaagctgttataaaatgatgagtttgaaaaatagaaaaattatgttaatatcgttttgtcatcaccaaaaactaattagttttttgtataaccagttacacaatttgtgacatatattttaaaataattcatttatttactttttatttgactaattggtatagtagtcaactaccaaacaaatattatctgaaaaaaaacaagtcctgtcttatggatgaaatattaagtttattattcagcatattgtgatttcagtaatttctaaatattaccaggtctcatttatgtgatgagtacgttgtggtggcaaagtactcaaatgtgaaagaaaatatttggttagagatccgaattctttttttctataacaacaaacatcttaactcagtaaacttctgagttcgtggcattatggttcaaaatatagccaacacagtttgtggtttgtatacattttcctttctggggagtctaacagttgatgacataaaatgggcagtttcgtgagacatcctacatagggtggctcttgtatttgctgaagaagaagataaaaaacagttgagttgtctcccatcttgattttcctttattgtgacagctgaagataaaaagtccattatataccaaatattatcatctggtatatctgcttccactaagacaaaacaaagatcaggtggcctataagatttcttcagccaaaacacaaacggacattgtggtttcagataaactgaaccgtggctcttggaatgggaagaatgctctctaggcccactaagggggttattataggagcagcagcagttgtttgtggcaggagaaattattcagaagattgctatttctgcaattctgggatgctccagctgcataggttggaactgataataccaagtcagtagcccatctgtttctaaaaaagcccagagagaaatgtaaaaatggcagtcagaacagaggcagttatgtggtgtggactaagacacacagtcaacagttgcttgtggtctctcctcctcgattttctaagtgatggaattggaatcggaattttatctatttgtttcacacaatgatttctgttacaatatttgcaactttcaattcagtttagtgaatatttaatgatgaagatgaggattaagaataggattacatcttgaaaagagactggatggcttcaaccatttaagctcagaccagtagaagacagaaatacttgggagagtgtggttatatggtgtagttgagaaagtttgggttttaaagttagaaatactggggttcttgttcctgctctacctcttcctagctgtgtgcttgtaggcaagacacttaacatctctgtatagtctctgaaggttctcaaggggttgaaatactaattttattaggtgatgagaattaaatgaaataatatgtgcaaagcgccaggcttttcgagtaagtattccataaatgcttttgagatttaacatgaagaaagaaaagactactactggaaatgttatgcccctcgtattatcccttttcatgctggtgataaagacatacctgagactgggtactttataaagaaaaagatttaacggagtcacagttctaagtgtctggggagacctcacaatcatggtggaaggggaaaggcatttcttatgtgctgacaggcaagagagagaatgagaaccaagagaaaggggtttccccttataaaaccatcagatctcgtgagactttcattaccacgaggacagtatggaggaaacggcccccacaattcaattatctcccactgggtccctcccacaatatgtgggaattatgggagctacaattaaagatgagatttgggtggggacacagccaaaccatattacccctagtgttgaccaaatggcataaattaagggagtgtagtcctctgcagtaattctaggacataacccagcagaagtccacaagcaaactgcaacttctgtgttattaaacctgcattatccttttgtcagagattattattgttaactcctaggtcaagttagaatttcctggaaattttatggtcatttggagataagttcccccaagctccttagcagttagaaaatgggttgtattccttgagtcaattgaagatgaattaaaccaacgttgcccataagtccccaaattttaatattggactttaaagattaacttataggaatttggctctggcttgaggaattttttttatggaccctagtgtatgcataacttttaataatacaagccttaatattttcatctgtaaaatgggcttaatttaccttgtgtgagggcgaggtaagcaaaggcatgcaaagccacacatcaggaaatcagtgaatgttaattatctctgagcagggtgctggagtgtgctgtatctttgttctcctaacttttaaatttttgaaactttgaaaaagacaagagatgccaaattagaatgaatattgttcaaagctctctgactttcgggtaattgctttcccagatttagagaggaagatacctctccatacttgatttgcatattctttcttgactaatctcttatgcagattgtttaattgattaaaatgtgtaagttagctgtgattcctgagaagactagggtattggtgtctggacaaaaagttctttgttaacctgaaagcatatggcagacatatcctttcttcatatgctcataaatcccaatctaagcactttgtactatctgaaataagtttcttctttaacttgatactcaattgctttttatttttttaatggggtagggtccagagatgctatgaagtatatgatacatcccttgaaggtttttttttgttttttttttttgagacagagtctcaccctgtcgcccaggctagagtgcagtggcgcgatcttggctcactgcaacctccgcctcccagattcaagcaattctcctgcctcagcctcccaagtagctggtatttttagtagaggtggggtttcaccatgttggccagcctggtttcgaactcctgaccacctgccttggcctcccaaagtgctgggattacaggcttgggccaccgggcctggctccttgaagtattttaacaaggttttaagaggagtgaggaggccgggtgcggtggctcatgcctgtaatcccagcactttgggaggccaaggctggtggatcacctgaggtcaggagttcgagaccagcctggccaacatagtgaaaccctgtctctactaaaaatacaaaaattaaccgggcgtggtggcatgcacctgtagtcccagctactcaggaggctgaggcatgagaattgcttaaacccgggaggcggaggttgcagtgagccaagacagtgccactgtactccagcctgggtgacagagcgagactctgtctcaaaaaaaagaaaaaaaaacagaggagggaggaattgtcaggaattggagattagaatattgccaaagacatattcctgagtcatgtattctggcctgtgcagctagtgctatgtgatgagagcaaaaattgatgattgtattaaaatggaatcaaatattcatttatttcattctgaaaatgtatattaatccccaattttggacaaagtgctatctaagctaggcactggggacagggagattacacataagaattgtccatgggctgtgctttcaaggaactgtttgttttgttgttcagagaagatgtatataaataatgaatccaaggtagaaaagagaaaattactgtttctagtgcagggaaactgggaagaacttgatgaaaaagtgacttttgtgctgcatcttgaatggggaggtgtgatcttgaatgtggatcttgaatgtggagatgatgagctttttagtcaaagggaccatctcatgctgttccggaggcatcagatagtgtggacctgatgtttgggagatcattccttggcccctgagatttctcagtaatgtatgatccgtgaacattttacatacatacatatatacatacatatatacatgcatacatatacagggagatatacatgaatgtgtgtatatatgaattaactgtaattcatatgtggttgtaatttgttttttggccaaagtgcatggagctaatagtcgtgtttttaatatatgtatatatttggccaaagatggcaggcatatttttaattcagttgccatttattataaaaatcctggatcagttcagtgaattatgaacttgtctcaaggatgaggattagatgttctattttaatcaaaacatttgggagcttcccagcagagacagatagacttactcacttcctggcatgtattatggccttgggaagataaaggtggatcatatttgttttttcataaactcatttcaccccagaatctctgacaactgaaaacctggcagagatgaacatctatgattgcttggcctctttatgcactgatcttaaatgttatgctctggtttaaatttggctagctttataattgattatcctcatctcccctaaattcatgccctattgtggtatgaataaaggttatagggtttgggtcattcatatagggggagaggagagttagacaaatacaaatgtatattttcactaaaggatcgctgggttctaaatagtaagaaaatattgattaaagttataagggtggctggtgtttactattaatattcccaaggtaatgatttcactgagaaatcataacaaaacactaagaactttattgtgaagaagcagaagttttaaattttctaaaacgaaatgtcttgaatttagttttgagatttaaaagtaagcttgtggcctggttccatgcccctgacatcacttccctctgcctatagaggcagagagtcctttcctattgggataggtcctttcctattgggatacctcccaaagcctcagtaatggtagtactaagaatagccaaataaataatatacacaattctagtgctaaattttaccaggtcccagtgacctaatgcacatcctcatctaatccctataatgactttgcgagatgggcactattttaacccctagtttaaatatgaggacatcgaatctaaaagatgataaataacctgcccagtgtcacacaactcatagcacagctgggaggtttgccttgctgtagctgattgtccattacctttcaaggtttgggtgaagtaatattccacaatttaaatatcatacacagcatttgtgtgtgatatttaaacaaagcatttgttttcatctgtgctttcatggctttatctacttccataatggcctgtcacaattaattaaatttttacctttgtttttctaaattgcaaaagtaattatgtttgtagtaaaaaattagaaaatatagatgagcaagataacaagaataaagaaatcatcatgatctataatccctattctaggaaaaaaaaagtgctaatcaaaagaatatttactgtctgattccgtatgtatgatgtttgagaataagcaatactacaaggaaagaaaacagatcagcagcgtcaggacctggggtgggaggtctggaccacaggaggacacacaggaactgttttagagtaatggaagcgttctgtatcttgattgtcgtgtggttatatgactgtatacatttgttgaaactcaggattgtatacaaaatagggaattttactgtatgtaaattattcctcagtaaacgtgactgaaaatataagccgatgttaacaccttgttgtgtatccctccacacatttttctatgaatatccattacaaatatgtatcacatatatatatgtctttaaaagagagactctgtcttgtaacctattttttcactcaaaaatgtatcaaaagcatttctgatcagtaatcattcatctctatcattaaaaatgagcatgattatttgaataaacgtattcattattcaaattagctgttgtctggattttctcatcgcagatcttatttttaagctttattggcacatgtttactatgcgaaaaagaaaatctttctcccagaacatggttgctttaactgaaaaataatgaaggtggtcggttgcctaaggtaatgtctttgtgaacattctgtctgttgttagcctgctagtgattaggtagctgaagactccttttcagtacattttctttgaccttgaattagatgtagggctaaggcaggaccaacctgtgtaagtgagcagtcacaagaagttctttttacctgatgttagtcttttgtaatctcacttttaaaaacaaacttctctttcttatgttttgccagtggaaatatttaccattcgaaacttactctttgggagtctaatgaatgttatttcctttaaaaggcacaataaatattttccttctgacctctaaaagtagatggcagaaaataaaattgattgttttcctcataaatttgaatagacatattacctctgtttcaaaaatgacatcagctagatgacttcccaggctaatgacagttttcctgccagacagaacacttgatttaccattgtcatgaagtcaccgtgccaccgtgtttcccattcccattgcatgcttgaagaattgtgatacttaaggtttcctataatgaaaaataagaaaaaactggacagggctcattgttcaccattatgtagagaaagatctctccacagcaaacattatgagagtgtcttcattggtcttgctgaacgtggccagccttctctgttccccaccctgttaacacattctctgcctcttctatgtggattttttttaagtacatattagtttcatgaaggtctttctgcctggagaagtggaatcccccaacttttggaaagccttttaaagtctccatgagtccagccaggtgtggtgtctcacacccgtaatcccagcactttgggaggccgagacaagtggatcatttgaggtcaggagttccagaccagcctggccaacatggtgaaaccccgtctctactaaaaatacaaaaattagacaggcatgggggtgtgcacctgtaatcccagctactcaggagactgaggcaggagaattgcttgaacccaggagacagaggttgcagtgagccgatatcgcaccacactgcattccagcctgggggacagaccaagactccgtctcaaaaaaattaaataaaataaagtctgcatgagtccaattagctaccgtgtttcatatcttttctgtatctaaaattgttatcctctgacctagtagaaagggtctaaacctctgctttctttttagataaacccatagattattttggggggtggttgtgaggtttttttgcaaattagatgatcagtaagtccctagcgccatagactgggccagatgcactgggcaatgtaaagaaataagccatgtcctgccctataggaacttgccattgttcatttgaatttgttgactttgtttctctctggaattatatataatttcctgtttgctatgatccttaccttaaaataaacctgcagtattatcccattcactccttggaatgttctgatttatgactattcagcagttctgtcccatcaataggctctcaggaatgtcctaaattggcaatctgtggactggtgggttccatctagagcctgatagggtggaaccactagacaaatggagagtgtcttttgttgtcgttgcttgtttcagcatccctggaaggataatttactttccaaagcttcattagctaaatgaaactcaagtcttgcctctttagtttaagacaggttcttttaaaaaaaaaaaaatcttgatgtgtcttagatagatattctcttggattatcttcccttttacatgatacagggctttaaaatcaaccttgtgtttgacacgatcaatggatggagatccaggaagaggactggtgctttaggatttcacttcacattgctgtcctctgcagagccttctcttccagttgacatgctgagggacttggaaagggctaacaatctgcttttaaactagcgatgtattctgatgcccagtgcttcaagctgtttccctttttaggcttaagtttgcctggagaggaaagtggagaccttgaatattaaactctttttgccttgtgtgatttgatggtggttttgtggagaattatttgtccttaggtggactctcagcccagtttggaatgaagtcatcatagccacttgtgccaggccccaaacaacccatatagctgatcttttccccggagtcagagacacaaatagaactgtttcagagcattgcagaggggaactctagagaggtttggccgtggccactctcctttctgcttttaagatgaggtgcattgtgcttggactgactccacattggtaaccaggagacaagcagctctagaagatgttgctcctagggcatggggcttctctgcctaagaagccttaggacatttaagcagcaggaaaagaaaggtctgttttggctttatctagccatgtcactgagtataatgaccccacgatttcttcttcttcacattcattttgatgccaattcttttttgctgtgcttggggatttttgtttttcctcttcaggcacttcccagggttctgcacaagtgtcctctgcagtggggtggcatccctgctccctctggtggaaggcctgagccacagtgctctgagagcacctcactcactgcagtgaagcaaaaaatcctgcctagcctgtgtggcgcagctttctattttgcagtcataaccttttactcagctagtcaacaacaggtattctgtgactgcccaaggctggagaatcaacagttcctatctcatggagcttgtattgtagacatgcatcaaaattttgtatctgaagtgcaaataccagaaatatataaattaagacgagctctcctctcccccactgaaaataaaggaagtcttactcaattcttggggggaattgcacccaactcaccaatgttttgtagtaggaaattcaaaaattcagaaaagaccgttataaatcttaggttatttttcaagagacataactaataaatagtacctggggaggcccctggacagtcagcaccccccagctggtagcatcctgggagcaaggtggctgtgccttttgagttcctgagttgctgttactttagcactttacacattgccccaccaaccagctgaagtgcagaaggagtgcaaaaaaagttactttaacccagatgtccatcataaaacgtacaaaacagcttggaaataggtactgtgtcaaggaagctttattatgataatattactaatggaaagacaaaagttgaaccaagatatattgcctccacattcctggtaaaggttcaaaacataagcacagagttactaatgtgtgagctgtcttttccccaattctgtgctaaggaagtgaaattgccatcagttttagtttttataatttctgagcatccacatgaaatagcaagaaagaaaataccctaccctccacctcactggcaagggtgccagcagtgtcttttagattctgtaagggacacggtgaccagaaagtcaggacaaatggattctaccattagccaaccaacaaaatgaattttcagattgttctagacatgagaacaaaagatcagagaagccacaacaatgagatacctgttacacatgtattcttggatctccttcttccactctgtggatgctctgaaggaggctttatttacatgcactagtcgagaaacagtttttgttgaaaacagataacagttacgagaatctggccaagcttagactcacagattctgcccagctaaatggtgggatgtctctttcttagtttttaattgtgggaaaatacacatgacataaaacttgccatcttaaccatttttaactgtagagtttagaatatggatctcctttaaggaggaattaggctactaacagaataaaaagtttaattctttctctcataagtttaaactgacttctctaattcccaaatagacacaggtttacggcaaatacaaaaatctaggcttaaggtgacaaagcagaaatagattatgcaaaaattcatgggaataataaaggtattcttgtatgtagttgatatctgatcacctccttcgcctaagtggtgagcttttgacagtaagggctgtctcatactaattcatatatttgtagcacttagcacaatgcgttactcaaaagtactctaaaactatttgttgcttgagtactatctatttttcagtaaataatcttttgtccattcaggcaactgccctgaaattttgctgtgttatgccttcattatagaagggaaagagaagggtggtggactggtagtgccagggctctgaggctgcagtgctttctccaagggaccatcacaacactgcaaagccgctagagaaatgacagcccaacagacctggtggactttaaacaagagctaagctagttcagctggcacatattttcaagtgactccaaaataaaatgcgtatttgcatcaaacaactggaatcattttagctttggagttatttaaatttatcgacagggagaagagcttctggctttttctatgggtttgtcctgtcaaacattagtctgctcatttcaaagagcaagactgatcaataaggtgcccaaaaagctgcctccagacaaggctggcaaagagagtggtacctcttgtggtttctgcgtggaacccattggcattgcacattgacattcttcaagaggctctttctatgtcctttctggccttttgaaaaggtgccactgtgttttgggaaagggtccaaagagtagaataagatctagtattatgactgtaacctttttaacaaggtgagatttcatagaaaaatgtttattaaaatatgcctctttatgaatatcgaagattaaatgttctgtagttggtgagctcaagtgggcactcccagtcaaatgaattctatattttccacctcaaatccttttgaataagactggagtagacataaattacatgtttctctttgcaaattggccttcaatatttcatgtgccaagaatatgttacaaaattggggcagcattaatatctttttcctaatgctctctaaacagactttttttggtatttcatctcatctgcataagccatttagtggccagcaaaaactgttatgagggagcaaactaatacatcagaagcaaaacccaagatatatttagtgctcagatctaagttattcacaatttagtgtcctttccactgcaggggtcttcagacagtgttctaggaaacatggtttaataatgtcatgtcctgccttcaggtaagttacactgttgttagtgaacaacgccttcccctcttctcagcattcagcctggggtacacagaacctgaatcttcaaactcctaccttcccgtcccccactaatccccgcagctcagaccaactatttgtgttgtgaaaggtcttattggcgtttttgctttaaacctaaccaaaatgactacaaaaattttggtgaccatccagaaatgtctttggattgtagacttcagggataatgaaaattattgatttactcagcaactttgtacagctgtgttgagggaaaacgaaattgtgtatgagaatttaaattggcaaaacaacctaaatccttataaatttcataccacttataaatctgtgagacttcttagccttcttagccttttagtttaaagccagaacagaatatgaagacactgacctatgaaagtcaagtaaacatgcatctttttatcatcacagcaaactgcttgacattgtctgaaattttgaggggaggaggaaaaaggaagacagatttttaaatacacaaattattacaaactggcatctcaggcagtcatttggtctccatttgtaagaccatcctgggccatttagacctgagagtgaagtgattaatagcacggattgaaagaagttattttaaaaagtgcattatcaccttttattttcatgaggtttagggatcaggaggttaccatgatacttagttttattatttaaataacccactataaataaggatttgtcatatttttccacttgaatcattttttttctctgaggtttctttttttaatcatagtatctaggtacttagaatctaaaaataagatgttaaatctttttactcttttgtgctctcagaggacattcataagcatttgttcttcagctgtgtctgtcttggagaggagtcctgcttctgttcagctgttcttttagcctgacagggagataagcccaaatgagatgcatgtaattgacaatgatacctactaatgatatctcagaaaagggccctgcctttattggggaagattttcttggacttaagaagttttagctgggccagtttctgtggcctaaaagcacctgcctcattcacagccctcggtgcttttgagaatgaaaaggggagcctggaccattgcagggccttcttcatctctgattattttgtgtatttattgttcacttatttattgtctgtctccccttctggtatgcttgtgtcatgaaacaatgaattccccagtgcctggcccgattcgtggcctctagaggtgtccagaaaaaaagtttcggtgaatagaattgacgaatgggttcagaattgaaacctgtgagtctatggaagacaaacgaatctatacagaaaaaaattcagaagctggactactgaattttagtattcatttgaggcatagagaatgaaaatgagccattaaaagacagaaacacaaggaaagaaaagacctttatattcaaaacaagtcaaggatagtgtttcaaataccaaaatcaaatgattacagggcacagacaaacaaaaatcaattgtgtttaattcctttaaaaatgtttttggaaagaaataagaaatatttaaattaccttcaaattaatagaagaacattaaaagatttctctttatggctagttttaaaagaaggcaaatgggaggaaggggaagaattggaagacaaagcaaaagaggggaatggggaggaaggataaaaaaggatataaaaggaagtagaggtgacattagacaggaagggagagaaagacgctctgaaaactcaggccacttagagggttggggagttctccctgccctgtgaaatgctattagttgagtcatcacagtttagagccctagacctgccacatgggagggaaaactgctttcagagctgcagaactactgtctggaacaatagccgatgatatccatggagcagatgaaataaagccagaagtcagacttggccaaagggatagaggtttcacacactgttttatcagccactggttctatgatctggaagccctcatgtcatctgcacagtggcgtggaaaatggcaccattcacagtgaattgtcttgtttttgttggaatggctggtagcagtgcccctagaccctgggactgacctaggggccatcgtgatggaattttgggacgtgcaaaatttgcttgctgagactaatacaggttccaaccttggtggaggaagtgatatttaatatcacataaaaccaaaataaattattctctagggagttgtctggttggcatttctttcctatttttcttccttcccaggccagctcaattctattaaaaattctgttagctaaatgtcaatgggttcagcatgtctcctctctgtgcctacacgttgaaattttcctataaaatactattttaatgtattagagataaacagaattttattaatgtcagccccatagatctacacacaacccagcaccctgtctggggttacatttaccagggctagtttattattattctcaattcatgatgacaaaatacttatttggaacacagaaaaatgaaagtggctttgctacttaaactaaattgctggaggatgaagatttgcattgagtactctagctgttagacttaattaggctccacagttttctaaaagaattgaatatagagtgttctctcagttgtctaagaagaattagccagccttgactgtgccaggttggaaaatttactggtttatgaagaaaaggcattttacagaaaccacgccaaagggttttaagctatgctggcacttttgttttgtttaagaattggtagtgttaatgtttgctctgaggaacttccctgggccattagcaccctgtgggctgacattatccaagggtagtgttaaaagtgaactcattttgcaaagttggaaggtttccggtagaagtatccttatcttttttagcactcagccatttaaaagtaacaaccaccatctatatccctctaccttataaacagccaacagcctagccttaatgaaggacctttagctgtattcagatataatcatctgacactaaataaaattgtgacccaggctcattaggaataccacaggcccctcacagtgctgctgtggccacgctttgcactgattcatgcctcagattgattttattatccgaggatataaggcttggcttggatggaatcagtgaaagaggcaaacaccatggctacagaaagggggtgatctcctttctcctcatcataagggatcacagctgacacccttgtaacaaaagacaggttaacaagagaaaagaataacaaatggattgcatgcacatatgtgcacaggaatcatacaaaatacgaaaactcgaagaaaatgccagagggttgatacttaaatcccttaaatgccctcttcattggggagagggaaggagggcagcgagggctgtaaatgaatgaggctgaagaccagtcaatggtttgtacatgatgctgtttgggaattgaatgggacctgagaacagaggatggtttgggatgattagctaggctctaggtgtgatgtttaattttcagtctcttcctctgtgatatgagttttcatctttcctggttaatgaaatttcagggaagcgattgaaggcaattgtgtctttaggggtccagtttctgggtagataaggaaacttcaaagaactgtgtgatcctgtgctttgggagagacagaggattaggggggtggcctccttagttcagcatgttaaagtgccatattttgggatatcattttctgagctccaacaacaccaatctttttttttttttttgagacagtcttgttctgtcacccaggctggagtgcagtgatatgagctcggcttactgcaacctctgccccccaggttcaagtgattctcatgcctcagtctcccaagtagctgggactgcaggtgcatgccactacaccccgctaatttttgaatttttggtaaagatgggatttcaccatgttggctaggctggtctcgaactcctgacctcaggtgatccccctgcctcgtcctcccaaagtgttaagattacaggcatgagccactgtgcctggccaacaccaccaatcttacaaaaaaaaaaaaaaaaaaaaaggcactgtactccagaaaggggcttttgagaagaataacaatgatccccctcaaaaaggagacaggagtagaatttactgtggatttcggagttattatccccaacactccagaggctccttcttatcttggtcagacttcatgagtttcaagatccttctccaggaaaatagaatcaactcagaaactaggaatggagacaaaatccattcctttgggtgcctatccagagatttttgagttgtctgtaaatgtggacctatttactgtgtaatgtctttttctctacaagcaactatttagaaaacatggcagtgcttccattggcaaatgtaaagcagatcttaaattcttatctggtccacatcacagctgtggtcttgctttgcactgattcctgtctcaggttgattttattatactgaggagataaggctcggtgtggatggaatcagtgaagaaagcaaacaccatggaggcagaaagggggtaatctagtctatttcagtctattccaagtgcccttacacatctctctaagcccataacagttgcctggtgtcatcagcttgccttcagatcccatcccctcctgttcaatctctaggtccttttgcagaactcagtgtttttgtgagagcaaaactttcagaaagaagttatttaatctttgaaagctgttgaaactggtttatcgactagtctgaacccagtagaagttcagtagttttatttttctccactcagtgtattaactgcactgtattaaatctctcttctccataagtaacaggaaggctgggatctttgtttcattcattagtgtcattgtcactcaagtgcctaaaatggtgactgacacatggtggatcctcaaaaaagatgtattaaattgaacatttttggtggaacctcacttgttttcattaattaaaaagaaactcgccgggcatggtggctcatgcctgtaatcccagcactttgggaggccgaggcaggcggatcacctgaggtcgggagtttgagaccagcctaactaacgtgtagaaaccccatctctactaaaatacaaaaaattagccaggcatggtagtgcatgtctgtaatcccagctattcgggaggctgaggcaagggaattgcttggacccaggaggcagtggttacagtgagccgagattgcaccgttgcactccagcctgggcaacaagagcgaaactccgtctcaaaaaaataataataataaaaaggaactcagggttgtctagtttaaagcaccattctcatattctttgtaaatctcatcttttccattccctccagcacctgccttctttagttttaaaaggacttggatggacctggaggtcattctgttaagtgaagtaagtcagggacagaaagacaaatattgtatgttctcactcatatgtgggagctaaaaaatgttgatctcaaggaggtagagagtagaatgatggttaccagaggcagggaagggtgtgtgtaggtggaggaaggaagaggggaagaataggttggttaatggatacaaacatacagttaggtagaagcaataaatgttagttttgggtagcacagtagggtgatgacagttagcaacaatatatatttcaaaatagttagaagatttgaaatattcccaacacaaagaaatgataaacgttcctggcgatggataatctaaacaccctggtttgatcattacatattgtatgtatgcatcaaaatatcacatgtaccccatacatatgtacaaatattaatgtatcaatttcaaaataaaaataaaagacttggattggggagggggtgcttactctttccatcttcctccccttcccttgccttggaaaagggtaaaggaatttgatttagttctgggacactcttactctgttcttcttctcattctccttcccttcctgtattttagggtggggcggagatagtgtctctcacaccactgaccatggctgccatcctctctctggagatgtgcctgcttctgtggtacccctgactggtggtgggtgcctgccaggtgggagacatccaaatactggccttttcatggtactcaagggaggtctccttagagccccttcaggggactccctgtcctgtgtttcctggctgtaggagatacaatgtcaacccggctttatcaagccacccctcagctccgctcctggtggtacagcccacagcctttccttcctgagctcccttgacatgcaggctgcccccttgagtaggaccctggcaaagggatgtagacccactggtgcttgggaagctcgctcatcctagcctttgctagatggttcctgacccctcttgccctaccatttctctccaattcactttttgcctgctcagggtggttgggggactcagggctgatcagcaaagcggctgaccctgcagtcatccagctgggaagcaggatgccaggttctccttcaagctggctcctccaaagtaattctcttagatagtcacctttctcttgctttagttgaaagaaaggataacaatgctagggaaagaagaagggaaagctgtagctactctcactaggcagaagacccggagctaattccacctgctgtcttctttgtcttctctagactgagaaggaggaaggaggggcaagtggggagtgtggtgtcgcaggactattctaccatctccctaagcttttccggaggtgtcttttctcaatcattagtactctgtagactgcagtgcacttgcccatctctttgaccttagctttgcttccttggtcaccaacatagggcaacagaacaagtcctactcaggactctgctgcacagctaaagaaacagatctccacctctcttttctgacacttttaaatccagccaagcaggggctgacagcgccatagctaagtccctctctgtacagtagagtggctgctgtgtgtttacagtcacaagatatttctgaattctttgcttttagtcttgcggttcattacatatgggaaactgaggtgtatttcattctttggcatagctcctgatgataactatttattttggaagggctttccttggattataacttatcaaaagataccagagcaataaggtataatacgtcaaggaaaaaagaattcccatttttcctgtgtgtgttcattgggctctcactacagcattcaagtcagtataagacacgtttactgacagctggattactccgggtctggcaaaagagcttgaatcgacacttctgctaaatttctcagcagtacattgaatgtatatttaacgtgtgtcataaagatgtgtgcagattgcttgaggccgtccgtcattaaaggcctgaatgtataccattagccatcacactggtggtacctccaatataattgaaaaaggtttagcaatatatgagcatatgtaatgtttgtcatttctattagtactctaattaaatcagccttctaatcagacaacttataaaatcgtaagtaatatgattagagcaatataggatgccaccctcgtattctgaagcacagttgggtagtaactttttgatattgttttgatgaatggatggctttgctcagtaagcaggtagtccagtgttgagattctgacaaagctggctttctctgagtcctctaaagattccaggcaaggcggtttccactgttacacctattaaggaatggaccacgtttcctctgtaatgattgcagcagtatcttagaaattctaaaccctaacaccatttcctccagaaaaataccagcatatttcatttataagaaaaatggttgtagataaatcaatagaaatctcaattatatttattaatgaacaggattaagttggattaacatttatcgcccttacgttttgattatatcaaaactgcagcagagattgcagcttgggttgatccaagagtggccctttacacgctattggctttcagcagacaaaattgttcagcagcagtggcttatactacattagtctagaaaccactgtttgagtcagccaaaggtgggcggtctgctcagagcccgctgggcagagtgcaggatgccaggtcaccaggttggacgtgagggcagactttcaaaggctccaggccaccctttggaattaaaatattgattaagttcatcatctgtggaatctgtgcagctggcttttgtcccacattgcaaagtgtgatcctaaatctttgagtctttcctttcctacccttaacaacaataacaacaaaaaataataataaaacctggctgggtgtggtggctcacacctgtaatcctagcactttgggagactaagttgggcagatcacttaaggtcaggagttcaagaccagcctggccaacacgctgaaactccatctctaccaaaaaatacaaaaattagccaggtgtggtggtgcatgcctgtagtcccagctgcttgagaggctgaggtgggagaatctcatgagcctgggaggcagagattgcagggagccaagatcataccactgcacttcagctgggtgacagagtgataccctttctcaaaaaaaaaaaaaaatagtaagaataaaaccctcccctacccttaacaacaacaaataataataataatatacagtaatataataaaaacagtaaatagctgccatttattcagtgcctcccatgtggcaggccctgtgctgtgtgctttccagtatcagctctggtctctgtgccactcagagaggattgggctcagtgagtgtttacagcttgctcaaggtcatacaactcatccaatggtaaagtcaggacttgaacccaaggtacagagttctccacgttgcctccatcccagggtgggcctaccccatgtgctcatgaaacagactcagatgtgtttatagccacagtttccgatgcttatcaccctgctcttttattgcttagtctttaagcaacacaaaaagatctattatatcattacagttcatttttctcataattgtattctcagcggatgcaattgacaaattatcgagtttctcttgtctccctgacattcttacttagttttgaaattcttttacatgaacggttctcataaaaagaaacattgttacttttcaataggaatccactcaagtccccaacgcccactgcaaacacaatgcaaatttgcccacaacacagacagagaataagcaaattcacagcagaaaaactcatccactttacaggccagacttaggtagaactgccatagtgcccatttatcccaggatatccaccacacctcctaacagtgtgcaatttcagaccagccagacagaccttggtgcaagggacatgtccaggtttaaactttctctagaggataaatcctccctcctgtttgttttctgtgcctctttcctgcctaccacagtggcagcctatattccaacatggaactcagagaagatagtgatgtttgctgattgtctgaacaacacattgtccctgttctactacctcttatgtattagaattgtgattcccaagcttgatcctgtaacagactcatttgggagcttgttaaatacacattccagggctctaccccagaatctccaggagtggggtttagaaagcatttttacaaaagctctccaggtaattcttttggacagacactgccgtagaataataaatggaatttaaaataaacaagagcttatcagagctctgcaaaacctccgtgtccactcctgcctgccatagggagctagaagactgtgtacagaaaactgtttcaggagttaccagtgcttttgtctcttttcttccggaagccatttaaaataaagcttgcatcgtactattactggtctaattgctcctgtaaaaagaaaggaatgaagattataatggaagtataaatgcaacaccttttaaggcaggaactatcttttagggatagtatttttaaacccccattgcttttagcaaaattggtgatggttaagtagtggtgagaggatagaaatttttaaaaattgatattaagagttgcaaggcattgaaaattggtaattcaatctccactaaaagaaaaaggaattataacaataaaaagcttaagtgattagtgcccagtaacaaaaatcagacagctgctcagcagcgtcccttcctacaagagacagaaatagtccggtggttctcaattgaaagatgggctgcctttcagcaggtgggttgtatgttgggtatgtggaactcagaacatatttgcccttagatacaaagtagcctcactgtgctgggtacctgtcccacaaaggactgggcacaggagattttgggagggcggctgcttatcacatggggcgtggctgagtaatcattttgaccaaatactccctgtggcatgctcaccagactgctggggccgacagtgtggtccctctgtctatagtcttggcctggtcttatatttttccttggctggtgtctgttttattacttaatccgtgcaccattcaccccaatcacttttggcaaccacactttctttccaacagcatctaatacgctcagcatcgcccatttgctcagtagctcttcactgctcgggccttgcgtgcatcacagaacggtttgggagcaggcagacctagctttgcatctcagatgtgtcacttattagctccatgagcttgggtatgcaacctcacatctccaggcctctgttcttatgtgaaaggggaataaaagtactctgtgacttattaatcagtgcactcaggtattagaaagtgtcctgcacatacacttcttctccaggagctttggatacaagagtctgtggtaaatggttcctcccctccatgttcacagtctagtgaatgaatgagacatttgtttaagaagaaaagtcacgataaggggtatatactccatggtgacaatggtgacaacgaactctgcttttatcccttcccacagcagcgtcctttccctctgcccccttcataggcatgccccctcctttagtcctctttattcttgggatgacttactcacatctctgtgcttggcttagaagttgaaaaataggcctcgtatttctcattttattggagactctttttagcagggtcaacttggattccaaagaggaaggaatgagtggagagatagggaggagaagctgccaagtgggcatgggcgtgggggtacaggccgtgtttgtcactggggacagctggaattattgacattcatgacctgcaattggagagtaactaaaatacttcaagttgtgagggtgtgtgtgtgtgtgtgtgtgtgtgtgtgtgtgtgtgtgtgtgcatgcgtgcaggcacacatgatatattaaaaattaatccttgggggagattatatagagcaaaaaacgagagcagaaacattaaacccatctttattttttctgggagctgtacagtttaagggaggctttttgccttctcattggacaaaacctgataggtgaagtctgggaagagccaccagaataacagctttctcctttcacttctggattggagaagtgtagggccaagtctcctttgaatttcacatggggcctctcatttccctaagaggaccctttgggtctgacaaatgaagatattttcaataaaaatctctcattagcttggtatcttagggccaagttttgcttttgaagattaaactgttgtcctggcagattggtttctacataattttctgtgcatgcggagctggagctgtacgtctccactggctacatcttcactataatgagattctttttgggtgtgtttcctagggactctatagacaaggacctgtattttttttatgccagtaacagtgactaagacatatgagcatccatcatttgctctctaaaatggctgctcagtcacagctgtgagatgaacacagggatgaacttggtcaggaagactaaatcctgttcatttcatccactgattaaatatggcgttattctggaaaaactccttagaactgatctttctctactcatgccataggagcccaaaaatgtcaaatgaatacactggcaccaagattcctaggagagaggcaggaatgtggatttcaagatttcttatgagactgcgcagcattgtgaacatcctgaataaagaagatatgtgttcagtgacaagggtgaacagcctcaattcatcctgcccttgaggttcttttcagcccattgctagttaagtaaataggccagcaatttagcataatgctctggtagcttcaggttttgctgtgttagacactcatttcatgtaggacacacaggcttgccctttttaatgttattatcacgttttttaacagcactaacagcacttatggccctctggatgtacacgtgggtgtctaagggccccctttttggtgataccattaattcaaataagaagatggccacatagaagacaggctttgcccactacatcttccaaatgtcagtgtcttgtgtttgacagtagagatccttataaatttgaagcctcgttcagtattcacattggcgagcaggctctagctattgttggcagagtgtctgcaaacaatatttttaggagcattggaattaacttttttaaaaattaatttctggttttagaagcttgtcatggttttcctttgcttgacagatatttattgtgcatcttctatgtgcctagcactgtgcaagacactggggcacaacactgaacaaaacagagaaaatccctgccttcattaagcttattaaatacattcaatgagtcaattaaacagtatgccacaaagtgatgtatattaatagggaaacaaatcaaacaactagggcaactaggattgggagtgccaaggaacagtggtgttggcaaattaggtgagtttgaaaagaaatttggatacaaataataggctgaattctgcccaatgactgggctgtagatacctttgtgacatcatttgtaccattgtcttgttattttatttgatctttcatgctatgtcctgcttctgttagtagtttgtaagcaacttgaagacaggaatgataaatcataagtcctggcttcccctagtagtacacattgcaactgctccccacctgtggattggattaaatgcatttatacctccccatcagcaaaagataagtgtgaccttgtgcgtggctatttcctaaacctgtatcaagtgtgtgatgggggtgtgtgtgatatttaggatattcttcctaaggtagaatggtggtattgttgcagtccttcgtcgaattgttcatagtaactctctccttgcagcactggttggactatgaggaaaactactagagaccttttcttttctattcctcctctggaaaaatttgcttccttagcctaaaagtcacaggacagacggttagtaacggcttgacctaaaccaactgggaacagttgcctccgtattcatatttagctctgaagagcttcagaccttgtggtctgatccaagatattccagctgctgtcaggaaattcttttttatgttctttctaaatttaattgaagtctatttgtcttttttcgaggtaggctgtggaagaggcaaactagttgatgtgattagcagtgagccctgtcatggcctgtcaggagcctttctcttgatgctttccaccctctgggctgtgtgagggatgacacaaaaccacctgtcccaccccaaaagatagtctgctgtgcctcctcactgggcttccaggacattttctccaagcccattttactcagggattcattgattgtaaggaacaacacacatgcagaagagcttaaaagagaaagagggatgtgttggaagcacacagatgtatctaatggaagctaaacctggcagtgcgccacccttgcaaggggtatgtaagtgaagtcatcataacagatgaagcctcagacctcagtggctcaggacagcaggggttgatgtctcgtgctcagaaactcccacagctgggtgaggcaggctgtgctccacacagtcattcaggggtccaggatgtcaaatctctgctgtcttcccccagacgtccccagccaggcagctgataggagagatgagtggaagatcgagcaggtggttttaggggccagtcacaaaagtggcataaatgatttccacccataatcccctggccagaacccagccacgtggttatggcttactggtcgggagatgaggaaatgaagtctagctgtatgcccattggtaaagggaagtaggtttggaggacagttagccatctctgccataaccaggaacttgaagtccgtctggagctaggtgagccacttcctttgccctgccagaaaactgtgtgtcttctgtgcttgtttctgttcagatgaggagagggacagagatggtttttagtgagtaaagaaacgcacatcctctccctcctccatgactttgcagtcctctgtgtggacactgttttagcttgctggaacaccatgctgggcttcggtaaggcccttcatcgccccttgctcttggccaggggtcaaaggtcagctgagttgttagcatattctgtgcaggctcatctcagacagctaacaacaggcactgaaataatgtctgtaaaatatgtgagcaaagacagttctcccaggagactctgacctaaattttgagccaggctctgcaaatttgcctctttaactaggaaaagatgaaacaaaggacaggttccttcaattcacatctgttcagtcctgcctcagctctagataatgtgtgttccttaatgcccccaagggagagggggctttaccttctctcctttcggggtttctacactgtatcttctccccagtatagcagtcaacacaactcccagctcctaggctcagccgcacagctttaagggggttcagatgagtttgggatcaggcatatattaggaagcatgtgtgtgtgtgtgtgtgtgtgtgtgtgtgtgtgtgtgtgtgtgtgtcagagcgggggtgggggagctggagagagagagagagcgtgtttaggaaccgctggggaacactgcagttccccagtgaacactgtccatttcccctgtttagtgtttgaggcagcaaagctattacaggaataggaaggacagttggcctgacccaccccatagaggtctgtcctacccctattgagactggagaattgtcaccaccttcccacaccagaggcctcttccacagggccatgtatactgtctgttttataagccacatctcagaaatgttagggagtatggaaatgttggggccagtgccatggttgtatgttgagggagtgaaactctcttctcaggttcaggagaaggtattacaagaagaggaacccatacccagacagccctgctgttgtcctgcattgttgagggaggaattatgtcctatgtgtttgtagtaacagaatccacagctaagaaaagacaagctcaggagggaagtccttgggtagatgctaaagagccttctctttgttctttgtgccagaagctataggtttctaattatgatggcaggagaagtgtccttatgaagtgtgtcgctgtgtataaaaatatctctatgttttgttattgctgtgttctttgtgtgatagatgttattaggagcacactctgtcctttccaaggacgtaatctgactgttttctgtttcctcttcttttttgctttgctttccaacctgatgatgtgctgctgtgttctgttgcaatgaaattccttcatctgtttcacatcgcaacaaaaaggtaaggaactgcaaaccgtattaacatgctgaaacagcaccaacttatataacatgcaaaaggagatgcattttaatcactgggaatttttttactttaagagaaaaagtgatggattgtgaggacctcaattctcgtattggtgtttggctgatggatttcacatctcctggggcctggtgttgaataagactcaggtttatgtgtgtgatgggggaggaagtcaggggggaatctttgtgtttatgagtttttgtcagcagctcacaaacttggagaaacattcacagacatttcacagttaagctgtgtaaagacaaaaatattaaataaaaaggtgagagggatgttaatattgctttggctccagactttgaagcaaaagtaattcaactaataatgagttcattaaatatgtgtcatgataggggagaggccatttaggttctttgccaaatgagaaaatttgtaattttgtatctgctaatcacatccacctaccatatattcttttttctctctttgcctattttcggtggcaaaaaaaaaacatataaaattgaccatgttaatcatttttaagtatacccttcagtagcgttaagtattttaacaatgttgtgaaatagatctccagaagtttttcatctggtaaaactgcaagtctatacccattaaagaactttccttttcctttccacctcaggccctggcaaacactcttctactttctgtttgtaagaattaaactactttacatacttcgcgtaggtggactcacatagtatttgtctttttatgactgcattattttacgtagcataatagcctcatggctcatccatattttcgcatgtaaccggattttttttcgttttttaagtctgaataatatttcattgtagatatagaccacattttgtttatccattcacccactgatggacatctgggctgctttcacttctttgctactgggtcgccgtgaacatgtgtacaactttcccactgtatcttttgattggatgaatggatggatgtgtatatccattccaaaagtcaattttcactgtctcttgtattattaaattttcaacacagccaagccaagcattagtggctccttaaggctgaacactcatcttgaggcttagtggctgtcaggttcctattccctgtcctataacccagcatcctttctcttccctacttctctttcctacaaattcagggcagaaggctgtggaagcacatgttccccctgcagtccccatcaccctcacactggaatgattgtcctttgtggcacacgttgttgcaagtattttcgtaatgtgtatcatttcatgtaaatgatgtgagctcaagattagtcatgaattcaaatcgtgttgctttgttgcttggaagaagctcattttattgcagtaatccataccaagaagaagaaagcaccctatgatcctgagtagcagacggttcctgtttttcctcccactcatcactggggcacactggatcaggcaagggagaacagtacctgagctacagggctatgggaacaagaccttacccgtcattgagttgaggttctgatggtgaaaaagggctgttttcccaaagttctcttgggtgctgctaactgtgtgagaatagtggaaagggtgggagctaaggaggtgagtgggtagggagattttggtaacgctggagcttgtggcaacccatgtgccttcactgcagtcccagattttctctgggaacagcttctataggcagagttggggttcaccttcagatagccaagttaagaaaaaagtaacaaccattctctgatgtttttttaaatgtcatctgtaaaaaagcatcaagaatgtgcttcttaagtggtaatattagcagatttgagagtatgtcctagactggggacttgacacagaaaacagacttgggcaacagggtctgcagagattgagcatgggaagtgcgatgtgttgagcccttgtgaggctccagagcaagataaagatgcgcccactgttcagcttcttaaaatacgccagctgggtggtgtattccctgggtaggcagggaatttgctccttagataggccccctgattcaggatgtttagtgttagtggcagtttaagccttcgagagctgtttgggagctattttgcttaccagtgcttttgtgtacattcctctgtgttctgcgtgggaaatcaaggacgtgctggactatgcaactgccagagccacctgcaatgccatggaggcaaggtgatttaacacccagagttccacttaccgattagactgtttgctgagaaagcgagggccagctatttcttgaagatcagtaatggggagattggataacaggttttctggcatgttatatgggtctagggagtacctctttttgtatgtgccccaaaattagtatcattgataaaatgcaaggaatctcccttgtggtttcatttacttttacattaatttgcaggcacaggtggacactggacacttaacttgctcaggatttttattttagtgcactttaaattgaaattaaaaagtaatactgggcgtggtgacatgtgcctgcagtcccagctacttgggaggctgaggagacaggttcgcctgagcccaggagttcaaggccagcctgggcaacaaaacgagatcctgtctgtaatttttaaaaagtaatacatagcatgagtggcaagaatgggactgctgagaaaggagacagtttgagacatggtagtcttcggaagtccatcactgcaaaacatgcaagtagaaagaaatacacagctgccttgggttttggctagagatgttattcatattgggaattataaatgagttatgggaggggaaaaggaacaggtgtgttgggctgtggggtgggcgagaggcagtgaagggaccctggctgggtccacactctccagagggctctccttcgcatggtgcaggagcaaggccccccagtgagacagggctgggaactaaggagaacttaagcagactgggaaacagaatagttcctgtggggtctgggtcaggaagacgaggaggcatgcgtgaagcgtgtctgagcaccatccatgcttctcaaagttggtggtgtttgaatcagtaataaggcagcttcacaaagatttgtcttctctccgtctcagtgatctgtgacccaggcagaggaatggatagagtggatggtgggaatggtctgaggccaggaattggcttgaggggtttaggaaaatgctagcagtgcaggaggctgggctgtggagagggtggcttccaattccttaatcctgagccttggaatggaaagggaaggccggcaatagacaacagagggataaatggtcccagtgcaagaggaggagctgaatggagtggaatggcgctgtgggcgtggtcagactggggacatggagagaggatgtgtccaggggaaggccaaggctgacactgaccaaacagagggcagctcttgcctcttctgaggaaggtgggaacgtggacagtatgcttagagagagtcacgtttcaattaaatccaagaagggaaggaaagattgaaaaataggtatgggatacagagtagcttaaagtagtcctaaagcagggcatagcaggtagaggttgtagaagggaataaatctttcctttaaaaggaggtgggagcaggcagtggccatggtttctttccccttcaagaccagcaaataaaagaacatgagtaaaatatagaaatcgcttaaataacatgaatattttatgttctccatgttatctggaaacccagctgtttgctgaccattaaaagaagacagttatagacctggtagtaagttatttaaaaggagaactcagaaaatgtatttgttgaaagatgtttcttgacttgaattctccattatgcttttggcctttgcagaaagaaggaaatcacattatgtacaaacgttgttaattactcattaatctgacattttgatggcattaagcaacaaatattaatttgcgactcaacattgtgattgtatctaaaatgtaagacatctccaaaaatatgaaacctacatgtcaaaattactttcttcaaagactgattttggcaaaactcattattagagccttctgtactttaaaagttttaaatgacacactgcaatttacagaattcattatggtgcacaactaattagaactttaaaggaaatcacagtagggaattagacattttaaagagcattttcttgagctgaagtgttcttcaggataaaggttgttttgcagtaaacgagacacttggattttacatacatatatagacacacactctgaagggtagcatgtttgaccagtcgtgttcggaaatcattcttgttctctgtttagacaaaaggaaaaagcaacaaaggcgacaagggaggggcaagacagaaatgcaaattagatgtccgtagcatacttgggagccaaacaaaaaatgcagacatatctaattagtttccaaagccagctttaccctagggaaaaaaaaaaattctcatctaagaaaacagcagtgcgggccgtgagtcccaggtgtatgggtgattacagcagagagcagagaaagccactgttgttaggctcagctgcctctgtgctacacaaatgtgcttacagaaagaatataaaatcgaccatggataactccctccctttccccaaattgattaatttctcgacgtgctggcaggtttttccatggatggggatcgagtttgagagatgaatgtgtaaatcaacagcaggtgggaagttgaatttgtctggcccagctgctgttccccgcatttcctattctttctggttatctcagtccagcatctgtcatggagcaagactcatgggcttctgtcatctcaggcctggggagccacagtgttgcctgtgtcttccaacagctcagtgctttcaaatagcaaacggcaagaatgacggccccgtcactattagcaggaactgccagagaattgaggagggtattttttatatcatgtgttgagatttctcttgattcttgatgtggacacatgctttccacttcaccttgcatttggatacttgcatgatctgggctctttttacaatacttcctttcccaaatttattgcataataacactcatatttgaatgtgattttctttgtattttaatcttgctgattgtacaacggtgataaaaaatgacctgctttcttgccccttagattaagttttgaaggaacaatgtattttccacacactttggaaatctctgtggaatttaatcatccagccgaaacacaatttcagcatttcttaacatcatacagttttagtgttgggcgtaaccttcagaggtcaacttctctactcttccaatgtaggaatccttctgcccgactcatcacagatggccctccagtctctgcctagcataggtcgatgaggttgattctgatatggaggcaaattgccaatgcctatctttgacagcacttcaccattggggaattatcctagtaatatttagcttacctttcttagacaatagggttgctgtttctccaaggctttctttgaaagagcaaacagactgccttgcttgcttgcaatgttgcttggatagatcttatcttctaaataaaattacagttactaatgtcatttagaaatattctacagaaagtattgactgattattactggcagaaagaaagtcagatctttgatatttattataaaagagatgggtgacattgtcttaagtttagctacagcacaaaatattacattcagtgctacagcaggatgtgatcactcaactatttagcttatgtatatcgtttatttttattatttgggcattgattttctctaccatttgtttccacatgaagtcttttttttttaacaaaatctaatttctcataacaagcagaaatgcttttaaggaattattctttttcgtcctgtcaagttgcaggaaacatcaaatattgactgtaaactgttatcaatttcatatgtgacaaggtctgccatctcttcatgtacacatattttcacggcccttaattacttttttattctttaaaccttagctaaagtatttggtatactacatttgtttttatatagttatttgtaatcttttgggtagagaaaataaaaccaagtattattatctacagctttccaacagaattggcttcaaaaatctttctgtacattttcagcaaaaaaaaaagtcatcagaaaggagaaaaaagatttaaaagaaaatcccaaattatttggaaaattgatagaaatagactctcacccatagaaatgtggaatattcaattaaaaacttgtaaagaggctcaacattgttttctagtgatattttaatttgtcaaggaaaagattatatgcagataaaaaattgtaacatcttagagttagaaattccctggagatcaaacccttgcagcctcttcatacctcaagtgataagcagtttgtcaccattatcacaaatatttgcagagcacaaattagatgccaggcaatgtctccagtatgggttgcaaaattgaacaggacaaagatgaagaaacagcgcccattgtcatggaagtacatttgtgtggactatctgccatgtacacaacaagctgagttgtttaaattttgctcctcatatcatccagaccctgcctcctgtgtcctcagggactcatagagctcagagttaagattatcttggaggtcttctaagccagccttttacaggtgtaggaaacctctctgtggaagccatagttgaacactgtcccatggatgggctcaaataggtcagtgtttctggtaaaactgagcacagccttccacctgtggtccagcattatgaagtgaagccatttcctctctagttttagacactagacatcccccaaggaaggcagcctgagattttgttagctgctgcacatagttacctggcataaagctgatggtcagctgtaaaccttaggccttttataacatgcattgcttcggagtcaagcctcccacatcctgtacttgtatattggattttttgaccctgaatgtaggactttgcattaatcttgtttatgtttcattatggttaaaattggcccacattctagcttattttgagctttatgagtcttgattattttctccaaatggttttgattgattacttcatttgtaagtaacttttgcgtgttctccttccatatatgtgtatttattgttttataaattatatgtatgtgtcattagctaatacctcaaggcacagtatatactaaaggcaagatacaaatagtgaattaaattcatatttcacatcatcctgaggatttcattttttttgtttttttctgatcagatgttattaaatcattgttgtttttatctggtaggacgaacatagtgctcgtactaggaatagtagaactatccattctgctatcttcctgttgttcacttatgctttcattattagtattatcttcaatacactatgtttttgtgggaatcttttttgtaagccagctgttcatttagggaagattggtttagttaaaactagaaaatgtattgcataaatccacttaacagagctcaactaaaaggctgtgtgtgataatacggggaagagaaaaacagatgagagaaggccctccagtcctctgctgtgatgacctactctgcccttagactcgcatccctggcatgacatgccatcctcccagttacagaccaggtggcagtatcgctgtgagtcagggcatttaaaatgttagtgaagctggccgggtgcaatggctcacacctataatcccagcactttgggaggccgaggtgggcagatcatgaggtcaggagatcgagaccatcctggctaacacggtgaaaccctgtctctagtaaaaatatcaaaaataaatgaataaataaaaaatagctgggcgcggtggtgtgtgcctgtagtcccagctacttgggaggctgaggcaggagaattgcttgaacccaggcggtggaggttgcagtgagctgagattgtgccactgcactccagcctggcgacagagggagactccgtctcaaaacaaacaaacaaacaaaagttagtgaagctgaagggattttagtttaaaaatagacagaaagtgctcaagtactgccttcccacaacgtagtgagccgccttgcatacctctcggtgctatactcaccctgctttagtgatctctcctctcgtatatcagttgtctgcaatttttttgtcatccatattttgacagctcacttttaggtgttcattccagtcgtatataaaagtaggagttgaaagaaggattaagacaaattactggaacaattgcgacctctttctaggttgacatcgatccatttatcaaccctcttgaggtacggttttttaactagatgggaataagcttaactgttttgacaaacggcccctaatttttccgtctgggctagaagattatcataagacatacagtcaaacacgttgattctagtggtaactgtgactaccacttattgggtgcctccccagtaacaggcttagtactaggctctttacaaatgttatttcatttgtttctcatggggagcctatgagatgggaatttgattcctgtgttgggaggaaaaagttaggaaactgagacacggaagggtaaatttgggggcagctgtaagtgtcacatgagcaggctttttgacattagagtctgtcattaggaaatgtactagggcatgtccaccacataaatccctagagtgaacgacaagatggtttcaaaggatgcagaaacataagttttaaatcactgtgttctctgagtatgtaacactttacccccttttgaaaattgggacatctgcatgtctgtaatatgctagcctccctcttctctttgccacactgcctaggggacaggtaccagtgtgtttttggttcatatgcatgctcctttaacaacccaggtagaggttgccaggacctggacacaggaacatgtgcaaagtagctgggtgccctcttactctatcctcacctacctttgactgcagtccccctttgctgtgtttatctgtgctggttggagaatcatttgaggaaacagagctgttttctctgccatctgctgctgtcttgccaccttccggaaacagtggctttctgttctctggcgggtgtgtataaaccaagcaatttagagttaggatactaacgtatcatttcaaatgatacgttagttattttcagtttttactgtaaattttcaaacgaattttaaaaatcgaaaaaatagtacagtggatacctatttaccaaccaggtagattcaaattaatgttttccatatttgctctttctatacttctttttctgaaaatttaaagggatgcagacatcatgacacctaactcctgaataatgactgtgtctcagagttgtatctgctaaaaataaggatataatctctaaaataaggtcattcgcctacataactgcaatgccattttcatacataagaaaattaacacgaattctctagtatcgtgtaatacccagtgcaattatccctccgaaatgtattatgtatttttttccccaaactaggattcaattaggtttcatacattgcatttggcttttatatctccaatagttttagaatttaggcttttgttgtgacagaggtgagaataaaagatctggatgattttcaaaaaaatatttaaatcccatctcacatgaaggatgacttttcagattaaatagactattgatctagattattccggtggttttttacttggtagtaaatggcgccggatatgttaaagttgtaaaatatagaaatctctaaagtgtgtacatgaaccacatcttaacagaggcagtccatcaactgtaaatgtacatgggacctgagtactttgatgctgttgtatgtgtgagaccatctcataagcaaataatgcatcaagggttttggctcagcactggtaatggattataatagattgaaattaaatatgatataagtgacaggaaaattctgccaggtaagtaaataattgattaatcatcccccagttaaacctggcaagttaaattgcagggctggaatcgaatgcttggtagaagctcctctccacattttagtcctgataaaaactgtgctgaagaagaaaagaaaaaccagaaactgttcagaggaagggcctgtcccttgctgtgtcttatttgcggcatggcattgtgtgtattcgttgcgctgtggaagtagtgataagaaaatgaagatccaggaaagagctgtcacagaaaacataaacaagtagagatccatggttgcttggaaatcaacaaatttagaaggcaagtgacagcatatctttccttttttcattttgttttgattgtgataagtgggatcaatatgacttagcatagcaaaactggtcccagtgtgtgcgtgttactgtgtagctgccactggacggtcaaatgaccttggctcagtcactagcctgccagtagtctgggtgtctggtttctaatctgtaaataatagacttggatgggagatctctgaggtgccttccagctcttcagatctaagattctaacagccagaaacctctgtaacatagtgctctcctgatttcctcgtgtgattataactggtctttgtcatgatgaccctcggccgttacagtcttccatgtgtctcctgagtcatcaaagaaaaattaaggtgtgcacttagtttatatgaagcatatgattttgttctacttcttaaagattagcagtattcccctaacactttattaacgagaatgctttatgaatcagaatagtccattctgtgaccatgtagaataagagaaattttattgtaattagaaaaagatgtatatattttaaaaaatggaataaccactaatacattaaagttactgcttaaaagcccttaatttacagtaatgcagcaacctaagtgaaaaagagctgaccctactcattacccaaggcaatgttatgttggattttaattataaagatcggttcagcatttgtattttctgggtcagcagaatatgtcctgtatagcctttaacaaactttttagacttttaaagctatgatttctgcactgtaaaatgggaaaaatacagtacatgtgtcaaagagtagtaaaaggatgaaacgaaatcacaaatcgtgtatgtaaagagcctggggcataataggtgttgagaaatgttaatgatcatagccattgtggtatcactgagtccttggcaatttcattcagggtggagagtcctccaaccaatctgcatgaccaggaatcaagactcattatgttatgtcagtcatcttaattggctagcaacattggattgaccttacagcaattcactgactacctcataacctgagaaagatagatacctccacttagcttaatatggaaaataagaattcataatacactgattcaagctacttgaacattttgtcttagaaaagattgacactcattcattcactctttccattttactgaccccagaaatgccaatagcagctgccttatcttcaaatgtaaacatataataatatgaacaaagaattcacaaaacagacctttgtggtaaaatgtgatgattattctttatatttgaatctgagctagatcaaatcacatttccctaaatataaaaagcacaaacggcaaaaacatgatacaattcaggaatcatgctcaacgctggcagtacgatacccattcactacattatatgaaatgatttagtatttgtttctggaacaattgccaaaaggaaaaatcagaatctcccactcaatctttcatcttagaaactttaaaatactcttatccatattaatgaagacaactccaacattgtgaatagtgggcaagtgacactattatcctgtcttattggctctctcctcttctttttaaacacctgtctatccgtagtcttcttcattgctatacaattagaaaaaggttagcttttaatattttccaagtccatgtaaagaagggtttctatttccacttcatgtgtgtgtcaattgaggtcagaatggcattatccttgtgtgattgggagcatggaccccaccccacccccactttcctccaccccctgagaaacaggccatgaagtggtaagagtctgtgataatttaggcacatctaaaagcaaataaccctctccggaggcagtttcttgaggcaccagcatcaggatttatttttctggaaacaagcatcgccatagaaattgactctggtgacactccttttttgggttggaaaatgtcagagtctttggttttaatcaaaattgctcataatctggcttaacgatgccataaaggccttggtttgctctgccccaggtgaatgaaaatatttgctgtgaaaaataggttattagttttatagctctacctacttcaatgcctctatcaagagtacgagaagagatattaaatctcaatttttaataaaattattgacatcattggggagctttataacacttgacatttgctttcagcgttgggggaagaaagagaaagtaaattgatttgatatttatttcctaggttggagtacaagttactttaaacataaaatatgtgtgttgcctttgaatacaatgagcagaatgggttgttggttctgaaaatgaacataaattttaagataaaatgggtaatgtaatgataataaggtaatctgattgctaaatgaacctgtttgattatattcctcattggattcctgttgccacctagacactcttccaaattgatataaagtattgtttgaacccagaacatacagctcaggagtgaaaatacagatcacataatgaagttaacttcttttcagtaatgggctttcagtattattttttctacaagagtttaaaacaaaactttcagaaaatatctttgaatgtgaacttgcttgcagagactatctgtctatattccaatggaatttgcttctagtgaatgattgtgagatactggggccagggcagcgatggagttgatggcaatggttgctaggcagaggccatctgggactggacaaggcctagcgaaggctttgtgggatagagggaagccaagggtcttctgttactaccttagcaggtcggtttgcctatcactggctggttcaaatcccagataatcaatatggaaaggttcctaatacagtgggataagtgaggggtctgtgtcttaggaaaaaaaaaaaaacctgcttattaaagtgtcaaccctttatcaccatttgtcactggcctctaaagggagctgttcaggaatgggcgtgcctctttgaaaacatgagatccattttcctgaagaatgatctcaattgataagtttcctagttgtgccattatattgctaccaaattcttttgaaaatatgctggcttctgcagtgatcacttgcattttcaggaaaaggcctacaaaacttgtataaaggccagctgcaattcggtttatctgttcctacactatgtgcaacagactgtctgaattctttttcctttccttactaaagacgatgccagcttatttaccccagcagtgttcttaatgtagatgttaaactgcgcgatagatttttaaatgaatttttaattactttctgctattctgagctcattgcaatcagcagccatcttgcttgaggataaaacaaaacaaaaacggctagctcatgggaggagcaaaggcctttgcaggagtggaggacagaagcccattgtcagcgacagctgctgaaagctttccccaagcacaggctcaactgccagagggttctggaggctttgagttttccgctgatggttcctcttctctaatgaggtcacctctcagcacagtaggtgggacgactctgctaatgggagattcagaaacgcagattgcaattacagtctttgtttccagccatctcccgtagtttctgaacaaccccagaagcttgtaacagggacagctcctctacaaatacgtaacacagccagataggacatatcatttatggggcatcacctcagtgccagatgctatatggtgagaatgatgctggccaggaatttatgtgacgccatttttataacatttaaagctatgccatttacagtttcatatagtcagacaagtcttatcatccacattacgccatgaaaaatgcacggttcagagggtataagttgtctgtccgtggccactactctaggctccatattctgcaaaatgggaataatacaatcatacctgtgccagttagagttttataaaatactatgtgtgaaaacactttaaaaatgggtgaatgctctacaaatatcatgtcttacaacaattaatcctaaaatgcatattttttgagtaccacacagagaatagaagcagataaacatcttctctcccctcctttcactttccttaatggaatctgaggagaagcccgacctagggacctagggacgacagagccctggtcatctggactggggcagttcggacgtgcaggtgtggctcccagcagccgcttccatctctgctttcccgtcccaggattaggatgctcatgtcgccatgataacaggccgctgccctactcccagctggccagatcagtcacctgggccagttctggctgggtcattttttgtttgtttgcggagctttttttttttttccttttttttctttttttctttttaagttaactagatcaaactccatatctcatttggatttttctgtcctcttaatttctgtatattttttgggtctgattgtaaattagtaattctcttagtgaggcagaatgaagcgcagaacaccaaacaagattctgcttgaattccagccccaaggtgaggaagtgggcattcatccaagtgaaaatttttgttaacgttaggtaaggattcaaaggctctgacccaaagctttagtacgtctccttatcttagattgaattgatgcataactgtatgaatgtttttgtcaggcatcaccataggtactttcaaacctgctcactcaattcctgcagtagttttgggtggagggaattattctcccctttgtttacagtgaagactcttccaagtctcaggaaagctgcttggctccaaggcaagggctcctcccctctgctgcgctgcttctctgcacagccatatgaatggggctcttcactcttctcagagaggtcagtgggcagcaagataaggcagaagccaatgagtgactgtctcacctcctcactctcctccttgggctgagagctccagcatctcagctactctctaaaaggatcttgcagtaaccaaagtggaacatcactttctggtcttccaagaccagaccaactagtcggggacttccaaagggaacaaattgcctatacttccttcagaccaagcatcctgaaagtcgtttgaagttgcctggactactttgggtgggagccagtacctctgctggacccggggtggggcctgccagctgggggggccttcctccaagacaagggtgcacattcccacagcaaagcctggctagggctgtgcctttctgatgtgatgggcatgtgacatcctgctgatgagaacaatgacaagagcaaacatatgttgagggattcactggagcgccacatgcatagtgatattaaggaagagattggattcaaaaaacccactgggaaaccattataataatccaaataagggaagataacatctggctgaggacagggcagaggaagtgggagagtagataaatggaagaaataagatgaaggaaggatcagaagggctggtggctgagttgaggaggtaggtgtaaaacttgcaagatttagaactgggtgccagtgatgagaagtcctcaagatctccacaatttctatttccctctctgtctctaaataaaactgtttttctttaattacaaatagtgaggaaaaatttatttttttaccttcactttttagtgtttcgtttaattacttatactgttaccatattgctttctgctacttttcattgcagatggattagccaaactttgtttcctagccagagaacaaactgaattactatttataatgcagtttctatggaaaatgaattatacatttcaaacagcctcacaaatagaattttggaatacggagttgtggacttcttttattgacttttatttgaaaaagagatattcttatagtagatgtgggattgactctcagaagaaaggtaaaattgggcagcatatatgtgggagtcatttgcataaaagtgagaatttaagaggatgaaaatgatcaaaaagtgggcagcggggaaaatcaaggcagcagtgtactccatttgtccagctagtttagaactgaaaggaaaatgaatacaaagtctgctttatttaaaataaaaaaataaataaacatttctaaggtaaaagtcaattgcgaaaaataaaggtaaatctctcttttaggaaagaccaattttggtgaatttatctgtgagttgtaaagaatattaattaatatatcaagcaatgtaaatgttctttttgaaaaaaatggattgggccatcattctagtttaaaatgatttatgattaatttatttgtctgaggcaaaggaatggtttgtggcaaagggctggtggtggccctgtctatatggaaactgcatgagtccctcgggttcgtatgcatgcctctctgagctgtgacatcagcctgctcacttgggatttcctgttgagagtatacttttacttccaagttgctatatttaattcaactccacaaggctttattaagcatctttcattcatatgctagcaccaatataggcgctgggaggagtcaacagcataggaccctttccctgccattaagaaatttgtaactcatttggggaggcaagacaaaccgacatcagccagttagagttcataaaaggtggagtatcttctttctgttcccaaactgttgggcagtttttattgcagggacatggaaagaaagagagaatgagagagagagagcatgctctggaaactgaagcagtatcaggagaccttgtgaaggaagagggatttgggaagagtttgagtggattcaggatagaatatcatcagactaggaagaaggggaaagatgagctgggcaaggaggaagggatgatcaaagcctcatcctgattgtccacatcaggaattatgggagaggaagcccagatagttgaggtgtggtcagttaaagtgtgaagacctcgaatgcctggctaatttatgtgaccttggtctaataagtagtaggagcaggatatggccagtgagacaaagcagtattgagcacaaaactgtgcaaagccaggtaatggtgcttgtgctcctcagtgggacctcatgagccacgttgacattctgagatgacaagcctaagaataatgaatctgtcagtcctctggctcttaatgacctgaatcctaaatgtacaaggggaatggccctaacttgaaaaatgccagctgcaaccaaatggaaagaagtgtaaagtccagatagaaaatctcttgcaaaagagagaatgaagctgtgggacccttgtcaattttcaaaagccacaacccagtcaggcagcacatatcggagctcaagagagaaaatatggccacattgaattgaccatcttcgtgatcctgaaagcattgcctgtaagtgaaaatatactcactcctggggaggctgaaaatgactagtcaattagatatggtcaggagacattcccctacttgagaaattcaatgaatttttcacttttaaggcaggtttgccattgtgtagaaaaagccatagaacttcctgattggtgcacacattctgagagcccagcattccactcactattgcatgaagttgaaatgataggaaaaaaggaatctgcagctgtctcttttttcctgctcttccgcttctgtcgtcagttttcgtggaaagcttttaatgcaggggcaaggttttgctagcagagccaggcccataccagcagctcttagctttcagttttctgagctttgttactcatcggttatagtggtctgttcttatccccagtgtagcaagttctaaatcccatcagcttaccaatccactgggctgagaagctgacttgggaaggatggaaaatggatgtaggagtgaaccacagaacagaaagatccccagcagagctgcaagcttgggggtgggaggggaaggggatggaggaggcacactgggcatttgatcatctctaagtgcataaaacttgcctgtgacacacctagaatgggtcatttaagtgtacatttgcagtgggttccagaaaaatataagaaatggttgaaagcatccaaaaatttaagaatcctttctaatgagtttcaggaaggcatctctcatgggagcctggggtgctgcaaagttgctgttggaacttcagcatcacagctctggtcttacttctttgatgtaccccatgtgtggggcatcacaggccctgcctttgcaaacaaaacccaggtgtaaaggctgcagaagtcttgctgtggatgggctgtgtttccaccatactgcatctgtgcatttctgctttgggcattatggtttccatttcttttaacaagtggcaactacaactgccacaatccccttggcaacttctcttttccaagccaatatatgaaacaaatcagtgtaatatgctctaaaaatatccatgtgatgctttaaaaatgcgtatttccaacatgttctccttcagagcactttgccttggcaggtaagcactacctttacatgcttttgctctttatggactaggcccatccttagccaggttgattttacttttattcatgctctttatgaaattggctcagatataggaacatggagcatttgtaactgttacttattcatttaatcaacaaaactatattcaacattcattgctgtccattgttctaggtgctgaatataaaaagattaaaaatttggtccttccttcaaggatcatgaaaggaaacaagcaagtacacaaatatttggcaccataggcagaatgaaattctagaggtctttgcatgctgtattaagagcatttactcagttatctcattggctgggatagcaagccattgcaaagtgttaagaaaggcagtgacatcatcctcatctttaggctttataaagatgactctggtataagagaagaatgaattatagagggtcgagccagacagattcaattgctggtagttcaggtgaggtttatatgagcctaaactgcagcaatgtctataattttttttttttttgagacagaatctcgctctgtcacctaggctggagtgcagtggtgcattcttggttcactgcaacctccgcctcccgggttcaagtgattctcctgcctcagcctcctgagtagctggcactacaggcacccgccaccacgcccagctaattttagtattttaagtagagatgagttttcactatgttggccaggctggtctcagactcctgacctcgtgatccacccgcctcagcctcccaaagtgttgggattacaggcgtgagccaccacggtcagcagcaatgtctgtgatttaaaggaaaggatagttagaggagatatttagagagaattgacagaaagttgttactgggatttggcagtggggagggggggcacagagacagagagtgagagagagagagagagagagagtgtgtgtgtgtgtgtatgtggcaaacgtgatggataagatgtttgtcatgattctggcttggctgtgtggatagatggtgacacttttaagaatatgaatgaaagaactggttttagtgcaaaaatagtgagttttgttagagataaactttcaggtagaaacttaaagtgagcagttgtatgtctgaatctgaggttaggaagaaaggcctgggttagatatgtaaatctgggagtgtgttttgtgtgtacaggtggcagtgagggtaatggaaggaaaaggatcacagaaagtgggaagctcacaggtttgatcattgtttctggatttgaatcctggctctgtaactgtgcttcctgtgtgacacattgagaaagttctgtaaccacaatgagccctagtttctcatttattaaatggggatggaaggattgaccttaaggcattgtttgtttatttattcagtcattaattgaacaaatatttattgagcttctaccatgtgcttggatctggcaatgcatatctgaacagaacagacatagtccatgctctgagttggctttcagccttgacaattactgtaagggaaaataacaggaagaattgcataagagaataaatgtaggacacttgccacaattgtagtatacagaataggccctcagacatttccagccaaagttataaccttaatggaatgatgcagatagactccggtttctggtgggttgaggaacaaatgagagatgagaaattggcaataacgaataatgattactagttcaaaagtttggcagttaagagaaataagaattttgagggctatatggagaagactagtggttgaggacagatgtggggtttttcaagatgtgagtcttgagcatgtcgacatgctgagggacaggagctagtggagaggatgaagttagaagaaagaagcagagaggtcttttgggaaataagcagatgcaaagaaaagcccctttttctgaaatagtaaaagaagcatgtgaaagggattaaatgagatagtgcattacaaaatgcaatgaatggcatttgaggtactttaaaattgtgttgattttggctgtgagcatggatacacacatatccatattcatatccgtgtactagtgtctatagctacacacacccgccacacatgaacacatagagttaaacgttttagttgagactgaaggaggaaagctgaagttcatacctggtcaccttactttcttgataaaggaagaaggcatctgctgagagatgggacagaattgtaaggtcatgaggataagagtgatggcttaagctggcctcttaaggaatgacacaaagaagaaggtgcacctaggggagaacccctgaatgacactgggggtctgctggagattggagatataacatatatcatatgttatagacacttagggctggggatttcctgcagcaagccccatttccctcagaacctttggggttggctgggaagctgtggtgtaacaaaaagcaggtgagagagcaaaggatgctcagtacaggaaatgaagtggtggactacagggtttgagtgcatagaacgaaaagatgcacccgaggagatcccagggaggatgacattagatggctccataacatccaggagcaagtgcctgggcagtgaggaaggagaggaactggaagaattgaaaatggtcattagagggttgtatattggaatttcaatttttaaaaagggaatggcttggccgggcatggtggctcacacctgtaatcccagcactttgggaggccgaggcgggtggatcacttgaggtcatgagttcaagaccaacatagtgaaaccccgtctgtattaaaaatacaaaagttagctgggtgtggtggtgggtacctgtaatcccagctactcaggaggctgagacaggagaatcacttgaacccaggaggcggaggttgcagtgagccaagatcatgccattgcactccagcctggatgacagagtgaggctccatcttaaaaaaaaaaacaaaaaacaaaaaacaaaaaaaatagtcttagaatgcctcctaggtaaggagttgctaaggtagagtgcaagtgatagccataggaaattgaggagctttgaggctgctcctgcaccctccacccacactagtgaactgaatcttctttctgcaaggtcccagtggtctttagttgcccagttatatgtccttttcttcattctcaaaatttttgacttgtcttagagtcctttcctgttgaccaactccttcttcatgccctctgctccttgagtgtctggcacatgtatgtactctgggttctcctctccttcccattcctccactctcctccccattcctccactctcctcctctcagccctcaacttgctgatggagacgttctctgaagactcttctgtctccacattcatgatcagagtcacactgtgacaaaggtgtgcacaaaagattggtggagggaaagaggaggcaagcagaccagttacaacactggttctggagtctgagcaaatggcacacaagcctggaattggaaagtggctctgggaaagagaatagagatggatgtggaacatattttgagttgataatggaagtcagcaggacttgacaacggggagaaacatgtatatggggaaatggaaacagaaggacaaaagatgactaaaatgttgagacttactaagaggaagacattaacagaaagagagaacatgagaggacagaggcttgggtgtgaggatcaagggagatattgggttctgtgtggggcatgttgagtttcaggtagtagcagcccattgagataagatgtacaaaacatagatgaaaattgaaatggtgacccaaagacagcaaggtgagtactagaaatatatattgggggttaatgaccctaagttagttgtgcgaatgacacactagagcagaggaagataatgccaattgagaactagtaggaagagatgataggagagccaagtagagaaccccagagacagctatattaaaggggtggcatgagaaaggctctcagaaatacagatttgtcatgacgtgggcaagaagcaagtagagatagtgaaaagaaaagagaaagcaataatcttgaggtctagggaagacttagtagaaagacgagaatttttatggctcaggggaaggagaaaataagggagagaatacaagcaaagagctacttgttggattaagctgtaatcaaggaagaccacagctgtgtaccctattcctctgaggtggtagagaaggaggaacatatgggcaaagagggaaatgttgagatggagaaacatggcaggctggtggtcttcaacattcttgttaaaggagaaggtaggcatctccacatggaaggcttggagtagatgctttagggaatggaaaaggtactcgttagacctgtaggtgatggcctgggaagaaattgggtgattggatgtcctgggttgcccaggacagtcatggtttacacatgttgttccagcataattattttaattgtacctcttgtcactcagtttggaatatatattgcaaggtcaccctagagagaagcaatgaagacttaaagacaaaaggtgtttccctgagacacacacacacacacacacacacacacagagtaagaaccctggcatgttctgcttaaaaagctgaggcacacagcatgtcgtttgcactgttgggtccaacagagaaatgaatggctcaaaagtctagagagagcacctaggacatttgaaatttagttcattagaacttcactgttgagcagatgcacacatccaagttgaaaatgttcaaggtttattcccacatcaaacaaaccaaataaacaacaactttttctttgtattggttctatttggagcaattgtcaatgcattcttctgtcctcttttttcctactttcttggtacataatacacatactagtcagacagtggcattaggttatttggaagttgtaacttttttaaaatcaccctctatatcattaactctaagtatttttggttcaggcttctctatactcctacacattactgaggaccccaaagatcttttattctgtcggctttctgaatcgatgattataattatggaaaaactgaaaaacttaaatatttatttattaactcacttaaaatagcagtaatacatatgttatcaaaaataatatattttatgaaaaaccaataaatttttcaaaacaaaaagtatcaagaggcgcttttttatttttgcaaattattttaatatctgccttaataaaagacaaccgattctcctatctacttctgcattcgatctactgaatacccttcaatagaaatgtatgaagaaaatccagcctcacacagatatgtagggaggaatattttaatagccgtcaaaggtaattgtgggcattctttaatactacaccaacatttgacaagcagaagttcattaaaatttggttgcaatgtggaatctgaaatcatctattggtcatttagaaaatattggttcactgaattatacagtgttgacaataataatatatataatatctaaaaattgtatacattggtatcaccacaagttcatcagacaagtctttaagtattggaaaattgttaagcttatgttggtagatatgagtttccaaaaagcaattcttcacttgaaagcttgaattttattgttagccacaaatactaccaagttgtttccttaaaatgacaggcttacttcattcattgttgggaaaatgtcttccagagacccaagtctggataactttgtttctctgtcagtagttatttcatgaaaaaatgtgaatccatgaaaaacgtggctagttgagctcactactcagttgcatgaatgtttttcccctggagactattgtacttcagtgcacagcagaagtgctctattctcccttcccctttggtcacacagaattttaagaagatgtgtatgttctcatgacatgctcccacctttctcttcttctctccccttgtccctccatctttgttgctcctgtaataagccaatccctgtgcattgtacaatgtcctggttgctttttaaaactatctccttaagttgtggttttgcaagccaaattatagagttcacccaggggcacagctcagatatcattccttctcattaattaacatgttttgctgagatgtgtagtagacatgctgtacatagctgtccagtgaacattggatgaatgaggtggatgagagcctctcctatttattgggttaagtagggttgttgagggtatatttttgctcaattgaattattaagacaaacaacatcacccaataacagcagacagcttaataactgtgtttatctaaaacatcaagttttgtgtttcagacatatttctttagtaataaataacaccacactatttctaacaatagttatctctagagaccagtgctaccaagtaaaacgtaaagctcagcatctcctttgatgcaagatgagggtttttagatacagtgtagacctttatagagtagtgatttaatctttctaaattacatactgatgcctgtgagatttccacaagattaatcatctaatatcatcgatagcttgttgcagcttatttgtaaaaggtaacaagataatttaaaaaaaacttacattcatctgttttctcaaatttgatagtcataaatatcgtagttgataattaggagttacattctgtgtttcatatatttaaattgtatatatttcttaagtgagatgtttatgtattctaataattcacttttttgtgtgtaagcacctgttggaaataaaataatactagataattaggcaatatccagaattgcagaaatgtttacagtggcaagtaagtctccattttcagttcacctgtctccctcagaactgccactctgagaatccactgcatagctgggtgaaacttactagatattgtgaagaaaatgaagtctgtggtgtagcccttacagctgagaattaaactatcctttcagactttttctgcatatataaacatgtattagagaattatttctattacatgcattttatttttttttccttttatcgttttctttatagtcaaagcaaaaggggtggttcatctacagtgattctttttttgttttttttattatactttaagttttagggtacatgtgcacaacgtgcaggttagttacatatgtatacgtgtgccatgttggtgtgctgcacctattaactcgtcatttaacattaggtatatctcctaatgctatccctcccccctccccccaccccacaacaggccctggtgtgtgatgttattacacacaccccaaaagtgagaatgtagttgtagcttttagcaatgtgatttgtaacatatcattactcagtgttcattactatatgtattcattactcagtgttcattactgtatgtagctccttccttcccactgtgcctgaaactaggtttcacgtgtacctgctaataccatgtagacagaaccatgtgtgccccatgcctggagagactgtggccagcaagaaggctggtttgcagctgatgttattcctatcagcgcctgaggtcacacatagggcaggccctgctgagcttcctagggcagtctttgaacaccaagcttaggaacgcagctttggacaatctctcaccacattggagttgacagcatgaatgcaatcatggagctaaatggtgtttcagagaatgagattgtacctcctctttagttctgcttcgctccaggttaccaactgccccagtttccatgggactgttctaatagcaagacatgaagtccgagggccccttttatgttgcccaattttcctggcactggtacaaaatcccaaatcatgtgcagtgggagtgaacttggaactgcagagttttgcagggattatgaaagaatcagacacaacccatgttactgatcttcaataaagagaaactccagagcatttcttcccctgaactgattttactttttgtcaacagcagccaatacaaagcctcaaacccacttggcattcggcacttttgcatcagaaactgcctgtgttattgtgccagtggttgccctaggtgttcatcatgagcacttaaaatgattgcttttgcagttgcagatggctgtaccggttccaaacaaagagggtcactgagggctctgcttatagagtgcagtttctggaaggaattcaccacagattgtacaatgaagcccaagctcgctggactctgctggcccagggaatttttacaaggttaagtcagccataaattctgtctgggccttgtctgttccctgatagttcctctagggctttttcgagagtttaaattaaactatcttcttgtccattgagatgcacaactcccactccctatggatgtgtttgtgcaagctccgtcacaagaatacgtgggaagttgggttctgtcttcactgccatctcacaagagaagagagttgagggacagtactgaattacacatgatcgtgatctacacagaccatccgttttagaaaaaaattgaaaatctctgccacctaggagaaaagagagtagggaatcaaaagagccccccaagagatgattactttcatcttataaaatgaaaattataaactacagggagtttctttgtagattaaaaaaatcttatttcagaacgttttacttctttcttcagaacgtttcatttctgctccttacatctacatagtattttaaaattggtgcatgtcataccttggacttggaattcttttcttttttttcttgttattgccaaaccctgtgcccccgaaagagttccaggtgttcataagaggctgctggagtgtattcttcctgtcaaatgtgcaattactgagttatcaaaaatacatgggctcccttatcctgattctgttctcatttttggacagtttattcctgagactgatcaatcttgtaatcaggttaaacctcttataaaaaacatttagtgcttttatcatagataaaccacataaaatccccctgcctgttgagtatggtcagtatgtcatgctagtaaagaaagtcaccttgtttcctcttaagcatgaggatgtagtaaaagaaactcttgttgatttggcttcccgcccaccccctttgcccatcattcagcagaacctggagtgtgtaggtttctagtggcttgcagcagaactgagggagaagagaaggtggagaagcactgtggttgagctccatagagtaggctgggcttctgcagagccttctatgccagggagcagctggtcatttttgtccatcccctgaactgattttttttcccctgaaaccttggcttggatcgcttcctgcaaacaacgtgaaatcttgcatgtgtgccaggtgaactgctgttcgagatattttcagaattcaagggtgttatgctaggaagtcaggatcatttaagtaaaacaaacaaacaagcaattatggggttttatttctgtataatctgtaattttgagttgtagttccttggggggaggagcagcctgagatggttatggtgtgttaccaggcaattgctacaggaacaaggccaggggcctactgtaatttagcctttgcaaacaaagctaaaaatatcaaaacatgatattatagcaacccctttgtctttttggtttccagtcattagaagcatgttttttgtcttgtcatttatttgtttaaaaaaatgaaaaaaaaatcccatctcaggctccaggtgcctgctgcagtgtaggagcagggccctgtgcataatgaagctgcccttgctggctgctaacatagaagtcaggagaccaaggcgcctgctgttatcttagagattgtttttgcagtgcttgcttctggcctaataactactggaggtgaaaatggaagaatccatttttcttttctaaattacatggaaagccagcccatgatgtcactcttctagaacaaataacatttaaaaaaattgttttaatggatttttgagataaatatgaattgctgtggagggatagcagtgatgtaatggaaaaagaaaaaaatgaatgtgggactgtctaaatgtttgtctccaccaggaatgttattggattctgccctgtttgttcttcctttgttagttacggtcacggggcatattctcagtgggcagaccacaagacacaggcagtggagacgcgatctcattaacgattcaacacgccaccctagtggccacccgagcacatattccgcatggaaattcgaaatggacgttcagttcattgctttggctctctgggaaagaggctctcagcttgggttgcatgggaaaatcacctggactcttaacaattactaacgccctctccatcccttcacactcaaattcccctagtcacaggtagggctcagacttaagtatttttcaagctctccgtgcagccagggtgaagaaccactgtcttagaggaaagcaagtttgggcaaatccaagtgcagcctcatctggcaacctcaaactctgctgacctccttctgctcaagagaagatgtcttcttgccctccagaagaaaggcagagaagacctttgggaattggagtcagggttgtaattttcttaggctgtggcatatctttttctgtctgtaaaataaataccgcaaaagtgctgaaaaagtctggaaaaaaaaccacccatgctgctgttttgcatcagtattggctcagcagccgggtcagccaggcagatttaatgcctttgttataataagaacctttttcttcacccaggggaataggatgtcacagttttgacctctgtggtttcgctattgacctggtcctcaaagccagagagttcagagctaggtctgaggttctgaggttcttctcctgggaattgtcaagagtgttatggaaagcaatttgttagggatgagacatctctctggtgaatggtaatactctgaaaggaagagatgtgtccagccttgtctcagagaggccagtagggagtgccctttgctgtctgccaagagggaaaaccgtatgttgaggagcgttctgcttgttggataagaagtgaacatctagaatggagttaaagaaaagttttgctcagacctggctaagatcgaaagaagaaagtgtcagggttcaactgccctgaagacgtaagtgtccaggcagtatgcccagtgctgcgggtgccgggctgtgcaaatgagagctggtctcaacaccctagagtatgcagtgaaggggagaagagagggagtgagcaagtattgggaggaatttcacaagggaggtgctgggtgccatgagaagagacaactgtaggaccctacccactggcatgttcccagatggccactgaatgggattgccgaacaccacattatcttgcaaggttggatggagcatcctccctccccttgtgcagatatcactgcaggtagaccagatgcctctgggtacatgctctgcagtctgcatttagcgctgtactctgaactaagggtggagaagaggactccatgggggtacatgctctgcagtctgcacttagcactgcactctgaactaagagtggagaagaggactccatggtaagaaacacaaactgacttgttttctcctacaatacccatactcacttctaatacttcacttctgacatgagatgttggggcaggggcattcccacacaccaagcaattctccagtgaacaccaacaaggtgtcctataatttaaatcatttctgacactgtctacctggagttagagtcagatcccacaggctaaaggctcagtcccacgagactgccctcacatcacatttcagtcgcaagtcccaggttgtgacctttgcttctgaccctccagccattaatcagggttcccacaaccccctccttaggttccatgattgctaggatggctcacagaactcagggaaacacatatttacatttactgattcatgataaaggataaggatattacagaggatatagttgaacagccagatgaaaaggtactcagggcaaggtgtgtggaaagaggttcagagcttccatgccttctctgggtgcaccatcctcccagaacctttgcctggtcagcagcccagaaaccctctgaaccctgcacttcagagatttttatggaggcttcatcacgtaggcaggatccattattaattcaatctccaatccttccacccttctcaaaggctgtagagcagggctgaatgctccaaccttctaatcatgatttggtcttcctgatgaccaaccccagccaggagcccaccgaaagtcaactaatttgaacaaaagactctcctatatcacccaggaaattctaagagagtaggagctgtatgttggcaacaggggtcaaagacaaaatatatgtttctaattttgtcacgatatcacagggacccactgtctgctcattggcagcaagcacccagcatgacaatggaaacgtgtctgtggggagaacagaagttagaaaaaggtggctgtgaagtagcctgtggcattgtggaacccacctttccattattcaggaccctccacaaggtagaaagtgacttagaaagtcacttagaaagaaaaggaaatttaagtaaaaccaccccatccacttagatgaatttggaaaaggccaatcgctttctgatgcacctgttcaaaaagataatttctaagtcctctttagagctaagatccagaatctccactgtggtctctgggctccgagtagactcacttagtctgttttgattcagcctcaggccttctgcttgtcttacaagcagagaatgggaagtactaagaatctccacttctcagactaagtcagggcctgtagttcattttaaaagcaggttcaagacttgcagtttaaacctttgagacatctggtcgtagctgggatctatatagcctttgcttcccccacccccgatgggaccattatgagagtagaatgttttcctgcacccttacgaccctattgtccatgcctgagtgaagaaacctctggtttctctggttggggaaggctctggctgtctgtactcctctgtggtagctcagccccagtgtagagaagaccaccactggctctctcctggcttctcgcctggtccggtttctcttgctcctaaatagcaaaaccgactgatttttttttttttgaaatggagtctcgctctgtcacccaggctggagtgcagtggcgtgatctcggctcactgcaagctctgcctcccgggttcatgccattctcctttctcctgcctcagcctcccaagtagctgggactacaggcgcctaccaccatgcccggctaattttttttttatttttacttatttttagtagagacggggtttcaccgtgttagccagggtggtcccgatctcctgacctcgtgatctgcctgcctcggcctcccaaagtgctgggattacaggcgtgagccaccgcgcccgggcaaaattgactgatttctttccacgcctgtttatatttcccgccttctccctgggaaatgtgataatgatcagaaaaatagcaaaaaggcaacagcaggaagacagtggaggggcatagggctggatctcaaccatggtcctagctgccttccagcatagttgctagggtcaagatctgtgaaagggatttgcagatgagggactctgaaaatcgtaggaaaacacagtaataacgcaccaatgggtgctacctgtctccacgtcagtgagccagccagaggcactcctctaccattacaaatccagtggaatagctgtttgaccttgggcaagtcattttaacctttctcagcctcaacttcctcacctgtaaaataggtgcattttacttaaagcacagattgtttaaagattgatgtgatatgaatatgagaggacatggcaaagtacaaggaataataaaatattggtgggagatgttattatgcccataccttgctgagtgatgataacaaataatgactttgttagatcatggggaagcctttcagatcctcagttcacgacaggtaacttgtcatagaaggaagtctggagctctctgtcaggcaagtatagttgtcactgcgacacacacacacaaaaaaaaacactggctctattctacctactgtatgtcaacttcatagtgcatatctctacatagccaagaaaaatgaaatacaaatataatcattttaagcactttttagtaatcacaaattcagctgggttaagtcaaatttcagattcaaaactaacttcttatagaatcactcactcgttcactccttcattaagtcagcaaaaatttgatttctggctctttgggatttggtgtaatgaattttcccttgcatttaaagagggctgctgtattgataaacgtgttgacaaacacacaggatatgccactctcactacactgactagaaagtacgcagtctgggtccttccataatcagaggagctgtcaagcaacaccgatctgccagtgtgaagaatccagaaccctgaagcttttactcttcatcactggccttcaatttgcctcatttctggaaaagactcaaatgtcctttgtatgtatatatatctttctaagcttcatcactcccacacttggaaaaaataccattgtttctaaatggtttacgagcagtgttatagagccttccagtctggggtgccatgagggaaccaccttccagagtctgctgcccaaagcctcctgatatggtgctgacttgggtcacccacagtggctcaggccacttctccacaggccttcctgtgaaggtgggtgtcatttgctataggggcagttggccgctgtttctgaatggcagaaacgtgttttttttttttttaattaaaaaaaaaaaatcaccaaactcttacttagcattcagcagtcactcaaaaacttcaattccaaattttgcatgtgggcctgttggggttgagttagtggtgtgcagaagtctgcagaaggctccctgtggggagaagtgaggtcccactccagcctggagcccgtgttctatgcattctcatcatgtggttcacataactcagctcaaaatgtgagcggcacttaattcctggcactctgccaggttggcaggcggacttttctagaatggatccagtgtgaccagtttgctgtggcttcataatagcaagcgagatggcggttgggcagggtgtattactgttgttgttgtttttgtccgacagcttggttttctcttctctccccaaaaagttgatccacatctttacatacctgttctataacttctttggaaactgtatgtatgttagggtgtgactggattctgaagccagaatttcacagtacacatttttccacatctgaaaggaattggaattgaattccgaatagcatttagaattgaatcggacaagtaaggcctcttccgggttaggctggataatcgagttaattcaaatccatttgaaggatgttccttgaaaaatgttgccttgtggaaaggtgctatatacacagtgaatgcgttatctgtctgtattctgagaactaaaatcttgtggtctcggtcctatttgtatttggtgtcttgtttttgtttgtttgttttgtttttgtttttttgcccaattcacttttactgcttttgtgaacacggctttggaattccagctcacatctgttattccaagggagatgctagatggtcgatgtctggtcgtggcagcctccctgctagcttgcacggtcgtgactagctcagttctgaagttcaacacatttccacctaatgtgccttatgacaaaagaagggcagcgtgtgtcctcccagattggtttacaccctgcatcacttaggcatgtgtaattgtagttcgttgcagtgttgatatccattacctagtaattaatgtactatcttccacttctgtttgagatgtgttattaacttctcagatctgtcctgctgctcctggtttaatctgtacacagtaggaagaaattctgtttcttaccaaaaattgcagagcaatttgatccagtttcttttgttgaaacgctgagctaattatatttaaccacggatgatagtaaagttgcactaacagcattttttaatcaatgggaaatgtttagcttgtgtggggttggggagctgggaatccagatgtgggggaggccaggcaaccaattctatagaaaaacgttaactgtgtgattaagcataagctttctaatggagttattacaggactaaagaggtctttattgcatgaacgtggaggcaggatgtaaatgtgcttgtgtgcgtattaaagaggagagagaagatcctctctcttcctctttctgtgtgtgtgtgtgtgtgtgtgtgtgtgtgtgtgtctgtgtgtgtgtgtctttgttttttgcacatctccaaattgctttgtagaagtaacagccagcttgggaaacccaggacaagattgacctagctgatagcaaccatatcccaaaaacagaaacctgggacaattgtttatgtggtttaatgggcagctagacagacgtgtttgcccacgttatgaggctagcagatcatttcaacttgcctttattggtggaacaattagggttgaactctccccaatgtaaaatcagtactgcagattggctccacattaataatgcagagagaaaagatgtttgcttagaaaaagctagaacatgaactgtgatttgccttctcctgaccctgtggcagctcctcaaaaatatagttcaagctgtacctcacataggggaagagataatacatattatcacttgtcatcaattccctgattattgtttaggctcttgagtgtaagatgacagttggttctatgaacacatgggtcctggtaagcttgcattgctttttcagtgtgggatgggagacttttcagagttggatgggagtttttttttttttttggagatagggtcttgctctgtcacccaggctggagtgcagtgttgcgatctcggctcactgcaacctcggccttccgggttcaagcgattctcctgcctcagcctacagagtagctgggatgataggtgcctgccacatgtccgcctaatttttgtacttttagtaaagacggggtttcgccatgttggtcaggctggtctcaaactcctgacctcaagtgatcctcccgcctcagcctcccaaagtggagagatattttttacagctgtgtttcatttgtttgtttgactgattctttttttcaggagacatgaaataacacatccagaacctttctatgatttccaggcatcttcattttcaagtgtctcgattcctacaactcttttgtagatcaaagctaccttttcttgcaaattatatttatatttctgtggtgcttttcaaatcgtttgacaattgccagattattgagaactcatagcagcctgaaaccaaagaaggcagattgctaggattgtcctttcatggaagagcaagcagagatcagagaatgtgcccagcactccatggctaatagagggagagggttccaggcctcataccaagtcaatagacctcttcccaataagggtcacagcactttgctcttgatttgatttttagcaaacaatttcttcccaccattaaaaaattctacccactcttaaaataggatcgctgtcctttggtcatagccagtcctctttggttttctgtaaaggcagtgtgcggtgaaagtgacaaatacctgacaaagagcaaaaaaacaagggaaaatagaaatgcactggctagatgttaagaagatatgaaaaaatgcaggcttatgtcctcactatttgaaaagatcaaaaggctatggagaattgtgttgaggaattggtctttgggagggaagggagggaagtgaaggaagaagagagtgatttttgttgttgttatgtgtcttgctttgttttttcttttcatctcggggctgcttgtttaggtttcatttttatgtctccctggcctagttggttattaaacagtgggcctaaaaaaactaagggcaaaaaggtgtttctctttcatactacatggaatagacattgggagtcatgaattagaattctctttggtggaaaatgaaaaatcattaaggttgtcttccaataccgctaaaagctaattgcattaaaataattatttatgctgtaagtaagggccaggtaatctgagccgatgttggtgttgcattgtatttgtgtttagaaatcttcagtagtataattaaaagtaaaatacagtgacttgatctttaggggtcttgctttctgtgggaagtgcagggttcaagagggagcaggagacagacagagaaagtggattaatgagtgctggtttcctctgtgtgccagaggctgtgaccttatttattcatgttatctcatgtaatcgccactacaaaactctcaggtggatgttattatcttcattttgcaaagatggaaacaggtgttcagagacattaaacaatttgtgccaaagcatacagctcttaagtaagtggcagagccagaatttgaacccagatctctctgatctattcccccatattgtttcccaaaggatagtttggggaggcatgtggcttgaaatgctcatgagaagggataactttcctgggcatggtggctcacacctgtaatcccagcactttgggaggccgacgcgggtagatcaccagagatcaagagttcgagacaagtctggccaagatggcgaaaccccgtttctactaaaaatacaaaaaattagccaggcttggtggcacatgcctgtaatcccagctactcaggaggctgaggcaggcagaattgcttgaacctgggaggcggaggttgtggtgagccgagatcatgccactgcactgcagcctaggcgacagagtgagactttgtctcaataaataaataaataaataaataaataaataaataaagagaagagataacttattgccctcttgaagctaacaatgaattagattttctgatcactcactgtccaattgggtaattcattgctttcctacgaaatatgggttgaattctgtccgccccaaattcctatgttgaagtcctaatccctagtacctcagaatgtgaccttacttggtaacagggtcattgctgatataattagttaaggtgaagttctactggaataggatcggccctatccagcatgaccggcattcttatgaaaagggaaaatttggagacagacacacttggagatcagagttatgctaccacgagttaaggaactcccagaaactagaagagaagcctgggacagttacctggacagtaccatagtaccttctgagggagcataaccctggggacactttgatcttggatttctaaccttcagagctctgagacaaggaatttctctttaccctgctcagtttagaccagtttgtttcagccagccctagaaaactaacatagtacatctcatctcttattcccattaggtccttagttttgtcccgtcagcccaggctgggtggtggtacttcttccaagctgtctgttcacatacttttagcaggttccaggagctgccatcaaaaccattttgtctcgtgtattgcatgaagctcatcccctctacattccaaatagccgtcctcacctgtattcccagcagtccccctcccctccaactgatcctcattgtgttctggaattattattttctgtgccacagtggattccgtaagtactccttggctggatgtcaggatattatagcttgaggattgatcttggtatgttcttttgtctgggtcttttattttgccttatattgttcattcacagattttagaagattgcacattttgtttaattatgttggagacagactggcattttagctgttacagtctgtgggagaggggttgatagcaaaaattatgtggagtttaaattgtgttcggtaaaggaagtagaaatgaataaagctgttttaccatgaaaagtcggtattttgccttggatcttagaatgggtctttttttattttttttccttcttagctggaaatgttctaagtgctgcattgtctatttcgtttgccttttacaagtctgactgttataaaaaggaaatttgtatctgtatttgcaaatttgagcctggcagctgtgttttgaaggcttaatctgggatcgaactgagatgcaaatgatgtcgaatagtttttcccatgatgttgtcaagttttacttttcaaaaatactgctcgtggcagctccagcctccacacagggtctactgagttttagatttttaagtaataggcaattttatactgatgttccctcagaaaagcaatggcttctcgttgtaccctccctacacaatgcctgcacaactgccgtggggctgagaaagaatcccttctctgctcttattacattagccatgtttttgattagttgaggggaaaaaagaaggcctcacaaaaccacaaagctttttgtctctcatgtctgtcaaaatgtggctgatttaatttgaatgaaattttaattagaaaaattctgccaagatctagccctgatttgaatatttatagatatgttaagaatctccgtaaacctggggtctaatttgaattacttccctggacctcagccctaatggtacagaaagtggcgggggagctgtgcgatagggcagattacccacacactgggctagaatgggggtctggacagggaagcagctatgtgcgtggtctctgctgttttaatagcagcagtttatccagagatgtttttcaggcttgtgagcacttcattatgggagtggaaaacatatgactaatattagcatgttacctgatatatatatatatatatatatatatatatatatattttagagggtgcagggtatgtctgaaaaaccatggggattgggagagtcagaaaatccctgtccaggttcattcttgcctagttcaaggcttgtgttcttgggcttaacctgcagagcttcaatatctttatctctagaatagggaaaaataagatgtgcgaggctcatagtaaaaccgtaccagcagcaggagtcagcacggcagggctggtggcctcgggcagcaggttactgtgctttatgagtaaagatggtggacttggattgttgttgcttctagctagctcaatgccagaggccacctgttccaaatcatcccttagccctaatgaatgtgcttgatgttaaaaaaaaaaatctccatggcatgttacctttgtcattgtgtatttagaataaatgctgtgtgtccagtgcagcagaatgaaagctttaactagacaatagatttgttaccatagtctgccttcatctaggagattagaagtggaaaatcctaaatatatgcaaatataaatatatatcccctcctgaagatttcctggcaatcctgttctttttaacagagctacagaaaagacccacataggacttagttcctcgaatctgcagactcatagcccctcaacacttcctgagtgattgctggggtttcagcccttattgacatttctctttcagagataagactccatttccccgacaaacaccaggtatttctaagcaacctcaatttcatttagtaatgttggtgcaaaagtgcacaggcacaagtttctttgtatatggcaaaataaattggcgaggttttagtgaaaaaagaaaaaaatctgcaacagtgatttgctccagtaaatattgtcagcagatatggctgtgactcctggaataggggtcttatgtgcacatgaactagtcattttgcacgttggtcccctggctcctcctgagccagagacatggaatgtccctacctggctcatctgaccacccatggctagtatagactttaaccttattgcaaattcaggaatgtgaaaaattcatatatagtatgcttagtattttttccacttgcaagtggcatcaagaaatcaggcttcattaggattatccctgaggctaagaaagagcaagtggtggtgaagagcaggaagcaacatggaagatggcttagggtaggagggactcctgccaaaaccctctgtgtgcatcccagaggagacttttggggagtacaagtattatgctgacactctcactccaggcccaccaacaactgtatctccatcctcagggaatagtcctttatatctgctggagaaggttgtatatatgtgtggaatttgtacaccagctaggagccaaaaggcttcctccatggaactcctacaaaataagactccagaggtgccttggcaactgaggttgctgggtgatgtcatgcccttgtgggagatctgtatttcttagattaactgaagcctttgaatactaactttgatgtgttatgttaaccatctggagacattttacagttgttgtcaaaaggttgactgaggtctctaatgcaacacgaggagttgatggaagcttaatagagtttaccagttttgctgatttgtgaatgacagcaccacaataacccttggcccaagagatggcggctgtgtgtactgtttgaatgaaggtggcaaggggtagaatgtgaatcgtgcattttgtaacaatttggaaagcagttgaattgggtacatccaccctagttgggaaactttgccctgttggttacatatatgtcattgatttattcaccacttatttgcctttgtagaaagccctcttagtttaggagttttgcacatcagccctcattcctcaataagaggtgtggtatatttcaatatgccttatgtgtatatttggttttagatcaaggcctagcctaagcttccagggtattgctagtaaggctgttatgatactgagaagaatgaatctttgagctttgcttcttttcttcacatggagaaatagtaagacatctttgttttcctgtttttcataccattcaccattgtggaaaaacatcaatcatactccccacgtatctgaacatatttaatactgtgtccctatatttataatcccaacatatttatgcacatgtataattatgcatatataaaaatacaagagaggagaaaaaagcaaaaataatgaaaatgggaatactactaaaattaaatggaagcaagaagttgatgagagggtagaagaagaaatcacggtaagaatgtgggtggcagttaccctgatttgattatgtgaatgtatgaaatcatcgcatgtactcccaaaatatgtatacatattatatatcaataatacataactagtataaaataaagaatgtgggtagttggtcaaacaaccaccagatgctggtgttttgatacaatttaatgtgtcttaggggaacagggtttaatcatcagagactctactgttgagaacaccaagctgggaatccagagattagagtgtgttcattcaggtcccttcaccaactgcacgaaccccctgatctatgccaggaatggggctggtcctagggatgcacagaacaaggacaagcatggcctcttggaggctaatagatttaggaggagttctctgtcgccttttaaaagcaaaggtgtatggtaaagatggcttatgttactctaaattagattctgctttgattgtggtgaagcatgaatataaggaagggtcccaaggtcagaagggatgctaggtattctagagcccatcaacattgtgtcatccacagttgattgaattgtattctataagagattaggtgaaggtccacttgactatcatccaatttttagacattttgaaaaaccatctggtctactctgaggtcacatccccacctcagagaacacccactagcctgggaagaataaacacaaaacactccatggttttcaaaggaggtgttatgggtttttgcaaaggtttctttcttagttacatcctaagatatgagacatctgtaaatcctctcattgtttgtttttttctgtgtgtttaatttatgtggtttttttttctctatggctatgggatggagccaaatttagcttaacaaattcctaaaggcaaatacaagaaatgctttccaaatgtttccactgtaccataaaaaaatacaccacttgtttcccagcctgttgagaaaagctggcccatcaacttcttatgaggactgcatcctttatgaaaaattaacatgcagaagggcatatgagagtgatatgctacactgggtttaccaggaattataaacttgactttgcaaggttgcaatttataacctgcttcatcttctccaaactcctccatagactttcttgcctgacaatgtggcaggggtcattggcaagatcacaaaatgttatctcaggcatatcctgggatgtgttttttctggctgcctatgagtcacacattgcatattttaacatacccctggttagaatgttctcagtgctggtgttgaccacacttatgcacagagtagatcctggtgtaagctgctgaccacatgagtggcttgaagaacatcagctcttccagcctctatcttccccaatcatgctaggatgctgctgctgccatcctaccttatgtgggctgaaattccaccagaaaataagatgggatttgttttcgccaaaaaaaaccactattaaaagttacctaggaaagacagcattacgtattatgtcttgttgttgttgttgttgttgttgctggagtctcgctctgtcatcaggctggagtgcagtggcacgacctcagctcactgcaacctctgcctcccgggttcaagtgattctcctgcctcagcctcctgagtagctgggactacaggcgtgtaccaccacacccagctaattttgtatttttagtagagatggggtttcatcatgttggtcaggctggtctcaaactcccgacctcaggtgatcccccctggctcagcctcccaaagtgctgggattacaggcatgaggcaccgcacctggcagagagcatcatgtctttcctacagtttgtagcccctgtcatgggcagggtcagatttcaatagagcctggagccgctgaggtgggactgtctctcccagcactccgtttctgctttctctctttcctctttgtcgctcttgcttgttaccgtcacattttcccatggcctctcccttcactccctcaaaaggaatgcctacagcagcagtgaaagagggattcactagaggagagtgggtgggaggaatgctattttagaaaagtaactaaataaatggatagtcaagctctaaaaaaaacttccttaaagactgtgtgggatttaacatccaagaaacgaacatgagatagaccatacagatgaaataaatgcaaatacggtcccaacattacaaatttcctactttcttctttgccccattctccgggtgcttccattttagaagagaaaaatgaagaaggagagacaaaaagtgaacctgagagcagaagagaggcagggagacagaaaaatgggggccaaatgggagagaaagacatcggagaagagtaaaataactaaggatggggacactctcacgttacaccacatccctgatgcattaatgtgttgacttaaaaaaggctgcaggggctcatctccctgcacaaggtctacctttctgccctgagagatgatttggagttccgatgtgtatttcattagcagattgatgaaacgtggtggcacatgccaaccgtctggaagtgtgacagtgcatccaggctggtctcgcctcatatccgtggactctgatgaagctccttcatccgggaggccaattagcaaactgttgaatgctctgcttttttgcaagtttctgacaaacagcctggtttctggcagatggagggtaaccaaagcaagcctgcttgctggggttaggaggaaaagctcattgcaaaaagaaagaagatgaatttctccctgagtaaatggcacataagctccctggttgatgtcaggacagaaaatgtttgctgggtttctgaagagtgaagaacctgggactagagttcagggagtgatgacacatggcagattacagcattcgaaggccaacattcgaagagtccgggtgctttagtctcatttgcatcagctcactcacctgctgctaacaccaggctggaagaagcaggctcttggtgacccacttttatttcagagcccaggactaggacttgaatgtcaggcaggacagtattatgccagagctgctccactggtttgtgagaatcaaccatacgcatctcttcccagctctgcatttggtaataccatgttggtagcttgaaatttcacggtgggaggatttacaccacagatatgggtgaatgctacaaatcaggactcccccaccaccaaaagccttttgataaatattcaccagcatgccactgggcaggagagagagatgaagaaactgtcatatactttttaattatacattttaacaattttgaagcctagccttgttttctgtgagagtgtatgattatgtgtgtacccccaacttgttgattcctaagtaaagaatttgctctccttttgctatggagcaaaataagagcacatttccattttcagggtttgtttaagaattttgcaacaagttgaaggaaatcatgtctgctcagctaagcaatttggtgtctgttgatagccaaacagcctggaaaattatctttgcctcagctcacccactgtgcagggaattatgctgacaagctggctgcttccagaggcctattgtgtggcagcacagtggtgagggagaggcaggtatgtgattaagccatctcttgctctgtctgctctgcttaataagtgaacactgccagactgtctttgtgtgccttttctatcaacgcttgggtcatttcttctctctcatcccccgaaggcaggataaagtatagacaatcaccaaaagattttggaaagcatttccagcaaacacatggaaattgctagagataagaggatgtctgaaacctccttagcatgaaataccaagatttcttttgcttttaggatgcatgtcttaaaatatggagacacttggcttttgtgacagtatctttaagaggcatcttggttaataagagacagtggatggggaaggattcaactcattaatattctagagtcaaagaatattcacactcaatctctatgattttgttaatgtagaaactggggaccctgaggttatatgactttcctaagatgggcacacagaacaagaccccagattcctgggcaacccaggaacagcagcaacatctgccaccactgctgcagctgctgctccttcttttctcactcctgtgatttgtggacgactgactggcaggctctgtgctgagcattctcctggcttctcacttcatctcataggcattgaacagctgctgggcacaggtatgactgagcactcagaggttgcagagaacagtgagatatagcccctgtctggaagaggcttatagtattatcctgcttattggatatggactacccaaataaagagtgagtttagcgctacaggggtattgaaaggcaggagaaagtacatttgattgggcttataggtatctccaagattccttcttgggaagcattagctgcaggataaaaacaaacttttagaggtaaaaactataatgtgaagtttttcttagcatgacacttgatactaaaagaattataaggcattctctggaatgatccttcataaagcctgatgtaggagcccctatccctgggcagagcccacataagggaaaccccgaatctctgtgtgatgtgcaggaggccgtcttcctgtagcactaagtttttcttccactctactctgaagcaaaaacagcaaggacttgtacttagagtagaaaaagtagaagaaatatctcctctgaggcctcactgcgttattggggatggcatagtacaagagaaaggaaatggactttggagcagaataaatccagctccccagctgctagctgtgtaatattgagcaatttacttaacctctctaagcctccagctcttcgtctgtataatgggtgggtggatgtgaggttcaaccactcagtcaatgagtatgcagagaccatgctgcgtcccagagatgatgtttgtaaagcatgtggcccacagttaaacgcttcggtgttgatgggagtcttgcgtctgggatgaggacctcattcatattgcagtttttggtacagtatcaagcaagaataaaaatatccctgatctgaaatagcaatgctgactctactgctggggcttctttatcatgttctcagtttcactaaactgtaaagatgagttcctacagcctaggctgggagaatccacttagagtaatttgctactgattttaagagggctctgagatctggtctgcagctgtggtgtgggagagccctgggcagcctctcgggccctgccagccctgtggttccaagctgcccactctcaagctgcccaagtcagcttggcctcctgagctttgtttggtaggatgccggctgtttggccttgacaggtgcaggttctgaggtctaaatacctgctttgagtgtcagtaggctaacaaatgatggccagacttttcttaagaaaggggtttaccaaacaccgcttgttctacttataagtgggagctgaacagtgagaacacgtggacacatgggatgcggaacaacacacactggggcctgtcggagtggaggactgggggacggagagcatcaggaagaatagctaatggatgctgggcttaatacctaagtaatggattgatctgtgcagcaaaccaccatggcgcatgtttacctatgcaacaaacctgcacgtcctgcacgtgtaccctggaacttaaaataaatatttaagaaaaaaaagagggggtggttactatgtggttgtaatccagatgatcttctctcccctcttccgaaagaggactggacctcagaagcaaccaggggtcctggtcccatctctttgattgacagatagccactcaggattagattaaggaaccccacgctatttttgacatacaagcctccagagtttaaaaattgaatgagaccacttagccactttagcttcaaaaagtattttttgaaattagccctaggggtacattcggaatacacatgtctaagtagcttactgctgcatatacccaaaggaaagaagaaaaacacaaatcaatacagtgatttttttctctagctccttggttttattatagccctggttggaatgatgttatttggtaaaacacaacttactgtcctcagaggtattcatatctcttcccatcagtccatagggattgcttaacacttgaagaaacatcaagctttttgactgtaccccaagagaagtaaaagccttgatagaagaatagtctgtctcgttctctatttctccaagctcactctcctaccagatggcaatatgtccagggacgactggtaatgcattacaaaagcacaccagggccagcttgtagagttcttcctgccggtcaagcaggaggtgtggagcgtggatctgttccttccttcactgtcctctgtcatcctggccctgatgcttctcttctgggccctgaatgtgacgtaattaacagctgtctagaacgtgcctttttatgccttgtattatggttataattattcccctttgcagagtgcctcccacgtactaggcactccatgtgtcattttgcttgctcttcattgccactctatgatgcagacagtgctgccatctctgtttcaccaaagaagaaaagctgggagtagctggttcctccagagcagcagcagcaggagctcagagtggcagcagaatccccccagagttaggggcggtgctgtgttctgggtggactgtctggtttggactagaacttcagccagcagtggagagtcgagcgagcagagcccccgactggggagcggggctgcaagaggtcagcacctcccagatattccaggacctcaggcttacagcggcagccctcgctttgcccaggtggcttgggacctctgatgtgctgccaccatcagtgaagattggctcagaactgggtgggcctgggccgcagattggagccccacttggcaggactggggtgagccagccctggaagaaaaatgagaaaattgggaaactccttgacaaattgtcagttgggccccagttgtttgactatagaggtgaaatgagtgttcaaaatcagttagtccaaccccttcctttctaaatgagcgagctgagaccttcctggcaagatacagtaacttgcctcaaatcctgtgggtgtttgtaggggcaagaccagaacaaaacccctggttttctggttccttttcaactgcttttcccactttgccaccctctgcctcttttatactaattctacagctggggcaccagtgccacagaacccaggaggacgttagaaaccagaatccggatgccctgccacgtgtgcacagcaggcctctttctgtgggatctgtctgtcccgctcctccagattgaccaggcattgccattgaaaacaatttcaaaatgcattttttacccagtaatttaagaaacaatattcaccttaggaaatacacgcaaatgaaagagggtttgctgtcaggtagtggagagcatttattagaacctgctgggtataaaaccaactacaaggcactttgaaattacagaaatgacctgacctcactctaggtaaattatagtctggcttcttggtgtgattttttttatcccctctttttctccaattaactgcttgaggcatctcgaaaatattgttatcaatttctaatttgaagaccaagaaactttcagcagcaaattatttaaccagctagaactcgcatgtccagggacttattcgtgttcataataccaaccacttggaaagcaaatgacctcctcaaccttgggaccaggaggctgctttgaatcttgtgggtcagtgtcctcaggagagtgagctggggtatgacacttctgtgtcatttgactttctcttgatcgtttaaaatagggaaacaaaaagattgtataggaaaatgtccttatatattttcttctatattttctacatgtaggcaatgtctagggagtatgtaagctgtagaggtccatgctgaatgctcagaaagatctatcattccaatggaaagggcatctgcacttgtgcagtggctatgaattcccaaattcaaggaagagctaacaaatcactgaatggctttttctttaaagtgaagcaaatgttgtagagaggaggggaaaaaatcaatcaacaagcatagagataccaggaataaataataatcttttacatataaaaagagcatctgtccttgggactccatagctttgaaggcaagatgaattcagctaggaactgagggaaacaattgaaatttttctcttgttgggttcagcaggggattgagagtcctagttaatgcacctgtagaggtttaaaattcatcaatataacagaataaagataagaggcaggtagttccttataccatggaacagaaagctttctatgctcaaagtctgccatttagtgccagctatccttttaactaccattttgaagatacaatagcagtaattcatcttgttttatgatttatagctaactcagaatttctaaagactttttatttcagaaccccaaagtctcattttaggaaggcagtgtctgatgcctcatacatacccacacctttctttttcttatgcttaacaagaatccgctctgagcctctagaatgcttctcacactatatcctcctagtgactagcacattcgtctgtgggagctttggacatgactcacacagggaatatgtcaggccgacctgcttagcaaatcaatagaaagattgcccaactgatcagctgacacttatggagaccttccacttgtggtgtgtgagttgtcatcctgggctaggtggaccaaggatgtcaaactgtgtgctaagggcagtggtgtccagtcgtaacgtcctgtcttttatattatatccattttgattgcaagtcatatctacttttagaaaaatatgatgttttcatgtatattgatgtactagtctgggttctccagagaaagagaaccaataggagatacatacacacacatgcatataagtgtgtgtgtatatatacattatatatatgtgtatgtgtgtgcatttatatttatatatatatagagagagagagagagagagagagagagagagagatttattataaggaattggcttacacagttatggaggctgagatatccaagatgtgcagttagaaagctgaagacccaagagagcttatagtctagtttcaatctgagtccaagaaccaagagagcagatggtgtaagatccagtccgagtccaagtctgaaggcagaagaaaaccaatgtcccagctcaaagatagtcaagccgaaagaaagaactatttattaatcagtcttttattttattgagaccttcaactgactggatgaggcacacccacattgggaaagtcagtctgctttactcagtctacccaatttcaatgttaatctcattcagaaacaccctcacagacacaatcagaacaatgtttgaccaaatatctgggcaccttatggctcaggaaaattgatgcataaaattaaccatcacaatcagttttagtgtagcattgtacttcctaaagtgttacagggacaaacgtgaaaacaaatgcatgaaatgggagtttctgcagcgctatgtcacactgcttaacgtaatacatggccaagtaggcagaacaacattagaatgattgtaaaaataagcaattccaggaaggggcttgaagagtttaactgagtttaatagtatttgcaattcgtcagttatcccaggtaggttattgactaagccagtgacccccctcacctggctgtatgtaaaaatcacttgaggagctctttaaaactagaaccacagtggccctaccccggaggtactgattcaagattttcaggctgtagcaaggaaatctatttttaacaagttctggaggtgattcttaaccagataacctgcccctggtccagagcctgcccccgctgcatttggggaccattagactggtgtgaatctcagaaaacaacggtcataatatgattttcaggttatttcagcaactatcttttaaggcatggccaggcactatgctgggtattgggaatgcaaacagtccttacaaagttcagtcatttaggccaggggtccccagccctgggctgcagattggtaccaggccatggcctgttagaaaccgggctgcacggcaggaggtgagcagtgggccagtgagcattactgcctgagctctgcctcctgtcagttcagcagcagcattagattctcatagaagtgcgtgcgagggttctaggttgtatgctgcttatgaaaatctaatgcctgatgatcacagctgaaacagtttcagcccaaaaccacctcccaaccctctgccggtccatggaaaaattgtcttccatgaaacttgtccctggtgccaaaaacttggggactgctgatttagacagatgataatgcattacattataacacagtaagaggtttgattaaggcacaagctaattgctataggatcacaaaggaagaattgacctttctacctctttaccttcattccacattcttggagaacacttggtcagattttgacagttaagatcaggagatggccccgcatcggcactctgggggcctgggttggtgtttcatgggagaaagaatccagaagtgtcacattttgaagcttacaaagggtcgccctctattctgttcagtctagtgtgtcccagccctctggcagctgatcagggtctcatggagtgtcctagcaatagcctctgagttcagagcatgcaacaggatattcacacacagcagaggtgcgaagccagtgtcccagctggtgtttctggaaggctgtgagaagcaacagaattagcatagagggtggcttcttgctcaggctccttaggggacatgagtgacactcactaatgtgtcctccagttagttccatctctttttgttgccataatggtactttccttctcaactgaagttcttagctccctttcttgactaattctcacctttgcaggtttgcctcttgcaactggtatctaagggagttccccaggtaaggagaagcctcatatctgagctgaatagcaaggctttttgctaagatgcaaaaataagccaaattcgtgtttgactgcagcagatttttgctctgtgaggaaactagacccgaccttcttgacttcaggctttggtctctgggtcagtcttcctcgtgacattacaaaaggatcttggtccaagacaagagccaaccctagaattgaattcattttgggcatttgatggcctttccccaagggttcagggaaggtacaggacacagagggtaagcagtctttgatgtggtggttatttttgtttgtttgattttttagccttataacttacctagaagttttggagaaaaatttgagtttatcatcacctctcctcagctagaaaacaggcaaataactcacagtccagtgagttttgagtctgatattgtgtacactgaggatctgtgtgtgtgtgtgtgtgtttctgtgtgtgtgtgtgtgtgtgtgtgtgttttggcattaagatctgcataagctattccaaatgtgtcaaacttgcttaaatggactcagtgaggaacgctccatgaaatgtgaagctatgtgtagaccccacactggaaaagaggagtagacagtagtcacttatacctccagagagcagaaagaaactcagcaacagattcgttgtaccagagggagtttgaggaccgccactggaattgtgtgctcttttttctcgggccatttattctggcaactctggccctttagcagacttggttgtcaggttattaccatttaatagctttctataagatactggcatctttaaaggccaaatagtgttgctgacagctatgactttatagaaataaaggcagcttgccttgttataaaataaggtacattgcatgagcaggagtatgtattcatatagatcagtgccttttctttttgaccaaagtttgttgctactgttgctgctgttgggtgtggaggacttctgtctgtttgccagtcctgtaacatattcagaaagctcaccctgggaatttgagggtgtgaggagagagagagccaaaggggaatgaaggtagggatgctgttagacaaaagacgggcatgtcggggagatcccagcccttgtgaaaccagcagcccattttatcaccatcgtctgtggatgaaagcctgaaagccacacctcatcctctatgatgagaccctgagaacctcaaaggggctcctcagtcacccccaggactccacatctatctaagagcagacagatgtgttactgtttctacagcagcagaaattacagccttggctgtctgaagcattagagccattcagcatggagtttgtttggggaagtttcttataggaatagaagagaactgaaacttgaatctctcagcattatatttcaaaacatcctgcatgaactccttatttaaatctgttcagattgatactagtctgagggcttctcagttttagagctgtcagtccaatttggaatagaaactagttattgcaccccatatttagctactgttgaggttgattctatttttaaagaagaaaatttcagtgactggtgacctgggttctttttaaggaacccagttttgcctggtcactgtgacttgacacaaaccagtgacttttggtcactaacattcccagggggaattcactgtccagggagacagggtgaggaaggtggtgtgtgtgtgtgtgagtgtgagtgtgtgtgtgtgtgtctccctgtgtgtatgtatgtggtttcttcccattgtcccactcacatctcttatttagagttggtgctgggatgccaggcagagtcaccgtggtcactgtaaacttccacctccagaaaaggcatttgttctcctgaagatggaaggaagttttctgcagacctcccctgaaaagagtttgtcctctccgtaggcttttccctttcatttagacagcaataccagtgatccaggaataaggaagcttagttacttggttttaaagttataaataactagaatttgtcaccttggtagggaagttaagaagcatagcctcggccgggcacggtggctcacacctgtaatcccagcactttgggagactgaggcaggcagatcacaaggtcaggaatttgagaccagcctggccaatatggtgaaaccccgtctgtactaaaaatgcaaaaattagccaggcatggtggcgtgtgcttgtagtcccagctacttaggaggctgaggccagagaatcacttgaacccaggaggcagaggttgcagtgagccgagatcatgccactgcagtctggcctgggtgacagagcgagattctgtctcaaaaaaaaaaaaaaaaaagaaaagaaaagaagcatagcctttgtgaaattcttcctagaaggagacttagctgccatctgattaacttggtttgtgtttgtttctcatgggtgagcctcgttacttgtccctgacctttgaattggttccttgggactccattctgattttagtccttgaacatcaaagcacattatgacattgtgccttgggggtgaggggctgtctttaatgtttctgtctttgatttcacagactgggattcaaaggctctcttgcctgttggatgaagcaaagcgagtttgtcaaggacagttgggtttggattgagggaggaggaaagtcttaagaaaatcgtgaaagaacttagtactgattgcttaaataaaaaataaaaatgctaccataaaaacaaaacccaaacaaacaaggaaaaaaaaaaaaactatgctggataaaaggatctcattccatattcaatttgtatgacttattagcagttctttttggatgtagcattattctgggcaggaagacaggagcataattagcacatgggggaggtcccagtgaccaagtttgtgtgtttggtcgtgttcccccaacctcactactcctaccagtgaaccatttccccagccctcccaactgactccacctaaatctttgatttattataagtcagaaaaaatggatagcaaccttgagagcagccagaggcccttgctgttcttagacacataaatcacaaggtagaagtacgaagaatgaagacagaatgtcagtaaccagcctgggggttggggaaggattttgggacttttctggatctctgaaattacagcgtgtgaagacaggaggaggccatccacatagcctgaggactgttaactaactgagaaggagaaagtaatgctatgggtaattctgtggatggatgcatcataatgttgccagatgtaatactgcagactcacagaagaagaatgtattttggatgtgccagcaccgccccacggccaccatctgctgctgccccttctcctctcccctctccacacccagccctaggttgggctactctgggttctgagttcctgataagccatggtcatgatgacgtggcatttcctaccctgatgagtggtgaaaagctgtgggttccagggacagcttctcatttgttccctaactcaagaaagcgaaacaacgatgtcccagggtattctgtttggcaagttattattcaaatggctggattttcttctgctctacctccttcaaaattttgtataacttagtttatgtattatctagcaggtcaggcaccatctgatctggtgtgacagtggttgtgggggtggggaatggactctccatccagtagaagagtgtgacctccaacaggaatccctttaacatggacactctacagatgaccccttaaggagaatggctgcttggagacagcacaagttgagtggctatatgaataatctgtttcaaatgcacactctgcagggagtgggggcagaaccagtcacaatttatggatcatcaaaggataattttattatcaacgttttaataaggaaaggtatggcttatccagaacccaaattgggggatcagtagtaatccatagatgggaaaatgaaaatccaactagcagcccccgaccccatccctgttggcatccaccaccaatgctgagaactgagctatagagacagaagggaagggctgcaggtggacattgaggctggacccactggtggtgaggagcagggttggagggaattcggttcagagaggaaggaaagtctacggcagggagaagagtgtagccaggtgggctcaggaattccagcaacctgtttccattccctgtttaaacttagtatatccctgggcctgaatcatatagctcctaggagacagtgtttttcttttcttacatgcctgcctgccagttcacccagtagaaaatcaacttctttttcatcagagttaattttgagattgactttatagaaatatatacttaagagcaagggctgtggagctggatctccctgggttcacatcttggctttactgcttaccagccttgtggccttgggctggttatttaacctctccattcctcagtttgtttgtttgtcaaataggataatagcaatacctatcttataggattgttgtgtggattaagtgaagtgcttggtacagtggcacagaagatagatagagatagatagatacacatgtacatacatagatatacacacatgtatgtgtgtatatgtgtgtgtgtgtgtgtgtatatatatatatatatatgtatatgaatgtggaattttccacttgatataaaccaaatttaacaattctttgcactggttgttggagacattgtaagcctttgtatcttcaatagcccagatgtgcttaaagcaatgaacacataaggacattattgaaaggcacgggcaggatctaaaattctcaggatgaagttgcatgctagcattctctgaatttctattttctgaatgtaaagaataaaacatctgcaaacaacagctggacaaatattgaaagatataattccaacttcttgccatgttggcaaaagcagttgagagagagggaaatgcttcgccttgtatcagtacctttttatagctggaagaaaagaacatcgacgagtcattttgtcaaggtttcaggagagcagaccaaagaaaacatcgtctggagcctcctggaagcaatcagatagtgtacagccatttactaagaaggcctatcttatcagggcagattgatggattgtgctttgtttatctggagaagcttagctgagttccaaacatcaatttgcatccttgctctacattttagtaattcagtttcatgcaaagtgctggcccgcaataagggtctgcttagacaagggaaagaacaggaaaggtggcctgaaaagggagcaagaaacctgagcttctgttaaaaagtgcccctggggttggtgggaggcactggatggattaatcagcttgccacaggactagcagagcacacaccatttgtccagcttatttagctgtgcttaatagagctattctctccctttaatgagagaatggctctattgggatgcaggtgagaccgggacagagcaggcaaagaggaaacagttgaagaaataactactgaggacacaaaaagaaaatgagacacagaagcaatagaaagccctgggtcaagtgtcaggacaacggccaaccctgtggctttcagactttgctgcaggcatcccagatttctgttcctggtgttttcctacctataaaatgaacgggttggagataagcgtcaggtcctttccagctctaacctcctttgttagtaaatggctctgcaatcctggccatgactccaacatagtagaagatggaaaagttgtgcttatcattaggccagtttcaccccttcttggcagaccccccacacccttggctatctgctcctcagtgcatgaggctgcaggacattcctgccttcacctgttgtgttctatataagactgggctgatgtccacttgaaaaggatttcactcctggcctggaatctggcccttttggagctctatggagatacttctgattttttttgctgctttggtaggaagcaataacatctggaaagcattctcgtcttctatgagactctgttaaaactagaaaacaaacaagcaggcgtgtatcatcaagttaggcgggagtctctcctggctatgtgcttgatccacggctttggtctaggacatgtctgtctcctgctcttgcttatgctccctttgagtcatttcttctgactgcccattaagatgctccagcgggctccaggcacagtggcttatgccagcctggagagcccagcacttcgagaggccgaggcggttggatcatctgaggtcaggagttcgagaccagcctggtgaacatggtgaaaccccatctctacaaataatacagaaattagcagggcatgctaattggtgatgtgggcctgtaatctcagctacttgggaggatgaggtgggagaatcgcttgaacctgggaggcagaggttgcagtgaagcgagatccagcctgggcaagaagagcaaaattctgtgtcaaaaaaagaaaggaagaaaaagaaaaaaagaaagagagaaacagagaaagagagaaagagaaagggaaaggaaaagaaatgagaaaagagaactgggtgccttttggggactgggaattggtggtgggagtgagagcctgggaaccacataattctattacttctgaggagatcaaccaatgtgtagactttcttgccctataaccagaagcacaggatgctgtgacatgaaattagtcacgttttctagcagctaggtggtttgtaggggcagcaaccatggtttgaaaccactcacttctttctataaaactaaatcggacctaatgaaatgctaatttgacccagggaactcaggaggccaagagaactgaagctgttatctggcttggctctgtgttctgatttgaagccagcccccatggaacagagccagtccccaattatgccggattcccagcagctcatataatttattatgctaagaaatagagcctcctgcttctggctagttggtttctgttgtttggttactagagttgcgtaggatagagtatttatggtaataaaatatcggataatcatccagggctcggttgtgaagggatattcaatatcttttcttcctgactgtaatattagacaatcaattatgatgtcatattagacagaatgctgaagaattctaaagccatattcaccttctccatcctttcccccttcactctgtttggaagagtcataggatttgggggcaggggttaaggagaattcttaccaggactgcttgctgcatggtttttgtgtatgactcaatacccagtccaggtagctttatgaaaaatgatagattttggaaacctgcttgctctatgagtgtaaagagcccaagggtctccttcaagtgcatttggtttagagatgtctatatgttatctgaaagttgtctgtatggcttgtctttataccaggaagctccgttttctttatcctgtggcataaaaaaatgaacctaccaagagtcatctttccctccgccttttgtctcaaattctgctttcacgcctctgctatgcactaatgttcctagccagaaaagactgcagctttcaagaggggtttccttcattctctaggctgctttacgcctcaggggaaacccaggagcccaggggcctgtggcgactttagacagcatttcccaagggcttcgttataaacttagttgatttggaaacctagcagatcacttctagatgtttaggtttaaataggaatgagatagaattcttgggatttatgtaagaggaccccaactacgctgatggaaggactggcagtactaagtatgacttctaggtgatttcagttgctgttgtgagccagctttaagccatgaggatacttccagtggcaattaatgtatggcctgccattatgaagccattatactgaaacagaagccaaaatctgtacaaacacatattttatagtctctttaaaatggcatctagcttttggattaatatttgaaagttaaacagtctaccttattttcttcttccacccagttactatcaacagtagcttaagctggaactgtaggactcacatgtcaagtatagacaagactgctctgtcatccctaataatgtattggttcttctctgccaaaacgagatacatttacttatgtccagctatttcttgcaacaatatcaacctgacaagttccattattctattaatacacacacatatttttatgggctctcaatggatgtatccacacatacacaaaaatgtaaatacacaccacacacacacacacacacacaaacacaccccttagtagatttttttttttttttttttttttttgagacagagtctcgctttgtcgcccagactggagtgcagtggcgcgatctcggctcactgcaagctctgcctcctgggttcacgccattctcctgcctcagcctcctgagtagctgggaccacaggcgcccaccaccacacccagctaatttgtttgtattttttttagtagagacggggtttcactgtgttagccaggatggtctcgatctcctgaccttgtgatccacctgcctctgcctcccaaagtgctggaactacaggtgtgagccaccgcgcctggccaccccttagtagatttttagacaggctgaattcaatagtatataagaggcccctgttatctcattctcattacatgtgtcattgggaattttgtttgtttgcagggtgtgtgtgtgtgtgtgtgtgtgtgtgtaagttcaaagtactgtcatatgtactgtcatttaaaaacacacagcatgaccttgtgtttggtactttatgtacattacctttctaaacaatttcgatatccctttgagatgagtaggatcaatatattcacttacagatgaggaatacagactctgagattcatctgagaactcacttagtttactaactgtcagagctggaatttgaactcagatctccctgactccagatcctgagttcttaatcacaactgtctcctccctatttaattcttgtgacaatccaatcgcatttgttcggtttttacagacaagaaaactgagaccaaggtgaaattacttgtctggagccccccatgttatgatgtttttggctgtggttaaattcagtcttttatatctgagatgttctgaccagcaattcaaatgccttattttaatgtagagagtagaactgggccacctgaccacaaactagattattcgggaaagttgctttatcttaaaccataaagggaagacattgctcccctcagaaatagtaaccgaaataatttctttgggaagcgttgttactagaggttaattaagaataataatgcacaacaggtattaaatgcttattatctgctttacatatgttggttcatttcatcttttcaaagccccatgaggatggttctgtttttccctgttttacagatgagacactgagaggttaaataacttggccaagattacaaagctaataggtggcagagctgagattcaaactcaggtagtctgggctggtgtccttggtcttaaccaccctgcaatgtgaccacattcgtttcctattcactttcactgattttgtaggtttggtggtgaagagaccctttattttccctccagtagtttgctgataatgagagcaagccatctgtattagtctgttattataatgctgtaaagaaatgcctgagactgggtaatttataaagggaagaggtttaattgactcacagttctgcatggctggggaagccttgggaaacttacaatcatggtggaagggaaagcagcacagaccttcttcacgtggcagcaggaaagagaagggtgaatgagcaaagcaggaggagccccttataaaaccaccagatctctgagaactcactcactatcatgagaacagcatgggggaaactgcccccatgacccagtcacctcccaccaggtcccgtgcttgacatgtggggattatgggaattacaattcgtgatgagatttgggtggggacacagagccaaactatctcaccatcccaggcaagtggcactgcttccattcttatgctcctggtctcagtatctggatttcccacaggtatagccaaatgaaagagaccttagcattcagttatactttgaaaaatacaaaaacaattctccattacagtggttatgtttagcaatacttaaggctcatttctagaatgatagccaacaagacaaacatatagctgtaatttaatgcctttttcaaaagtccatggtcattattaaatagattatagaaaactcccttatctcatcatagtcactgatgatatttatcctgtttgtttcacccgtcctttaaattggtgatcagagcatcttgcttgggtgtgtctacattggccttgggccctgaacatctgtaatgtcttcctcagcctccagtgactttataacatcttgacaaggaagtattttcaattagccacgggagagactttggttccctgtctgctgtcagctcctccctcctcaagcccattggaatctgaaaagaaaaccgataaaataaaactactgcaagaagttgctgattcatgtgaactcttttttgaaatcagaacaaattattctctgttgctttgcccacctcttctgataagcacctgagcatcttttaggaactgaaattttaattcacttttcttcagcagctaagactttatagcctacttctgctagggagttgggagttacaaaacatctatctacacctgaagccatttgctaaaagagttggcattcctttcagaacatatcatcagtttaaaaaaaaagacatttaaacagaaaacacatttcaaaatctatcagtctcccatggggctattttactcaactgaggtggggagagggagattgtttggttctcaaaagacagaactttttttctgtctgtgaacaagggatagaatagtgtgggagaaatggctggacttggaactgcaacccagtcttgaatcttgaccctatcattatcatcacttatggctctgagcgtcccttacccatatgtaaaatagaggctataatgctgtgattatctatgagcaaagaggccagttatagttaaccaggagagaaatgatggcagcaacttgatattagaattttttttttttttttgagatggagtcttgctctgtcgcccaggctggagtgcagtggcatgatctcggctcactgcaacctccacctcccgggttcaagcaattctcctgcctcagtctcccgagtagctgggactacaggtgtgtgccaccacatccagctaattttttgtacttttagtagagacgggtctcctgaccttgtgatccgcctgcttcagcctcccaaagtgctaggattacaggcgtgagccactgcgcccggctgatgttagatctttgtacaaagactgtgctctttctagcctatgatttggaaagagtgtaaatggtaactaataggttataataaacctatttggagatggacagaaggttatagtagttgaggggtttaggggaagagttcaagccttagaagtagatgatttttaatcttggttttagtgctcattaactaagggaccctgagcaagttattttatttctctgagccccaatttccacgttcatacagtggagacaataatattggcctttttatcactcagaactgtttgatgaaataatgaagtgtgttttgtaaactggaaagtgtgaactgtccacaaaagagggcttgggggatgagtgcttcttggaggcgtgggaagcactgttggaagcgcctcttgtccctgcccctgggtcctgcccagcccaatacctaggttcataagcacgtgtctttgaatccagctaagatgatgcagtatttacgcaaggagtgtttatggaaagcaagagatgggatacttcgtctgtgagaaatgtttacataagtgccttttaaggtgggagttatgcccagtgacgaaattccacttacatatgcaactgaaaaaaaggtgaaagttgaggtaggaatttgtattgggaacaatgaaaatagtaacagagtaggaaaggaccaggcagcaagcaatggagggaaggagttttgagatcaaagcaggatttccacttactatcattaaacctagtatttcagtgcttcgtgtttggggaagaataatcagccattgtgctgcagtggaaaacatccaagcattgatttccagagaacctggggttcctctgggccagctttgtctctggtgttttgagggaggaatcactagcttttccatctgtgcaaaaggccaggcgtctaaatggataactcttcctttaaaaacttctgtgatgggaaggggaacatcacgctctggggactgttgtggggtggggggacgggggagggatagcattaggagatatacctaatgctaaatgacgagttaatgggtgtagcacaccagcatggcacatttatacatatgtaactaacctgcacattgtgcacatgtaccctaaaacttaaagtataataataaaaaaaagaatattttgcaaataaagtaaaagaaacacccttaaaaaaaaaaaaaaaaaaaacttctgtgatgataaatgtgtgcgtgggatcctgttaagcagggaattcctttgaaagccttgtttcccttttctctccatggcccagagatagatcctggccgcatttggatatgaaaactcctcagccttgccgtgttctcctgccccttgagagttgtgttctgtttgaaaagagctgaacaaatgaaggctgttttttcacttgggataagaatatccttctcaaagcagtaagggctgaacgagggtaacaggatccatatgttgaagctggctgctaatactcagcatatggtccagcaaactttcttggggggactcagcttctcattctttaaggaatgctccagtgaactccagaaaagatcaggacttaggtgaccgtggcatagacacagcttctgggcttcataagcctgtagttcccagagaatgagagccacgggaagtgacagggaaggtcctggctggccttagcatggatagcactggcctgcagctctctttgtaaggctccatgctccccaagatacgatgggcccttatcaattcatgggctctctgtgttctgttaagggatagtgaatccaagggttgttacttggggttcccagatggtgtgttctagtgaatggaaacgttttgccctctgtgcaggggcagcattgcatcatggaaagatcacctacccggagccaggaggcctgggctctggggccacgctagccctaactagaagtgaccataggaaagtcactccaccttttcctcatctggaaaatgaggaggcaggatgtggtgatgtctgagacccctttgggctctcacagtgtagaatcaagtggcacctgaactccatcctgaggagaatgacaggagaaagcacccacagataatcacacttgcactgcgggcagtgaccccgcggcatagtattccagcacagctctgtgtgctgcgaccacattcaggagaggcaggggaagactttttattgctctcaggcaagaattcagtcctgagcctcagggagccggcagtggtggtctgagcaggggagaaactagctgccctagattactctatttcttccaaaccagtttttggaagtctgggttttcccctctgattttcacagatgacagcgtcagcatcttccccctgcctctgcccagggccccatttctccccttatgccctcctccttcccttttccatccctgtctccaccacatcacctctttctctctgaagcctctgctggctttctccgtgacctgccttgtctgttgctggcatggttaggaaggccgcacccccttcccagccccaagcaggccctctaatccctgcagtcggctgaggacaactgtagtctctccatcaaataagcatagaccaagacctgcagcagctctgcctgcgagccggtcaccatggcaacgagcatcacctccattctactgtgaaaagaaaatggctgttggaaggaagggctcactgaatctccattccccaggctgttttgttcaagcctgtccctcctgttggccagaagaagccccatgcactgaaccaaatacctgtttgcctttagatttggggtttacttaagagaaggaaaggcagaaagaagttgaattcaaaggaataaagcatttttccacctcgaaactctattttcatgaggaatggttgtctgctcccagcagataaacgaggagcagatgaacacagggatctgtgagatctggcgcagtgtattttgtcttatcggtgcagtggaatgacagagcatatggatgttcaaataaatattcagggaaagtagccaagggacccagggaattccacagggcacgggctacagaatttccaaagggtgtctgactaattggggtggtgatatgtgatgttggctcctgttatggaaaaaggtgtgttggtcctgtagtcgtgagggaaggtgagggtttacccttaccatccccacttcaaaatcagtgtgagccctcctagtgattgtgtccggacagcctggggaactggcaggagacccctgagcttgattctggagtgcagccttactgcacttgacacagctgtggagacacttcagatgacatccagaaggaactggttgggtcaccatttctgtgaatcccaggatgttgctgttttggagcaggatcataagtcttctcaaggggttggaaacatttagtgcagagatcacccagaatctcccagggcaccttgcactctctgaggggaaatagctattccataggagaatggtctgggccgtgtctctctctggctgcacatggccctggctgttggtggcacaagttctcaaactccacacaacctcctcccttcactctttcttaaagtcagttgggaagcctatttttgaatggaagatctgggtttcattcttgaacattggaatgtacgtttgaactgaactttgtgggtttttttttgttttttgttttgttttgttttgttttgttttttcagtttctctgcaggtggatattgttcccagccagggggagatcagcgttggagagtccaaattcttcttatgccaaggcaagtgcctagtgctcagctgcattttagaacttgcttcagaaactcactgggtagagcaggagccctcaggccatgtgagctggctggtcaagccacacctagaattcttggcattgctctattacagggtcaatagtatggccatttaagagccagggcctcttccttccttttgcaaaaatctgcctcaacatagcaaatctgtcatctagacttcaccttgactacagaggaagtctaggagttttcttagaaaaatcagcacaacttccagaatagtgaatcatcccccatctcctattctgtatacattcagagttctgtaaatgacaatggagaacagcactggctcagaaacaatacttcggtggatctgtttaaggcttatttcttagaattccccagagcttgaaaatctaagtctaaaacttgcctgtaggtaaatagaatactggtatggcttttgttgtgaggacatatatcctgggtttaccaggtctattgtgaatatcgatattctgtgccatggtccccaccagagctctgagatatgccagacctggtgaccttgttttacatttagaaaacatgccccatttccacagcccagataattgccagaaaatgtcctgtggaggaaaaggtttcaaattaagcctcagattctctgtatatgacatgactgggattcagaacatggaagaaccaggaaagagctgagctaggtgtaaatggtgacatttagcaagcagcttttggcagggaggggcctttaaatgctgtcatgatttgcgtggacgaggtggcttgtggccgtcggatgtgttcactccagctttgccttcattacagcaatttcaatgatctggagacgcagccgtggagcccacagcacatcttgcaaatagcgatatttattgaaaacatgatgggccctgaaaggaagactgcttcatttccatactaagcatctgtgcagggctgggtggtgcaggctgagaagggcgccacgcgaagaggcaggggcccatgcaaacaggcagggcgccgccacatccgccggatctgagcgcccttccagctcagtgtcctgggcagtttcagtgtcagagccctgttccagctcagtgccgggggcagctcagccaccacagtctgttcctcctcattgctgcctggggaaaggaagaatgggtggttctggctaccttctttgcagcatgcaaggaaatgaatttgtctgagcagggagtgacgaaatgacagtcatgccagtttgtgcaggcagatgctagaataaatgtggctggaaaaaatgaaataaaaagtggttggaatctgcactcctatactagccagtatttctcgccttcatctcaggagacccattatccaaggcttcaaaaacaagctgatcagtagactcagaccagttaggctctggcgcccgaatcctaaatacactaattcccttggttacccgttgtgtgaggcatgtgtgttcctagcttagtgcccagcacacagtatgttctcaacaagtatctcttctcttccatcattagggataggaccatgataacaactagtacaagtggttgttgagttctttccaaatattgtaagaggtgttaagtatataatagttaaatgcagaggccaaagaagggctgcatgtcattccagcagccatactcacccctccctgatgttcaagccttgactgatctgttgttcagtaactcttactgatcagccactgtcagtctggaggggacttattagtcttttcgacttcagtagcttaaaaataatctcttcctctttagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcgtaagagcctccttcttcttctgcattctctggcctctccttgccaaggagacatgtgggtagtggaaaggtggaaatgatgacagaaggaccagctgagggcctaaccagtcccattctctctccctaagtcttttctgaccttggccaacccagaactcacaaccctggttcacactggtcacagctactcccccacaggcgttcattctcaaaattcaaattacatagttcccagagggctattacgggtttctctatcccttccccaaatgttggctgactgttctgcaatttgggctcctctcccttcttatttccctctcccctgctggtaatggagcccagggctcagtggggtgggggatcattatctgaacactctctgccactcagagcaggcagttcctattgcctctgaaaccccatctgtaggtggcatctcgttaccttgttatttatatcatgcatccatcccagtggttggagtaatggtgggtgacagctaatggaacagtattgattgcacggtatttattgccattaaatgtgcttttttcctgttcttttcatcagcattctgtctgccgtaggaaagttggggtgggactgggagtagcagttcgagtgggagacaagaaaaggactgatgattcttactattcgttgtggaatggatgttccaccagttcattctacctataacctgtgcttcactggcatcatcctgcatgacaaggaacccttggtgaagatattcctttcattctgtagacccttttctgcacaaaatgtgataaatttagcactcaatgagcagatattggttgccaagcattggtaacctatgcttgggccagctgctctgcctgacgtctctgagggtgcccctcttatacaactgtacatcaggatcgagacttgcccaggactcaagtccaggtaccatggctctagtgaaaggggttctttgtgagagaagcagctgttttccctcactcttctgttcatcttccagagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatggtgagacctgaatttcctggcatctgccttttccccaggccaccaagttccctagctttttcacctgtactgaggcattccagtccaaactccaattcatgtgtgcccgaaccctcatgtggtttctgggtcctgaatagatgcatatctgaagttggtatacttaggtacctgattttctctccagtacgaaagacaaatttctaatagacatttactcttggctgtatttcaaagccagggacgcattttcttatttgggcttaaaaccccaccctatgatactgaagttaggaaaaaggaaagagactcagccacctgcctgcagatgctctctgactgattcttggatgaacctgcctcttatctcttctagtccgattcatagtcctgtccaacaactacctgcagatccggggcatcaagaaaacagatgagggcacttatcgctgtgagggcagaatcctggcacggggggagatcaacttcaaggacattcaggtcattgtgaatggtgaggagagtccgttcttcctgatctctgcattgctacaaccttggttctccaaaatcattctctttaacttcctcttgggtctgtaaattaaatcctgtcctgactcaatcatccgtctgagctaaatcccctccccaccgtaacatctagatttctttttttttttttttttaatatacttgcctgttggatcttccttcaactacgagggattttagtgcagcaactgaatgtccttcaccgttctgcagcactaaaaactttccccctgcttacctattaatcctcattgtccttgatgttaccataattgtgaagttattccgctgcttaaatgttcaaagaaagtattaagtcaactcaggcctcagaatagtcagaatcatggtccataggcttgttaatcttaacttgcagtgtcaaataaacacacccatggaattgatctgacatttacaagatgtttacaggaaattataatgtcagtactaagaaaataagtaaatcagggttgaattgttttgactattgacacatattttttttgccaaactctccccatctcattcctttggtaaaaaacagttttgtacaaggttgtttatcacagtcccagagaaatggcactctttgttatagctgatgcattcgaattggtgttaaccatttaaccactgggagcagtaatgtccaactttttccagtacaaagagctcctttttaacatcaagtttcactgaacctggtagttattaagtttagtatgcattgactgagaaaatacataatgaagaatagtgactataaattgaataccatcttaacatgcataaaatgtattactatagcttctcaattaatgaaaaacaaaaatgcatgtttgtagaactgtctattcagtttgcagaagttatttagtacatacatgaatttcaattcctgacactaactctgtagctgcacacgacgtttgtcccacaggctgagaactcctgacctggagtggtgtctcttctccaggccattgggttcttccaaattttcacaaccaccccatgacacccttttttccttcagtgccacctaccatccaggccaggcagaatattgtgaatgccaccgccaacctcggccagtccgtcaccctggtgtgcgatgccgaaggcttcccagagcccaccatgagctggacaaagtaagaaactggctcataccttttatcatggactagaggagaatggggcatcacaaagtctgctccatgttagtgtctgcgtggaatggatgtgggcttcttaggaatattaaccccaggagaagaatggactcttttctataagattctcttgcttgtgcattgattattccttcaatttcagccttgtgggggcagagtcagagccagagggtgtggtcttgggagcccactttgaaacatttgtgggtacagttgcagcccttggatagtcagaggatggaatagaggaataagaggtgtatgtggacgttcaacttggtgccttaactttttgtgaagactgaggagtctttcccattgactcagtctgcattctatggaacctaattaaaaataaacgtcttatttctgtggtcgaaatcatgctactttgcatttctacatgctctagggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttggtaggggcagtgggggcccaggtcactgctctgccacaattccccttcctctgcacattcagtccatcagtaagaccctggccactgtccctcagaacataacccaatgcaaccatttcttgccagttccaccacctagtccaagccctagtccaagccaccatcatcctcacctgagcagtgggacggtctcatagctggcctccccgactctccctattggtccacttcattcacttctgctcacagtagtcagaatgacctaagtaccactcatctgtttgaaagcctccagtggctccctatggcaaccagaataaaattcagactccctgcaatggcctacaagaccagagatgaactagctcctgccttcttctccagcctcatctttctttcgctttgctgcacatgcaaagttctccaaccacacaggccttcttcatgtccctcagacataccaagcttgttcttcatctcaggatcactgccctaggtttctcttctgcttggaatatctttccctctgatccactctgagctgccttcttctgatccaccattcagatcttaactcaaactcaccttctcagcggcgccttccttcactgccctggctaattcaactccctctgcactgcgaccacccccacccacctccactcatctctctctcgtgactcttactgtatcttctttgctgtacttaacagtacctgaacagatgtcatttgcatatttgttttggggattgtctgtctcctacctctactagtgtgtaaacttcaagatagcataaccctggctgtcatacacggcgttatccctgtgactccaaacagtgccagacttggcataggcccttggtaactttagtggtcgatgggctggctgctttgccttgtttgcctccttccctgacctgtgcaaaacagtgtcatggaagagcccccacatccctgctcacttcatcttcataaactcaggaaacttccattcatttcagaactgaaaagcattttgacctgatcttgaaaaaagaattggttgcagagaaacgtttaacctaatggccctcaagtctctccgcgtgtctgtttagaaaacacagataaactggtctactgtagacagcactggggaagtgccagtctgaggcgcagctctggtgcatggagcccccaggtcattaaaatgtgcacctgggaatcagggttgggacctgcttatccagcctgataaggagaactgttcataaacacagacctttgaaaatcaagactttatatgcaaatgtcctgctagttattcagtagtaaacagctgggtttagaaacaggctatcagttaggttcaagttaaccgtacgtatttgagagagaaagctaaacttcatgaaaaatattcttgaaagtcttttcttgaattcagactgatcttccccaatcactatggttttagtaagtttttccatattgtagaaaaagatagatgcatttgttaattaatcccttcatttaataaatacgtatggatcaccattgttgctggacagaggggctacagagatgaataggatatgatcccttgaccctgggaagcacaaagagggagataaatggataaacataaatgttataatagtgtcagtcagcaacatttgagtgactgctgtggactcagtcattgccaagtttacaagatgaataacatggactctgttctcatcagtagattcacaagctaatgtagatagtcaacgctggaatttgaaatgacaacacattattatggctgcaaaatagcaatatgcacagtgttttataggaaacaagttctctggtcctgtgtgatgtaagttagagaagtcattaaaatgtactatttcataagtaggaattacccagctgaaggagtggatgagaattttaggcagcctgggcacaggcacagaggcaggaaaagcacaggctatgctgaatgggagcttcttgtggacaggggctgtgtctgttttactcacagatagatccccagcacccacatgcattaggcactagattgaataaatgaaggaactgtcattagttctatatgatgaagcaaacatacatatgtggcagggagataagcctggaaacacgatcatcacctgtctctaggaaattattttagactttaactccataaagtagtaataataataatatcaaacacaagcagaacacctataatgtgccaagcattctgtgaagtgctatctgtaagttaactcttttaatcctcatcacgcccctatgatgtagattttattattatccccattttacaaaggaggaacctgatcacagagggatgaggtgcctctggattcaaaccgaggcaggtggctcctaagtcccttctctaatctaacaatgatggttgttaattccaggaaacccaacaggacacaaattgtatctgaattatgtgggagtgtctggcaatactagaatcagtgcactctgcctgcatcaccaggtagctcatggtttctctgaaaagcaactcagccctgacttggctgggcatgaacagatctcggcttctcttccagacctctctggtggtgatggctgccccggagtagtgagtgcagggccatgtgggaccgtggtagagggaagagagtgggtcaggtcgacgggaggaggtcaaaaggcagaaactgccaagacaagatttgtcttcccacccacaccttggacacatacacccctcttcatcacaaacacacacacacacacacacacacacacacacacacacacacacacatatttcacaatttctttcccgaaactgcagctggaagaatagggagcatagtggggcaaacagagaagaggtggccaggctcctgaagagacagggcaggaatcatagatttgtagagactgagtccacacagaatgggaatcctcccctgtcatagtctgcggagcgttcatgcagcctccctgaaggaacctggtgcctcttctccaccaccttttcccatccatcttcccttctcatcctcctttctctcctcctccactggccttcccattggttgaggaaactgatatagggttagggagccacctggggagggaccagctgattagggctccttctccttccactcttttatttcctttccagccccttccaacttgccattgtggcccatcactgggggagaaatgggacaggttctgcaagtgggagtagagtctacagcagtgaggtagaaaagggaggaaacctgtagcttagatagtaaagaaaagcccagaagtcctgtggcctcaagaaggaatgtccatcagtatgtatgggacatatctcaattagagactttatgacatcatttgtatctaagtggcatcattctttcctcagaaaaagacatgttctagcacatgttgccttagttattagctagatgctccttttactaagtagatgcatcctatcatcctttaaatttggcagtgaattctcattactgttgtccctacacgtgcccctgaagaagttttgtctctattgattcttgtgatgctcatgtacatgctcttgaggtctcatgctgctgtggctgaggaaagttctccagtggccaggagccctgtgtctcaagcagcccctgagggttacagctaaggacaagcagtggcctgaaagaaggtgcatctggtcatgccccatagcatagtgtccaacctctttgttcagggatgcaggggcctcggggctcttctttggctagggttgtaggagcatggactggagttggagtagacaaggctgcctcttagtggcaagcattcttggaaaactcacaggaggaaatatggggaaaggtgcagtggaacagtctgaggcactaaggcccatggaggcaggtggagaatagaacagggatccaaaagccaagaactcataagagaggttaattaatagagggcagggggtgtaggaagatgaaacccagagagatccctctagatgctggaaggcagagggagggaatcttttcagtagggtgacccagcatctgtccctgtttgcctactaatgccctttgtcctggtgtaattatttagagcctctcatgtcactctcaagagagtcccaatttagacaataaattatgcatatcactgtcttgttctaaggtggcatctgagctttctgagttagttctgaccgtactgcttctagagtaatagagaattaaattatcagtgggaagcttcccttccttcccacagcactctgtagactatacaaaattagccataatcatgttttaataagaatatggtttgccttttttctaaggagtcacacaatgcaccttctgtagccatctgggaaatggagcctccaaggccaaatattaatagatggcaactgacccttgcctgtcttctgttaaccttcggctgccatgacaaagtaccgcaggtcaggagaaggtcagcaaaacgctgtccagatctcagagtctgacaagattttaaggggccccaaattcagccttcctgggattgtctccagacctcaaaacaactgttgagtttagcgaattcagttgtatggccacattttttttaaattttttattctgtgacttttacaatatagagattcagctcttactttacctttcttttattttattaacctttttgtttttcatgtttattttacctttattttactttgccctctaaaacttccctttcaatggcacttggcacatattccttccaatacgagttgtaatattctcaaaaatcgtacttattaaggaaaacacaatagggaaacctatgaggtttaacctcattcatgtggactccatcaactgaaatctatgaacatttggccagattggattgagatgtgcctatgtgctatccatcaaaaaaggatttgctaaacaggctgtcagtatgcattacctttaggcaaatatttgaactatatggatgattttatgtagaagcaggcatttgtaacaaaagtatatagttctattattgttttctgtttattaaaacagcatcaaagacctcaacatggagaagatatataggcagttgtttatttgcctacttagggttactgtatgaatttgaatataaagcacatgtagtctttcaaaaactagctatcattctcttggggttttttggttcatttgtttgtttccctagcctgaccttttcctatattcatgaaataagtcacatttgtgcagtgttatcttttctcttccacacaaagttcagcaatttcagagcataattgttttaaattgggaaaattcaattttctctaatgttttaacatttaacttagctttggaatgcttgtgttttcttgcattacccaaaacatttggaaaatgaactcatctcaactcatctccttcccatcctgagcccaccccagagcccccatccagttccttgcctgatttcttcatttgagttaatgctaacacccttctcccagtcgttgagactccaagtcacctggactccttcttattgcttcttttggttcttctcacccctccttgccctctgttcagttgccacttattgaaccttcctccagcatctgtctcaaagcttctctttgctgtttcccctcaaacaaccttgttcagaatccaacattaccgcacatctgggtcattgccagggcttccaaactggttttcccacttcaaagtgttctctagtccaatgcttcctgaaatgtccctagattaaccttcttgaaatacaaatgcttttgtgcccctgactaaatgctgtctgtgggcctccaccaggcaccaggtaaaattccagccatccagcctcaccttcctgtgcctcatgccacactgttctcttcccagccatctcttcatatgtttttgcttctttgcttttattcagtcagtttcctacacttcaaatgactccatctccaccctagagttccacctcctgaaaatctcatggtccagccccaaagccgtttcctctcgaaggctccatccagggagcgatcttccgccatgtcctgcctcctgcattccttgcccttatcacttttactctataggatatttctgattattatggtttccgtgttgtcacatgcctacatcattgtaagccttggagagtcaggtctgcatctcctaaaacacctagactagggtcttgtacttagcagacagctaacctttgttggataggtgcatgccatcatttaaacccagaaagctcaataattagataaactcagagaaatgttttgtcttttcagcaaaacccaaaatcacatatgtagagaaccagactgccatggaattagaggagcaggtcactcttacctgtgaagcctccggagaccccattccctccatcacctggaggacttctacccggaacatcagcagcgaagaaaaggtatcatgctccccaggagtttcagggccttggaatgcagactcaaagcagattgagtctgctcatgcccagttctctttggggagctgggagatgggttatggtcaccagaggccacagccagatcccggggcctccctccccaaccctgcaggacatggcctgctcatcatccccttgtaatggaataggcacaattccttggataggttggtgggggcgtgatgtatgggcatgctcaagttagatgttctggggaggaggcaatggtgattgtcaatcccagagttatggagctgtgagggaacaaagagaaggcaatatcctggtccaccaggtgacattgtcatcatatcaagggcaccctaggaaagatctcccagaaataaccaggctcaaaatgaacctattaattctttttcttgtgtttgtatactcatgctatatatgcacttatgcacaaatgcctggttgccattgtgtctgcctgtattcttggtcacatttggataccattttgttctaaaggcaaaaatatttagcagtttctaaatgaggattacatcctggtttttcaatatattcatggagggtttaagaacattgtagcaaccttcctggcaaattaaaatggcgggaaagattgagctttaaagtccgtggatttgtaggccaccagaaagctatctttattgttgacaatatataaaaactgaggtgaccccacatcatacagcccttgattattgagtgggccaaaagtaggaggaaaaagcttcattttaatgcaacttaaaccgtcttatggtacttctccaatctcatctcgtatatcctgtagtaatgggctttgttttagttagcccaagttttgtcacctagtcaggaataatggccttagccttatggaacatttgtaatggattgcttattgatcagaatgtcaaaaatgatagattttcactcttctgcctgcctaaaggaaatctctagagagagtaaactcaaataaagcccgaaaggatagtgtgaaattccagagttaaatttgggatttgcatttgaggagctgatttctgtcccactaatagaaaacaaaactgcatcaaatggaacagaaattgctcttccaaataacctattattttttgcaacttttacctgcagagttaaattcaccttaacaaaaagtcaactgaggaactgctaaatatttttgaaacccacatatgctgtttgaaactgtgaaaaccagctagattaagagatgtggtgtttacttggatactttctttatcaacattagaattaaacccttagctaagatttcagccccactcatgtgtgttatgtggatttaatgtacatttcagggcttaaaccacaaggctgctgcttggcagatctttctacatcagcttaaaagtagatttttgtccagagtgacccagtgtatatctttgacctacagtgaaggacagaaataatatctatctcagatgaatgatgcttttgaattctatatcttttctaggaatagctcaacagccaagctagaccagaaaggttattaagatttgtgcctactgaggttctttaataggttggcacttctggcttgtagctatgatttcattttttttttttttttttttttgagacggagtctcgctgtcgcccaggctggagtgcagtggcgcgatctcggctcactgcaggctccgccccctggggttcccgccattctcctgcctcagcctcccgagtagctgggactacaggcgcccgccacctcgcccggctaatttttttttgtatttttagtagagacggggtttcaccgtgttagccaggatggtctcgatctcctgacctcgtgatccgcccgcctcggcctcccaaagtgctgggattacaggcgtgagccaccgcgcccggccgatttcatttttatagaatgagaataatagccaggaactaaaacacattcatacttgctaaatatggagacaggtgtccagcagagactgtctcaagcctagtagtgactactttttatataattctgctatcactatagatcatttgtcttaatcttagatcattatttcagcccagctacattggttgtattgtatttcttttacttgccttcaagttcactttattggaacatgagtgaatcggtattaaaacaagtcctccaaatcagctggtgatgtgacaccagactgacatatttgcctaagtgaaaccctatataagaaaatttgccatttctgttaattatatattgacgtcaaagaggcgtattgtccatcttacactgtggatagctaataattaagaaaacaaatataggctgttcatgaactggttggagtacagaaaataaatttcacttttactttggcagcctctcctcatgttctcctccatccgaagttgcttctatataattaggaatcaagattactagcatcactgtaattgtaggagtggaaaacaaccattttctttttaaaatcagggtgatatgctaagcaaacaagaatagatgattgtatctaattggtcaggtaaagaatcctcctgagatttagatcacataaaatgctaaaatcatagatgttcggaaggcaccttttgaggtcatccagtctcacctggcaccctggcctagcatccttgccaggaagccagtccgtccctgtctgaagcatgatggtgtcagtcctctgcaggggagttggccaatgctgaagagcagaaagagctacttccttgccccttcctctactcagtcctcctagcctctgccactcagtcctttgcatgagagacattaaaaactctccgactttcctccagtccactcctcttaccttgaacataccagttattttcactatttctcatatggcatagtttccataccttttatctttctggttgtcttatacgagatagtttcagttcactagtgctcccctaaaattttgctgtgctcagtgtaattaatgcagacttcaggagggctactgcctctttgatctggatgccatcatgcagaaaaaggcacattagctcttagcagtctccttattctgttgcctcatattgagcttgtggtcaactaaaatgctcaggtcttttttacatgatccccatttaagccacatatcccctatcctgttcttatgcaattgattggttaaccgatattgcagaattttatatttatttatgttaaaaattgcattttgtttgttgcagctcagtgcttctcaacagggtcatggtggcaatttgggaagaggcttccttcactgggactgtactatgcattgcaagaaacttatcatctctagtccccttcctgttaaatgccagtagccacctctaattgttactaaaaatatgacacatacaaacaccctgtggcttgagaatgactgtttgagtccatctttctaaccagtcaggactgactttcattagaaattcaccttagaagtctatgtgtccagggcacttcaacccatgtgtatattaaaagtaaagtagtagagtagtcagtggagatcccagcctaagcatagagcccaagagcaggcagtccagtagccttcccaatgcagtcgtcatctaacatttgtattagctgttgcttccaaccttgtatgaacacttatttgcaatatctttgtccaagtcactgatagaaatgttgactagaacaaggtcaagtacaaagcccttagactgccacaatggcttccttctggctcggtggctcagaaggtaggccacttgatgccacggtgccacagtgctctctcatggtttgtatgactttagtggaaggttcaatgattcctttaacaaagttagttacaatattagcaagttaaagcagttttgtgttttgcttcactgctgagtttagtctagtattagtcttcttaagggaagaggtggaaaaaaggcattcaaccatagacatatagttactaactttctaatggaataccaatgttcttgttcattataaaagaaggggggagataagcaaaaacaagtacaatgagcgtgaatgtcacactctacctttgatcatgtctctgtattgagtctagttactcatttgagaatgaccattaccaatctgttaagcttcagctagttgagttggtttagctcgacaactgataatagctagggtacctaattgtttggatcatcgagatcattaaggtagatcagctgtccaaaagttgatgcatttcctagtagttactattacattgaccaaaaaaattgaccatcataatgggtcaatttgatcatctgtatgaaagtcattgtgatacctcagaaagcttctgcttccatgttatttcactactcatcctgcccagattccttttaaatattgccaggtgtttgagtgagtggtgctaaattccaggtttcatttacttactgactgagacccgtggatgatgatttacgtactctatccctggcagaaaaaatccatcatatgcctctttgaacatctctatgcctttgaaatgactgacaaaggcctatgaagccttattaaggaaaggagagcagtgaagaattgagatcagaagagataggaaaaatgaaaagcattctgtgaaccttgaatcttaggctgacagaatatcccacaagtaagagagaacttttgaagttctggattctttggaagctggagtttccttttcacgagaaaaaaattcctcattcagtacaaacccagggcccgcttttaaacactggaaaagatgactgcattaagcaatcagtctggtttatccagcgtgtgggcacatgaataatggaatacctaagaaaactatagaaatgcttcactttattttatatatgtgttcctgcagacttgtgtgtaagacaataaaatatgaatatcaaaacaacctagaacaatttttggaggattactaatcacactctgatttatttcataagtgtgtacatttgcatatcaggttgtcctaatgtgggtcacacattcaccaaattgttagggccgagatatttcctatctttccaccaggcacaaaagtagaaggttatgttactggaagctttgtgttactagcaactacttattctaaaagccacagaaccatagtgatttgggagagacacaaggataatcagatttgaaaaaacatacaactcaatgtgatagagtctctcaaaagaaagatcttgattcctgcagccctggcatgtaaccgacaagcttctaagtgatgtggaattggcaagcacatttgacgtgttggcccaccgttactttggtctctgcatgttcctctgttctcaccttcttcttcattcccacatcatgtgacataactcgatatttccatctcatttctcacaaaagttccttgcatttagtggactcttactaaatgtttgctaacttatttgcattccctgggttgcgttgctatgattctggcatcttttctatcctttttccatctgaacatcagagacaatcgggcagtcttgccaggtaataaaaagaacaatgcagctatcatgtctttgaatcctagtatgaaaaacagataaactgtaaggagaatagattcccaagtgctggagaaataaaaaaatctagatgtgggtggaaaatccctctaacctctgtgtccctgggttggcttgcaaatgccaacttgtgaatggaatgccatgtttgatggagatggtacatgctggagtccacataccatctgtgcattctctgctgttaaggactggagccctccctcaaccacttccatttggtatcctcaaagcttcctgactcctggtctcaaggacttcatacttctcattcctagtgtacctctctgctccttgctttgttcctttttggcaataaaaatttgattttaacagaatgcatgcaaagagttgtaaaatgcatgagcattaaatggcattagtatatctatgataagctgccttataaaatccaaagaaggagacctattctctctctctctctctctttttttttttttttttttttttgagacagagtctcactctgttgcccaggctggagtgcagtggtgcgatctcgctcactgcaagctctgccttccgggttcacgccattctcctgccccagcctcccgaatagctgggactacaggcgcctgccaccacgcccagctaattttgtgtattttttttagtagagatggggtttcaccgtgttggccagcatggtctcaatctcctgacctcgtgatctgcctgcctcggcctcccaaagtgctgggattacaggcatgagcaaccgcacccggccagaggagacctactctcttaagtgtctctagataatgtggttagaactagtcatgtcaccaaatactatgagcaatatttaaggtattttggaacaagagcagtctggtcctactggtattcatatctaggtataccaaagattaggaaaacctgaaccttttgaattatacattttaatgtgcctaagggggaaaaaaagctggacataagctaaatcctaaattaaattgtgtaataaacacaccattgaaagtgggccttggaaaaagttctgaattaaagaaaagctgcatgtgcacggaatgcagtgtgatacattctctaaagcaacatgttgtaaaattttactgctttcttgttgtgttttatatcttgttttctccaggcttcgtggactcgaccagagaagcaagaggtatagcttacctgaccactagccagtctttagttttgaaagcattacagtttaactcaccattgcagtttaataaccagacatgctaaactaattagtaatttagctaaagaataggtcgatagtggtagacattacttagcaatagtatcattttaggatgagcaagcaagctgtgttgggagtggatgaacaaatccatattatttcctaaaactggatcttattctcttgctggtgctggtaaaatcacatccaggtaattacaccaatagaaataaattgcccccaattcccaggccaggcattttgaaatggtgaaagttttttgactcacatggttgatgtggctctggaccataaagtcacagagttagtgatctaaaaacccactcctccctttcctttccagctcaactcatcttgttgctcacttattttataatgatcagtcttggtaaattatcacatcacgtttcatctcaaaagcaatgcaaatgacatctctcgttggttttcccaaattgctaaacgtatctctgttacttttatagagcattaaatttatgagattagaatgatgtggtacaaatggttttatgttttttaaagtcagtagcatttaacctttgaaatttctctgactcattgcttcagtttggataatgtgggacttagtttgaaaactgaagttaagtattaatctttaggctttgattgccacatctcaagaccctacttatgatcatgactataattttttacccgatttatatgaagtaacatatagtgaaaatgaaaccagtggacttcagatgagattcaaggatctaatctctaaggacttttttaaagttgcctttgccttttatccagatggggctttgatcgtgtaatgctataaatgcagaacatcatgatcctatagattctgtattttaatttggtaaatctatcccttagtctttcagaaatgataattattcagaacgtataactcaagtgttcaggtcaaggctatacatatttatatgctgtttaatatttaaaagttgactgcctgtccccaggcactgatcttagtttctgcacatgaacaggctgccattgtcaaattcagttcattataaacttcctgtgtataagactgtcctccctgtcattgggatgactgttaagtgcacagcctcactgagaggcttcccgcctgtggcacaggaatcacttagtgctgtcacaggttgggtgctttattgtccaaaagtcatggacccactgggattagggaagagagagaagggttaattatcagccactcttaagcagctacagatctcattctgcttggcctcatacaactttccttgtcattctcatttagagctggttgaggaggagctgagatttatcagggagcattaaggagatgttaagagaattattattgtaagtggaagtaataggtttactcccatgaaagcagacacctcactctgtttttcagaagtgtccttatcatgagtgtcttactttggacgtaattgactttcaagtgaatgctgcccctagggctcagaagttccattctctcctgtttgtctcatttggagatgaagaccataagtccagatgagtgcaaaagaaggctcaggttatggccagtttcattttgtaagttctaaaagcattagcacttttacctggaaggagggagacaaaaacattttgatgagaagaataattatcattaaccttcatatttttggggaaaaaaggagttttcttgccatcaatatcttttcatacttgcccagagctcatctcctccttctgctgcagcctgggtggtcagcatgactttttgtctggatggctggtaggtggcacaccctgaagttgtgcaggagccatagtaaaagcatttcaggggaagatagtctaatgacactggagtctatctgtgtatcctcaaagggagaactgggcatctggcagataattccatcatcaaatctgtagtgagcctactgcaaaataagaattctctttagaaggctggtctgtggacatcattaaacaggagaaatttccacatggagaaatttcctgaaagaaactagataggaattaaaaaaaaaaagtatggctgttcacgcaactgttttctaagcttcccttcaaccatttctagactattctgagtaaagacttggaatatcccctgctttgttgtcgttaaggtcctgttcttgcgtacattcatttctctgcctcttttgttacaacatctcttccttatggaaatgttctcttgacttccagaagagtattgttcaatttccaagtttgtgtgtggtggccccaggacaagtctggtctgtgtcacaaagaattttagttcagttgctggttgatatcacagagatcaccagaaaggccaggggttgtccttaagttccctctgcctgcagtcctgctttgttttggacaagtaggagtgacaagcaggtcagcacagccctttagagatacctgcagggatggccccatgctcttgaggccactagtctagactcacgggtaaagacttgtgtatgatgtatgaaaatagccctggaggtaggggcggttccaagatggccgaataagaacagctccagtccacagctcccagcatgagcgacgcagaagacggatgatttctgcatttccaactgaggtaccgggttcatctcactggggactgtcggacagtgggttcaggacagtgggtgcagcgcaccgagcgtgagccgaagcagggcgaggcatcacctcacctgggaagcacaaggggtcagggaattcccttttctagccaaggaaaggggtgacagacagcatctgaaaaattgggtcattcccaccctaatactacacttttccgatggtcttagcaaacggcacaccaggagattatatcccgcgcatggctcagagggtcctacgcccacggagcctcgctcattgctagcacagcagtctgagatcaaactgcaaggcggcagcaaggctgggggaggggcgcccgccattgctgagacttcagtaggtaaacaaagcagccaggaagctcgaactgggtggagcccaccacagctcaaggaggcctgcctgcctcttgtagactccacctctggcagcagggcatagccaaacaaaaggcagcagaaacctctgcagacttaaatgtccctgtctgacagattggaagacagcagtggttctcccagcatgcagcttgagatccgagaacggacagactgcctcctcaagtgggtccctgacccccgagtagcctaactgggaggcaccccccagtaggggcagactgacacctcacacggccaggtacccctctgagacaaaatttccagaggaacgatcagacagcagcatttgctgttcaccaatattcgctgttctgcagcctccgctgctgatacccaggcaaacagggtctggagttgagctctggcaaactccgacagacctgcagctgagggtcctgactgttagaaggaaaactaacaaacagaaagaacatccacaccaaaaccccatctgcatgtcaccatcatcaaagaccaaaggtagataaaaccacaaagatggggaaaaaacagaacagaaaaactgaaaattctaaaaatcagagaacctcttcttctccaaaggaacgcagctcctcaccagcagcggaacaaagctggatggagaatgactttgatgagttgagagaagaaggcttcagacgatcaaacttctccgagctaaaggaggaagttcgaacccatggcaaagaagtcaaaaaccttgaaaaaagattagacaaatggctaactagaataactaatacacagaagtccttaaaggacctgatggagctgaaaaccacggcacgagaactacatgatgaatgcacaagcctcactaaccaattcgatcaactggaagaaagggtatcttgatggaagatcaaatgaatgaaatgaagtgagaagagaagtttagagaaaaaagaataaaaagaaacaaacaaaccctccaagaaatatgggactatgtgaaaagaccaaatctacatctgattggtgtacctgaaagtgacggggagaatggaaccaagttggaaaacactctgcaggaaattatgcaggagaacttccccaatccagcaaggcaggctaacattcaaattcaggaaatacagagaagtccacaaagatactccttgagaaggacaactccaagacacttaattgtcagattcaccaaagtggaaatgaaggaaaaaatgttaagggcagccagagacaaaggtcgggttacccacaaagggaagcccatcagactaatagctgatcgctcggcagaaattctacaagccagaagagagtgggggccaatattcaacattcttaaagaaaagaattttcaacacagaatttcatatccagccaaactaagcctcataagtgaaggagaaataaaatcctttacagacaagcaaatgctgagagattttgtcaccaccaggcctgccctacaagagctcctgaaggaagcactaaacatggaaaggaacaactggtaccagccactgcaaaaacatgccaaatcgtaaagaccatcaaggttaggaagaaactgcatcaactaacgagcaaaataaccagctaacatctcaatgacaggatcaaattcacacataacaatataaaccttaaatgtaaatgggctaaatactccaattaaaagacacagactggcaagttggataaagagtcaagacccatcagtgtgctgtattcaggaaacccttctcacgtgcagagacacacaggctcaaaataaagggatggaggaagatctaccaagcaaatggaaaacaaaacaaggcaggggttgcaaccctagtctctgataaaacagactttaaaccaacaaagatcaaaagagacaaagaaggccattacataatggtaaagggatcaattcaacaagaagagctaactaacctaaatatatatgcacccagtacaggagcacccggattcataaaggaagtccttagaggcctacgaagaggcttagactcccacacaataataatgggagactttaacacccactgtcaacattagacagatccacaagacagaaagttaacaaagatatctaggaattgaactcagccctgcaccaagtggagctaatagacatctacagaactctccaccccaattcaacaaaatatacattcttctcagcaccacaccgcacttgttccaaaattgaccacatagttggaagtaaagcactcctcagcaaatgtaaaagaacagaaatgataacaaactgtctctcagaccacagtgcgatcaaactagaactcaagattaagaaactcactcaaaaccgctcaactacatggaaactgaacaacctgctcctgaatgactactgggtacataacgaaatgaaggcagaaataaagaagttctttgaaaccaatgagaacaaagatacaacataccagaatctctgggagacatttaaagcagtgtgtagagggaaatttatagcactaaatgcccacaagagaaagcaggaaagatctaaaattgacaccctaacaccacaattaaaagaactagagaagcaagagcaaacacattcaaaagctagcagaaggcaagaaataactaagatcagagcagaactgaaggagacagagacacaaaaaacccttcaaaaaatcaatgaatccaggagctggttttttttaaaagatcaacaacattgacagaccactagcaagactaataaagaagaaaagagagaagaatcaaatagatgcaataaaaaatgataaaggggatatcaccactgatcccacagaaatacaaactaccatcagagaatactataaacacctctatgcaaataaactagaaaatctagaagaaatggataaattcctggacacatacaccctcccaagactaaaccaggaagaagttgaatctctgaatagaccaataacaggctctgaaattgaggcaataattaatagcttaccaaccaaaaaaagtccaggaccagacagattcacagccaaattctaccagaggtacaaggaggagctggtaccattccttctgaaactattccaatcaatagaaaaagagggaatcttctctaactcattttatgaggccagcatcatcctgataccaaagcctggcagagacacaacagaaaaagagaattttagaccaatatccctgatgaacatcgatgcaaaaatcatcaataaaatactggcaaaccgaatccagcaaacacatcaaaaagcttatccaccatgatcaagtgggcttcatccctgggatgcaaggctggttcaacatatgcaaatcaataaacataatccagcatataaacagaaccaaagacaaaaaccacatgattatctcaacagatgcagaaaaggcctttgataaaatccaacaacccttcatgctaaaaactctcaataaattggtactgatgggacatatctcaaaataatgggagctatttatgacaaacccacagccaatatcatactgaatgggcaaaaactggaagcattccctttgaaaactggcataagacagggatgccctctctcactactcctattcaacatagtgttggaagttctggccagggcaatcaggcaagagaaggaaataaaggttattcaagtaggaaaagaggaagtcaaattgtccctgtttgcagatgacatgattgtgtatctagaagaccccatcatctcagccccaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctgggaatccaacttacaagggatgtgaaggacctcttcaaggaaaactacaaaccactgctcaaggaaataagaggatacaaacaaatggaagaacattccatgctcatgggtaggaagaatcaatatagtgaaaatggccatactgcccaaggtaatttatagattcaatgccatccccatcaagctaccaatgactttcttcacagaattggaaaaaagctactttaaagttcatatggaaccaaaaaagagcccgcatcaccaagtcaatcctaagccaaaagaacaaagctggaggcatcatgctacctgacttcaaactatactacaagactacagtaaccaaagcagcatggtactggtaccaaaacagagatacagaccaatggaacagaacagagccctcagaaataatgccacacatctacaactatctgatctttgacaaacctgacaaaaacaagcaatggggaaaggattccctatttaataaatggtgctgggaaaactggctagccatatgtagaaagctgaaactggaccccttccttacaccttatacaaaaattaattcaagatggattaaagacttaaatgttagacctaaaaccataaaaaccctagaagaaaacctaggcaataccattcaggacataggcatggacaaggacttcacgtctaaaacaccaaaagcaatggcaacaaaagccaaaattgacaaatgggatataattaaactaaagagcttctgcacagccaaagaaactaccatcagagtgaacaggcaacctacagaatgggagaaaatttttgcaatctactcatctgacaaagggctaatatccagaatctacaatgaactcaaacaaatttacaagaaaaaatcaaacaaccccatcaaaaagtgggcaaaggatatgaacgacacttctcaaaagaagatatttatgcagccaaaagacacatgaaaaaaggctcatcatcactggccatcagagaaatgcaaatcaaaaccacaatgccatactatctcataccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattacaaatcattctgctataaagacacatgcacacgtatgtttattacagcagtgctcacaatagcaaagacttggaaccaacccaaatgtccatcaatgacagactggattaagaaaatgtggcacatatacaccatggaatactatgcagccatataaaaggatgagtttatgtcctttgtagggacatggatgaagctggaaaccatcgttctcagcaaagtatcccaaggacaaaaaaccaaacactgcatgttctcactcataggtgggaattgaacaatgagaacacttggacacagaaacgggaacatcacacactggggcctgttgtggggtggggggagcggggagggatagcattagcagatatacctaatgtaaatgacgagttaatgggtgcagcacaccaacatggcacatgtatacgtatgtaacaaacctgcacgttgtgcacatgtaccctaaaacttaaagtataattaaaaaaaaaaagaaaaagaaaagaaaatagccctggaatgtatcagcactgtcagccctcaaaaatccagtatctccaacaaactgggtgtcacaaggctttctagtgaagtgttccacacctgtttgttgtcatctctcattaatgtgtggcatctcctgggatgcatctttcaaccaaccagcatcccagatttataggtcaaagcagaggatcagagaactcatcccagggaggaatggcacttgcagaaatgggcagccatgactttgcttgactcttctgtcttcttgctagagttgttttttagcttccagacatgaaatgcattggggctcagatgaccggaataggctagatctgtcagtgatggtccaagggacttttcattggtaaatctgctgagactgctgaacaaggctagtgatgccttgcttgtgagcttcctaatctggctgctgtatgacattgcaattctgggcttcagggccccaaaccagcatatccaaagaacctgaagccaattgttctgtcattctttaaagacccaacgcatgggatggcagatgccaggtgcagaatataacctcctgtccatccctacagaacatcatatactggagacaagagggcccagcctacccagaacaagaccctttctccagatcactaactttcttgaggatctgaagttaagccacatgcctagactcttcctgggccagcaaccattttacttagaatgtcaaggggaaatccccttggaaatactccagtacccattgcctaaggactatgtgcttattctctttttgaccaatcattataattccagagatttaggaagcccattgctgtatcaaggactataaaatggtggtggccaaggtgtcaaggatcccagacctgcctaggactctctgtgccattgtccctggagagagaacccagttactctcacttccagtgcagtggctcctgatctttgagttgtttggcttgtttttacatgtgattatttcacttttaaacatccaggaaagaggcatctgcagaaataaggatttctttaataatttcttatgttgggcacttggaatgtcctgccacaggtacatgcaccatggaactggcaagtgggcagacagaaaggacaggctggcagtgcaggtttcccaggatctcatgaggtagggctgctgctgctgctgctgcaatatctgctggccggaggctttgcttccattttagacatcccaaacaaagtcatcttgggggacctagccccaaaccaatcttggtacttagatcaggctgcctgacataactgagtctcattttctgtttcggatactcccaggttctcatgctgcttcccagtgcctcccccattagatggtacctaaagtaagaaagccattgacacagagaggagagaggaagtgagacgggtcacagacaagtgatggcctagtctcccagcccccatcctgccatagcactgttgcccttcaccctgccttgggctctgacatgctcccttcccccccacccccggcagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatgtaaggaataaatggggaaggacctgggggagggaggggcaaggcagggtcaggatgagagaggaaaacatcagcaaggacctatgtgcaccctgtgtgttctgcttacgttccctgcagctgaccctgggctatttcagagctctgttcccaagccaccccctacacaccatctccaggcttcttacaagcctgctgtgcccttgagtcttcttcccatgctgtgcacaggaattctagaatggccctgacctctactataccaggcgctggctctgctttggagcacacctgccttcccagtgccaggagacaggatatgggggcttcataatcatggcagtcatcctgacagtcattgttatttattgcagatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgagtcaggatgggggtgggacagagcagagaaagcacagtttgactctaggtgggctccaaaatgcagctcaagtcctctctcctgcttctctggcacatcctgagcagggaaggcatgggctagagaagacactgagcctcttttcagctccccttcgcccactctaccagtcccctccctgaatgtgcctctcccatgagcccctctgctattcttttctcttgtttaaggctgggctggagctaatgatttatactttactagttctgttttttactaacttaattcagtaaataaagatctgagtctgtgaccatcccataggacacttgtaacccaatagcttcttccttctaaaggtgaccccagactctgagaatgattttgggaactacaactgtactgcagtgaaccgcattgggcaggagtccttggaattcatccttgttcaagcaggtgagtgtcccttactcacctgagagcagctgccacaaccccccacctaaccctgccagcccaatttgtgtacttgagtgattccaggatattgggaagaagaaagggccagggtcagcaaagccagagagttgggaagctgggagccattggatcagcgcatggggcatgttgggggagaagcatctggtgagatgggccaggaggacaggatacagtgacaggattcccaagagtgagcagaaatgacagagatgtgccttgtgactgagagttaatggtcttgggccaaactgggctcacctgagtctccatatgtgtcttccccacagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaaggtgagttgggcgagttggtgtttccattgggatcatgagtgcctcagtactcagatgtccccacctgccatcctgggcatgttcctacagaatcaggaactgcacctccagaattaggtcaaagtcatatctgcctgtagagttgttgcccctattgccaccccaacccatgctctgtgcttcagagcctggttctcatgacccttccagtatggatgaaggcatctgtaccacattccaggcaggaaccttgtgtaggttctgagcgcagccagatgagtccagcccataggttctgagcatggccagatgagtctaatccatcctactctgcacgtttgagttacctgtgctgcaggttctctgccgacacccggccagtcctgcttggatatctgtactcagggactggctgtcttgtaattgtgatagtaaccaaataagcacagccagcaggacaagtctgcccttaaatcagtcctgtgctagctttccaagctaaagattaaaagactgacccttggattactgcagtgtgaagattctgagcccagatcatctgaggataatgtgtgcttatgttggactcccctttttgggtttaattggaataactcagtgaagtatgttttgtttctgtacaaatttttaatcctggtctcgtatgtggtaattcgagtggaattggaagtaggctgggatatcagtatcacagccattcagagacatagtccagtgcagtttcactcagaattagttctgccagaaagtttccatcacttcttcagcttctcgggggagccagggggccgagaggagctgctgggtaatcaggattggagccagaagaaagcaatcactttgccttcctaacttccctctgaaatctcataccaattttgtggcaggttgatctcatgtcactatctgtccacccgacttttttttttttttaaagatcaattctagttatttttattataaaatatacataacatacattttacgttccatcatttttaagtgtaaaattcagtggcattaagttgtaaccatcaccaccatccatctccagaactttttatcatcccaaactgaaactctgtacccattaaacactagctcttcattcactacctcctcccagcccctggcaaccaccatgctttctgtctctatgtagttggctattctaagtacctcacataagtggactcatatggcatttgtccttttgtggctagcttattttatttcacttagcataatatcttcaaggttcatccatgttgtagcatgtgtcagaatttccttcctgtttaaggtggaataacattccattgtatgtctatgccacatttcatgtatccattcatcagtcagtggtcatttgggttgcctttcggctattgtgaatgatgctgctgtgaacatgggtagcccaggtatctgtatctgtttggtctgccatctgtatctgtcatttgggtctgcctttcggctattgtgaatgatactgctgtgaacatggacagccaggtatctgtatctgtttggtcccgactttcaattctatgcatatgcccagaaatagaattgctggaccaaatgataaatctacagttaattttttcaggaccctccctactgtttttcagagcggctgcaccattttaacaatagactcttttgtcatccttcccatattataacagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccgtaagtaaagccagctgccccccttttcccagcccaccttcttctccctgggggcagtggggaaccctgagctggcccatgtcattgttcagaccacagctttttgtctttcagatccctctgctcctggaggccccacctcctagttctctggttctcagtgacagctaacacacagtcccttcattctctctttctccaaggggttggggacactgtcctagtagccggtccagcttgttagaataacagtgaaggggaaggcaccaacacattattaaaggaagtggggagaaaaccaggagtgagttgtcaaaggatctgggaaagttgcttttcgacaggccacagaagccctaagcaccctgtgacttgcaggaagagggtaaagatggtgacagttcacataatgcattgcgggatctttgatgcagcagagatattaagtcagagacaaatggaaactgctatagaatatgtgagcagcagcagaaacccagcaaagccaaggggaagaggtagccctggccttggccttttctgctcctctccctcccatagcaagagcattcctcacggcctctttcaagagaattgcttccccctgattccactcagggatgtatctctaggttttcctcggccattccctctttcttttaactacgcctatcccactttgccctcccttcccaccagcagccaggctgtgggcaagccctgctcctgtcatacccctttgcagacagagatactaccctgggaagctcctgagtccacccagctaaagaagataccgtagaactaaatttctgagtgttcacagagttccctgggctctctgacccctggatttaaaatgcacctgggagaatcctttgcttccttctttttgaagccaggggcctgcaaagggacccactgcccttacctcttcccagaaataggaaagcctgtctcatcttccttctacaggagtggcttctttctctggatttgaagtaatttgataatttgagtttccagctccatgtgctctgcggattctattcatttcttttacatcttattttttttttcttgggtctgtctcttgttttttcttttcgtctgtgttccatccatgggaaatgcagatagccctcctccacgtaagtgcctcttcatacctcattacctgtttccatagcgttaacatctgctagttctagttcgtaatttagttctggtcccttttttgtcccctagaggctgaagtagatgatattgtctgggccctaaccacactgaccttagtctagttgtgctgttgttaacgtctgtaggttactccaagaggctaacactcttcctgttttagagcatgcaacttctgtgtctttggaaattgtgcttatttattaatttttgtgtgtgatgattaccccacggcaaagatggtgtttgctgagccaagcatggtggaagtctgcagatgggccctgaataacacgctatagccccgcctcaccttcagccaggatgccgggaaagtgaccacagccccaccaggccactattcaaaacaccttgaaaggaaaaagaacctgaaaggattttcatatttgcttttaggagataaaggaattgagctcagttgcttccttgcttcttgtctgtcagcttggtagctggaggggaataggaggactggccagggaggctcctgcagcagctgccatagtcaaaacgtagcatgaactttggttccgagccatgggcatgtcccacaggtagctgttgcagagttaaatctctagttccggtcagctctgttctttagcatgtagttacttgcagtgtgcatctcctcgtttggggaagactaaccagctaatgtaggaactcttctgccatgcatgctagggaaggggagattccccactggaaggacacccttcatcatgtaagctgtacatagaggacacagggaacaagggtaacagagagatgaactgtggtttgaccccattagcctgcagaaatgcccctaaacttcccttctcctgagatttggttcttcctaggctgaaccagaatagcggagggaggtgttacccaggcagacacagaaaaaaaggtattcaggaagctgtacagtcttttcataaaaaggctcccagctcctgaaaggtacccaaggaagcttatctttttaacattattcagaaatattgcagcaacagcaaaaactaagtagctacatgtaggtattctgagattttgagcaagtgccaaatgtcctacctcagcagagttggtgccgggatgaaccagctctcgaaggcatcagagttgggggatggagccttcaggccggactgacaggtacctgctctgggcctgcagctatgccctaagcaagttcgagaggagccactctgggcatgagggaaccttccttctggatcttcccctgatctttaacttgtggttcaactgagtctccaggtttcctctggtctggatttgatcagtaaatgaatgctggcttagttacattaaagagaggaaggctgggatgaggcccccctctgagtttctaaccagtaactggagtttgagtactgaatcagagtaactgggtcttggacttcaaaggccgcagtggttttcattcattgccagctcagttcttgcaaaggtgagaccatatatatagatatatagatatatatagatatatagatatagatatatagatatatatagatatatagatatagatatatagatatatatatagatatatagatagatagatagatatagatatatatctcagaagctatatttttaaagtcaatgttaaaaatgaaatttttaatgaaattttaattttaaattaaaatttagatttttaactacaaaaaagaggtctccagaccttgttgtttattgtctgatagtatcaaaatggataagtaaccacgactccaagaagccctttggaaaaggatggtgtcatctctgcattccaagtaggtcatgaatggtacaacaacaggcattgttagtggtacagaaagtcagtttttctcaatcatttaataaagttaaggtctgaagaatcaaaaggcaaacttcttttagataagtagaaccatggcatattcttagagttgagcacgccttttgcaagaattttagcaggatgaggcggtgaacatatgggaacatcatattatcaccaaagataacttattatggtctttctttgtgccctgataaccttcccagagttgctgaagtgaggacttagcccacggagtatcctgctgcccctagacccatcctgaaaacagatatcattgggaggatgctgccagcagttacaactgctatgacaaacccacccttttgctgctaggaactgaggacgagccttaggaaggaccttctctgaattcttactctcatttcttggaagacacaaagattgtctgaacttaggtagacagaaccaaccaccagtttagctgtgtgcttgcactgagcccaagaaccagtggcattggtttctgatgccagcttacggcaccactgacactgcacccctgtcctgtaatactgttgggatgcagatgcacagcaggatctcctaccactggagttgtgctctggttataccccaagccccaaggaagagaaggcacagagtcagcagaggccagtgtgctgcacaggcaggtgttgctgccggactcctgggctgccaggtgtcaggtgagaccagcgcatttggcactgactcatcgcttgaagttcgttgagatgtctcaataatggggttgctttcttggttctttaatagacctttccatgtttagggacatggatatatcagagcagggatgagcagggggagctagtaaaagccacaaacacttaatggactcttgttttcaagctgccagttagtaagcatggcttacctgtttggaggttcctttgtgtgtagttcatgaatgtgcatgaaggtaatgaggaagctgtgaccccagaccaacaaataaaactctaacctgtgagaatgtgcctatttcatgtattttttaagccaaatgtctgcatgccatcaagacactcaggaggaaagctcaaaacctctgtttgccttgagacgggctgcttgtgtcagactccttacaactagctaggaatcttcccctccatgactgagctacccaccttcataatttcattgcccaaacattacctcttaatttgcttctgtaccatgaagcaaaatagattatttctttttgaatatagagattatgaatgagtctctacttttttttttttttttttttttttgagacggagtctcgctctgtcgcccaggctggagtgcagtggcgggatctcggctcactgcaagctccgcctcccgggttcacgccatactcctgagtctctactttttaaaagaggcatcttgagatttttgttttcatatgttgtcccccaggtggcacattgcaagtataactatgcaaacaattcaagctaaacaaagaaaagagagggaaggagacctgaattaaccagaccatccaataatgatgagttatgattctttgttgctttgattccagtgacactgtactcatggtttaatgagatgccctcatgtggaaggtaaaggaagacaaaaccatgagtattagatattaaggcagtggcggagatacactgaggtttttccaaattttcatctagctctcgaaggagactttgttttgtgactgctgatgggactacttccaaatatttgccaatgaaaaaccaaagatccattcagtgtcccagtatctcagatgcacaactaaccatcctctacacagaagaatggctagaatttcagtcccagtctcttcatcatttctattccctggaggagtgagaataatcctgaacattatttgcatggctcttacgtagcagcctccaaataaccacattctgtaggggagttttggaaggcagcagtggttgcagcatcatctgtatgatacaggatcatgaacttcatacactagtacacattaggtaggagagccatttctgtctcattcattcagatgttgaaatgagtgaggcatataggttttgctataaataaagtcatatgtggaaatatatacctatatagaaacacatatatagatgtgtaacatgaaaagccaatgtctattttctccttcactggttcaccttaaactgaggtccagattccttttcctcctatacctctcgtcctatggagacagctggtcctgctgaactggatatttgttttcagtcaaggtttgaggcttgtgcagctgttcctggcccagactttacctgaactgcagggtttggcaggtgcacagtctcaaggtttgacgttagagagagccctgctcctcgctagtgccctggccagctgttcacacacggtgttgttcttcccactttaactcacttcagctcctcatactgatgccccagggttgttgcttccatttttttttcattcagtatctgtgtgcctcaatgatcttttttccccaccttcatttttctttcttcagcggcatctgctagctcgtctacccctgttccattgtctccaccagatagtgagtatcattttcttcatccatctctctgcaggtcactttccaccagccacagtttgttttgcctaatgttatctccttcaccaggtgataattcaactcagttggtggaaagcagcgtcgggttttagaggagcagttgagaagagaaacaggcatagggcttctcagatccatgaggggcagccttccctgaaggagaggcgagggaaaagcattgttctggatagaaaaccctgcaggcaggatccccaaggctgccgccctggggccagccctgtcctcaggattctgagtgggctggatcaaagctcgtatttggagaagccaaaggaattgaccaagaaaaatgtctcctctgcagggtcatagaaaatgtgttggagtgttttgtttttacccttcattttaattggcacagttggatacagacattgaaattagatagggaggcctgtagctttcgctttatccataaatgcatacttttcttgtaaatatttgtgggaaaataaacagtgtctggcagtgtctggcagatgtgcctggcagtaggcgcttaggcaaatcgtttaacccttcacaagtgagccttgtttatctcctctgtaaaataggatgagtagtcacccacgtcccgccaccctaaagaaaatcacaaacattttcatgtttatcatgctctgctttacccacatgggatcattaccaccaagccagcagtaatgtcagctggtcgctctcagatttcatcatcctggctaagccttgctcatttctgatctaattaatgttgctatcctgtccttttgtgtgcctgaatgtgcaggagtagaaggggctccaggcctgccactgtttggagttttgaacctagctttccagggaggaatagcaaagtaagaccacagctcagtaagacacaggatgtaatgccagcatctgcccagagtggcagacagcagcaaatgggcaggcagggtggtgccgcctggctggctttattctccttgatatatcagaagcccctgtggtttggactcagactcaggaggtgactcaagcctcaagctcagaagccctctgtcaccatctgttgactcagaagcatgcccaccatcccatgcagtgcttttccaggcactgtcctgtagcagacggagttcaggctttggaagtagacagacctgggttcaaatcacagctccgcttcttccgcctgaagctccataacctaggataagtcgctaagcctccccaagtctcagatttcttacctctaaggtgaaggatggattccacttaccttttcagtgtttgtgaaaattaaagattaaatgtgaagaacacaaaacatactgctcagcatttagcagctggaattaatagtaagaataaatgagagttatgttatctcttgctgcatgaaagtcatttgtcagcaaaatctctgatcatctcttttaaatatgtatattaagagtcttttaaatatgtatattaaggcccagcatggtggctcaggcctgtaatcccagcactttgagagggccaggcgggtggattgcttgaggccaggagttcaagaccggtctgggcaaccttgtctctactaaaaatacaaaaattagccaggcgtggtggcatgtgcctgtaatcccagttacttgggaggctgaggcaggagaattgtttgaacccaggagatggaggttgtaatgagacaagatcgcaccattgcactctagcctgagtgacagagcaagactccatctcaaaataataaataatatgtatattaatattgatagagaagagagagaatacctccttcaccatctttataatgatgcctacatatgtataatatatactcacccatgtatgtatacatatatagctatgagtttaatttatctccattctctccttcacctttctttgccttttctgtctgtcgtgtttccatagcaacttggcctcttcctgcccttgcaaccacagaaccagctagtgagtacagggctgagttgctctcggccagacctctgatcgcttgttgtagagccgacttctagattacagcgctgcctgttgttttcccttttattaaaagcaacagttgtgaatgcatgaaggctcctagcctggtgtggtttcctaagcatgccgtctgcttggccaagagagcaaaccaagcatcagcaaaagaacggggttgattattggaagaatactccgtgcatgaggaggcttttccaaatcgactctctagttaaaaatagccaaggattaggcaaaccctgaggacacaaaagaacagcatctccttcccggctttcgctttgctgtccctccttctgaaatacacacgctcatgcgcgtgttaatttagcagtagcaaaaagactgagagcgagggaaggaataggagaaaatggctgcttgaggaaagggagagggtgatgccgagaaggaaggagccgctgcttcctgacagcatgcccggctttgtctccgcgtacgcagagcacaggggaaggagagagctccttcctgctgtctcctttcaggctcccgcctcagtgctagaaaaatgatgggcagaaaaagcctaatccaggctccccttgggttgagagtccagatgaaagtgctggaatttatctcttgacaatagagtcaagagccagattgtatcctcttttttcatcgtagaaaacattgcacagaatcactgctgtaacatgttccaagctggtcttcataatgctctaatgaagtaagatgtgtgtggaggacctgaatctcctgaagaatccatatgagtatgcgtgcatgttcatagtgttcaagcatcaaagctgtgtgggagttttagattttataatatttctgcttgcacagaaaaaaaatggcatacatcccatcaagcagaacaagaaggcagaaagcaggtatgcaaagtataactccagctccccgggccaagctttccaatacataattgaacagagaagaaaagagtttcctggttctgtgtgttgcatgaaatggttcttttttttctactgcagaacacagctaagggtctgctttcttggtgttccctccgtgtgtgtgctgcgatgaattttaattcctgatgcttttgaggtttcattttgtcagcagagcagagccggtgacaacaggctgtgctcgcatgggtttaattcagattatgaggggtttttttttacatttggaaaaggaatgcagctgacagccccttttcttattctacagtgtcactcctgtcctttttcaacctggtgcaatgtgtgtccaggcacagtaggagaaagctacataatgtatttgtacaactgtgtcatatttcaggtggctcactgtaggttggtcttctctgttagtgaaacacaatcttggttccagattttgcctgaagaaggaattaggtgtctctcccctgacatgtctttaatttttaaacatcagacatttctgcccacagacaaaatgcttagttgtgacatccaaagggaagaaagtttgagtcattttattttgaaccacttgactactgacccaaattgtaggtcccagtggatactgagataaaggaaagatgctcacaattgggcagcagcctgagtttagcatgaacatatttctcactagtaagatgaaatgtggcacatgtgaattgcagtggaactaatagcagagtagctatcagcatgtgaatatccatcgatcatcaatccatcagtggggttgaaaatacatatctcccagttttgcttctgtgtgtgtgcgtgtgtgtgtgtgtgtgtgtgtgtgtgtgtgtggacccatttataattatgagggaataaaggtattctaaataaaaccaaaggagcaattgcttagttgtatataatccctgcaaggcccctttggtaggaaggtgcctgaatctgtgtaatgccagacaataagaaagaagcacacattctgtcagctcacggtggcaagggaagaggtagcctggttaaagcatttctctcaggttatttttaaccagcggtgttctttacacagaaaggtgtcttcatctcccttctttgcccttctccctcagcctcaattggcaatggccaaaactttccctggcctcttaaatttaaggtcagaaacccaaaataccttttaacaagtcgagatcactcagtcacaacataggaccaaaaggaatgcttaagaaaagtgttttttttttttcattgtaaatctcaaatttatgacttatcagtgcaaccacgattctaaagatataactttaaccacaacaggttgggtgccgtggctcaagcctataatcccagcactttgggaggctgaggtggaaggatcacttgagcccagcggggccaacagggcgaaacccccatctctacaaaaaatagaaaaattagctgggtatagtagcagacgcctgcagtcccagccattcaggaggctgaggcagaaagattgcttgagcccgggaggtcaaggctggagtgagctatcttcatgccactgcactgcagcctgggtgatgaaacgagaccgtttcaaaacaaaaaactttaaccacaaatggcccaaacatttgcttaatgtcaaactctcagcacgttgggccaaaggtacagtttctgctgtttagtgtcaacacagccattgtctcaaccatcagaaggaaacccattccctagtctgcactggcctcttcctttatatgggtcttgacttcagggaggctcaccgaggtctcaggaataacatgggtttgtggagaaagaagtgagataagatcctcaaagccaccatctctggcatgcatccacccagcctcattcagcccatactcccctcctccttatgccataggaaacatgaaatgactcttcttaatttaatacaatcttttgttcttctagggcacacagtcttcaccttaagactctcgggacttttccttgatgacccatattctgtttcattgcccttgtttcccaaggatgctgagacatttctggaatctgtggataataacttgcttttttcttttcctttaacagtctcctggattgactttgacatctgggtcctgacagcaacacctccccatttcaaaacaagtttacatgctcctgatgtggtattaatatgtagtgttgcagccgtagctaatgcttattggtgttgttaaccaaatgctctttatgatttattattcttctatttctgggcagtttcactgccctcccaatgtttcctatatatgctgctaatttaatttgatttctccttttatttagtctgtgattttgttgttgatttttctccctgcccattgtttacatcagtttttaatttttttgtattttccatgtgacctcctccactttcctttcaaccaatatcatgtgcgtgcgtatcatgtgactttgtcatgtggcttgcatggtgctgatgatgtcgtccacgctggtgaacagaaggtaaaactctttgttctgattagtgaaataaatctgggaccacagcctggcacatagggcacactcatttcttcctgtctcagatttcctaagcaaagccatttgagagatttcctcttgttctcaattcacatccagaattcatcattccttgcaaacttgacatgacgatttggtatcatgacaacctttggtttggtattttgcttcaagaaatttggtcacacaaactgttctctacagtcaacccacattagccacagcacagtttgcaaacttgaatttttaccagatggttcataaaaattatttcctagaaaggtgtttggcaaattagcttgatagcattgttatttaacttcatccagtagttctaaacaccatagttgttctaaaatgagtcacattcctgtgaaaatgtttacaaccttgaaatgctacagagtgaaatatatcaattgcaaaggttgtatttgttcaaaacccagtgagagtgcttcataaaattcatgcacattgaggactttctgaaataagagatttaagaatttggattagagcagtttggctgtgattactgaggtgtcactttttaagagtggccctcccccagggagggggagaaaatcaaagcaaaagtcacttggcaattaccatgaatggagatctccgtgtaatcaagaaacacatgattgacccttgcagcaaaggaaataaaattatagcctaattaagtgcatagcggtgacaaaataattagttaatattgtgactgtcacaaccttgttaaaacatttctcgcttaccagaaggagagaaggaagcctctgctcacagcttccctcactcaaatcaaacacctattcagaacctgccctttgagtcatatgcattcagttttctcctaactggaatgttttgcttccaatcacagcctgagacattggctacatggatcacgaaagcaaaactaactccaataaccccctggtgtgcccgtgcatgcaaggggtccctgtttgacctcacttctctgagaactgattgggcgacatccacacagacaaaccgtcaacagctggtctcgcatgtcctttgttcccggtctgctcttgtgtttcgttctcctcctgtgtgttagccctgtgtaccttccctctcgttcaccctccacatttcccatctctgagcccctcagctttatagggatgtcagcttggccccaatgtagtcccatttacagccagactcctggacttgcctatgagccatcttcatttccaaaaaggcgatattgggtatgtacattgcatgaaataaagtgggaatgtcccagaagcagaaggacatctgatgcagtccacgccaataaattgggcttacctttaaaaatcatctgaatatgcaggtcttagggcagagaatatagacagcttaagattttctaaactacaagtcccacccaaaatacggtattttcatgatttcccaaaggttgaccatcagcaagactggatatttttcagacttaagatgactgttcagtagctgatgttctggaaaaagatctgggccttcaccatgaaatcttaaatgtgagcagttactggatgttgaatttgaaacctattcatttctttttttaaaacaagcttggtcatttctgtgcaatgctataattcggaacgaaacaaagcacaatgttaataaggtagacactaattcattcctctgaagagagatctcttccagacattttaagccagggcaagaaatgtttaaagatgttttctgcagttgccgtagaaacactccttagcagtcatcttggctgttggtaaaaaatgtggccggtaccaaaaaaaaaaaaaaaaaatcgctgacagccttagagaattacaaagctatgattacgccctcctggaaccatgtcctcatccatgacagaccctctcctgccatctgcaagggggcaagctgaagacttattcaggtgagccccgcacgcagcaggaattgtcctttaacaataaaatttaagagaatgaagaggtcagggccaataaaatccatggaggagagcaacaaagcttagttaaggacagttatcacctcctctccctgggtattagcaaagatttaagctgaattgggcctcaatgagaaaagtgagagtaagctggggggtgaggggggagctttctgctgtcagtgggttgtacacccaacaactggtgacatctgatgttccctgtccaccttgtaccccctcaaaaaaagaaaactgcctgggatatgcataacctaagctggatgctccatctaccctgagttcagtgggacagcgtttacagaatccagcagcactgcgtgaagtgtggcgactcagaaggagaagggaggttataacagggattgagccctatcctttatggttacttggctcctgagcctacagggcttggcctgtagaggattgtgacagataagcttagacacctgtcccagaaaagaagaagtgaggatgcaaactttgattctaaggtcatggcatcatgtcactgcagggcttcctccaatgactccacggagccgtggctttgtccaccagctactgaggactctgtgtaaatgggactccccaccagcagcatgtgtgagatgagaagccccctgcacccctctgtccatgtgctgcatgtctgagcatggcgccctccccagccattcataatgatattttttttctttagctactgacactgactcgtactaggaaacgctgattctgatgagctaagctctttaacacccactcttccttcttagattgaaaacatcactaaccaccccttccactccctcctttattttttcacagctgtgtgtctggattgccacgatctctggcaggtcgacacagacttttcaccagggtttctgctctaattgcctttatctctaaggattccctgcactggaggttcctagggtagagagtcagtgggaaggggctgaagaaaaaggcagtgaggtgtgtcagcccgaatcctgtgggcagggactgtgggcagggactgtgggctgctgctggccttggaaactgccagttcccttagggtcaccagtatgggggctgaaactccccaggagccacattcttcttcataaccaatctaatgtccatgaaatagagttgaagatgggcacgagcccccttgtggccttggaggcaggagccgagttaactgttgatgatagcagttatttctgtcataacttcctcagcctggatcagccccataaccacaagccataccttcctggtcatattttctttttaggatgatgaaacaaagataattgatcaattaatctgttggtgttttcatgacacctgcgagaagggaactggtatttttgtggttcagtctgtcagagctcgttggttgctgtttaatttgtaccttgtgctgccatttgccaccgtaccccaacacatactctcacattcataaattcctcaggaaactggtgctggaaaggatttacagaccagatgccttagtgagtgtggctgcggggagctcagcatccttgctctgcaagctgggaaccggccgtgcccacactcactcattgtgtatcccgaggctccctggagctaggaactaggatggcaaagattctggtcactcaggcacaagcaaggccttaaagctgaagagaaaagggttcagggaaaaacaaacaaaactttaccccaaaagcttgatccagcaggaacaatgcctaagacaaattaatacccactcttacactgcccggctgttcttcgggactgtccgaaagtcactcggcatccctagaatagccaggtaggttaccaaaagaggcgccagggagagacatgaggatccaagaatgtatgcaacatagatcacatccgattcttttgtttgtcgtcgagggctaagcgctttgtttcaggaaagagaatcagtggtctaataacgctaaatcctgattccctcagataatttgctgatcccctaaggaccagccacatttctaacctctggatgtaattgtaatgtttctgacttggaaaaagtaaataggcttcatatttgaatagctaaatcatacattttggacttttcaaaaactaagtgtaaaaaggtatatataacacaagtttcaaattgcttggaagaaataatcaaccaaaggagacaggagttatgataaacaaaatgaacagtatttttaaaactagacagtcttatttgataggaaaagtaaaagattgtaatgcaagccccacatttatcacaggtttacgctcagacacctgaaactttgtgcagatctctatgagggagaaaacaaagtagatgaatagagaacacagatggagggctttttgttttgttttgtttcttttgaggctgagtctcgctgtcacccaggctggagtgcagtggtgcgatctctgctcactgcaacctccacctcccatgctcaagcaattctcctgcctcagcctcctgcgtagctgggattacagacgcatgccaccatgcccagataattttttttatttttttagtagagatggggtttcaccatgtaggccaggctggtcttgaactcctgacctcaggtgatccacccacctcagcctcccaaagtgctgggattacaggcgtgagccattgtgcccagccccagatagaggctttcttgaggatgcctgtttggcaccccagcctttcattcagaagacacagctaactcttggtgctcgggctcctttgagtgagaaatagaatattgttttcctgctaaaattcaccaatgctgtccaagtaccctggatttgctataatttttgttgtggaattcagatatccagtggagttttctaactcctggggcttctgctgatgagaggaagggcatgaagctgattcagatttaagggtacagtagcagagtaattacaaacagagaacctgcaatcggcatggccagaaatatacatttcaattatggtttctaagggagaatttcataggacctgcctatgatatatctgactatatgtggcctctatggtacgttctttctttcttgggttcatgattcacatcctgctagaaaataccagaactgcacaatactttatatttgttattggcaaagtttctttttaatgttccgttggtgtagtctttacataatacattttggggggaacatttgactcatggctaaagcgaaactccaagggtataattaaccccaggggtcttctgggagcaacctgccgattgctgctgaatcgcaaaccaacatttacaaataattacaataatggttttactgaacttactcataatgatttcaatcagggcagccatctcagaacacagtgcacatcaggactctctcaggcatttcttctgctaatgtgctcgataaagcagtcagcctcctgaatggcaaggtcccttttctcccaccacagcccctccctcatcaggctttgtgtagaaagcctaagaaagtttctctaaccccatttctaatctttaagagaatttgctgacagtgaacactggaagataagacacttgatgaaacaattgctctttccatattttcatgtactcacagcaagttacagagccaccaagtcggtcaaaatctctgtgatattagttgaatatgagcttcctgtagaaatactgtcataggctgggtgcaggggctcacacctgtaatcccagtactttgggaggccaaggtgagaggatagcttgagcctagaagttcaagaccagcctcagtaacacagtgagaccccatctctacaaaaaattagccgagtgtggtggcatgtgcctgtggtcctagctactccggaggctgtggtgagtgaatcgcttgagtcatggagattaagactgcagtgagctatgattgtgccactgcacttcagcttgggtgacagagcaagaccctgtctcaaaaaaaaaaaaaaaaaaagtcataggaagcattatgtatccgtccaagaacctcatcatcttttaaaagaattaatcataacttagttttttcatttggcaaacaaaatggtgtcttatttacctttgagacttcagtgcctaatagactacctgggacctagtagatactcagtacacatctgttgaataaatcgtaggtaaagcactctaaataataaacctaaatattatttcattttatttttgagacaaggtctcactctgtcacccaggctggagtgcagtggcatgatcttggctcactgcaacctctgcctccggggttcaagtggttctcgtgcctcagcctcttcagtagctgggattacaggcacatgccactatgcccagctttttttttttttttttttttttttttttttggtagagacagagtttcactatgttggccaggctggtcacaaaatcctaaccacaagtgatccacctgcctcagcctcccgaagtcctagggttacaggtgtgagccactgtgaccagccaatattattatttaatataaaatgctctaaattctaagagaaaataatacacacatatcagagtactgtgatagactcagataaaatgatacaaattatagtgttctaactatgtcaaatgtgttctaactatggtatagattttgatggcttttctccgattcaaattacattttttctgaaacaaatctaaagataagagagtactttcatcagggaagttggtttctgcaggattccctagagagatttttattcttaggtctttgaagagacttgggggtctcttttcaaagacaaaacttttgagataactttttcaacattttaaagcaaaaagttgacaactttctgccttagagatgtgaaattgttgaccttggagtgcatctccctaaaattggctgaaagtcgtgaattttgtgttctgtttcccacaatgtcatgagaaacagcccaggtgtagttggtagtccgtgctagtgcagtggctgtcactgtttcacatgacaacagagctggaaggagccctaaatagcatccaattcagggcccatattttgtaaatgtggaatgaaacttgatcgaggcaacagaccccccatgatgcggagttcagagacagtgttttgcaggattgattcagccttgaaaactcacacagctcaatttcaagaggaactaattaggaacgtgcagccagggaggccccagtggactgatccctaaaagggggccttgggagaaggacacagtcctcgactagtgggcatgttggaagggccactgatgctgcctataaaaatcccctccaggctagggcaggtagaccattcagcacagagtcagtgtcatgattctaagtgaacaaagttaaaataatttgttcatttgcagtaggtctagggtcatcaaccattccagtttgcctgggactgaagggtttcccaggatgttgaacttgcagtgctaaaacctggaatcttccagactaaccgggatgagttggtcaccccaatttaatcagagaatacaatttgtaaagttctcctgtgtctccttctatttgttcagcatttctgaatctacacagagctcctgccttgatctaaaatctatgccactttgagtcactttttagcactggatatctataatgacatagccataactgatgtattatctaggacttgggacagtccgaaggaatttggaaagcctaaataccttgacgtgtctaaaccaaatttctacctattttccactgaatagttgtggcctggggctagatagtggctttaaaacaggacaggtctttgcctgaagtccattcatctttttattcctgtttttatttgtccttaattattgatctaagaaaacaaataataagcacaacttttcctaaatatcctccagacattgtgcatcctccttgttgcagcttttaatctatgcctgttactgctacttctctaacctaaatgtgcacagagatcactggaaggatcttgttacaggtctaaaaagcgcccaggtgatcagcatgctgctggccctatgatgataagtagtgggctcttccttagccttctctctggttcctcctcgtatcaaaggaaggtggttcccagagtagctgaatgagaagtgaggcgtgactctcgctgtgcctgcagccgtctcataaatggccaatggtgtagttttaggtgcttagatccaatccctggtgacaagccattttgtggctcttctgtcacacgtctgtgattctgttttccagagagcaagccagagtgacccacccagaaggtaactgttttgtagcctctccaagttttctctctgaggttatgaaatagatgcagagatagctcctcacagaagtgcaggattccccagtgtgttaaatcttaattttaactttgtatatgagacgtcctctcaccttattactttcagcatatattaatgcaattgtttcttttaaagtaaatgagtgccttactcactggagaaccatcctagccctagcagtttgtcacatgcaagttcatcttccttctcgaccttggattcacagtgctacaagctgagtgtatactgcaaatcaagaaacaactgtttttctgttgagaaatgctaaagacatttttctctctctcctctcacaaagaaaaagactgcactgattgttactttaacacattaaagtcttgagaattagcactcactcatttgaaccattagtggatacttacaggaaacttgcataagagccataaggatacttacaaaaaacttgcctggggcaagttgtgatttatttaatcacaaccggaaacttcttattttttaaacgaatctaagtaataaaatgtcgttcatgaaaagccagtcccaagaatgcagcattatttactcccactagagatcaggcctcccagtcccaggggtgagtgatgtgtcccggcaagaaactgggctgttttacaaaataattttataggtgggagtttcctactcaaacacttctattttctcctatttcaggctgttcctcaagatgtgtcaggcttataaaaattaaatcttcagttgtaagaccagctaaaaggaaacataagtaccagtgagacaggggaaaaaaaaaaaaaaaaaaaagcctattcctaaaatggtgaaaggaccctgctcacaggaaggctatttaccagaacattcccaagaggcactctcagtttgggctcagtctgaggcatctacctggaattcagttttatatttattgctttttaaccatttgaatttctgagaaagcaagaaaagtgtccagccccaccctgtcactccatcccattcagatgggttggattttcattctgtggatgagaatttcatgtgaattaactggctgtttcaggggaacccagtgcacctaagctcgaagggcagatgggagaggatggaaactctattaaagtgaacctgatcaagcaggatgacggcggctcccccatcagacactatctggtcaggtaccgagcggtgagtggcctccttctcagacttcaccagaaccctgcaaccctggcacccagcttgctagggaaacaacaggggcagcccacggggcaggggtgggatggggtcttattctgtgtctggcaggtggcccatgggccctggccatggcttaaaatcccaagacagccctacagctattaggtcatgttcacactgggtccatttggaaacctcatagatgactgtggtggtgacaaacccataccatggttgatttttctgtgtcttgaacttttctacaaagttattttgccattatctagtacttcttgtaaatgccatactaatatataagaatccctaccttggataacatgtgtattgtaggccaggcacctgcacctcactgtgatcacatgcattttctctgcacaagaaccctgtacagtaggtcttaccattatcccctctttacagatgaagtaagtgggtgtacagcagtcaataactgctggatctcacgcagctgggtgaggcagtttgaatccaagcctgactgagaggctgggctctccccactgcccaaggctgcctaaggtcctcaaacaatgccagttccctcaccagcccttcacttggccacctgagctgtcctaatcctgctaacagcaagttggctctaagccaccttctcctggtttgctcaccacccacttaagattcccctcattccaccttttatcacaacccccacactgaaaatcaccctttccattttggttttagaatgacacttggtcatcttcaactataaccaatggctgagagatttagaggccacatctgagcactgagaataacctcttgctggggtttcgtagtagagaaaagaatgaaccagggagcagtttcctttcttcacatagccccaaggaagactttttctgggaagctgagttacttcctctctgccttgtgatcagctcctgtggaagtgataggtctttaactagctagtcttctggcaagtcagttcagcacagagccccgcaggcatacttctcagctgcagaggccttgttcccacttaatttgtaagcagatgtgagctgaaatagtaggaaaggcctgtcactgccctgaggcccagtccagagatcccagtgaatgagaggtccccatggcttcctcactgccaagtagggtgcaaggattgggcaggtggcccccaatatacccctggaagcagagatgtggtaggctgggatgcctttccaatggttatcctgatgtggccccatggacagaacataggttttagagccagacagacatggcatccaattctagctttactacttattctggaagaataggtcacctaatctttcagaacttcaatttctccatctgtaaaatggggataaaatagcttattgagttgttataaagatgcattataatatatgcaaagaacctgaaatgcacctgacacttggaaacctttataaatggtcactatggttactgctaagaggcaggctcaggctggaaccatctcccgtatgacatctccaaccatgtcggatgtcagtttgtctgaggagccactgtggctgcagcaggcagctctgcattagaaagacacagctgggcacaacgctgaaatatgttagatttcaacaaccgtaaccaccctctctcacttcaaaacctcattcatgtttgctaaatattataattttatattatgaataagtataatataacattttctctagattctggttgtctcttgtataatgatgtttgccaaggaagacagagaaatgaagaggaaagataccggaattgctttcttttaaatgaaagtggggccacatagtgatatatacacatcctagcttacagcatagccagactggttagactctaaggaaactagaattccccttccagcaccactggcatttgcccatgcagcatgagcactgtcacattcctaaaggcatctctttggctagtgcaaacccttttgcctgggaggactgctttgctgtaagataactcctcatccagccttagccatgggcctacaacagttactagaccactgtccaggtgacagtgctattgtgttctgcccttccaaggagcagcctgtcatgcaataaacatctatcaagacttcttgtgtgcccagcagatatcccagggcacctgccttgtgaaaaggccaaagattgcaaagagatgggctgtgcaatggtgaaaccatctgaagacttctcaggccttcttccacaaactgtttggtgagggaggtggttacctaattattgttctttgtgggccctttgagcagcccactgttggacttgacagcagaacttagtcccgaggtacctccatctatttgctgccgttgtagagaccaggtcacactgcatggaatagaaaaaccttattcagtccaacagatgtttgctgagctccctactatagaagggaaagatcatgagaggaggagaagacaaagagagattgattgatggaaacaaatacagtttgataggagaaatacggccaagtgtttgatagatcagtagggtgactgtagttcacaattacctattgtatatttcaaactagctagaagaaaataactcaaatgtttctagcccagagaaaaatatttaaggtgatggatatttcaattatactgacttgatctttacaaattaagtgaatgtattaaattatcacatgtaccctgaaaatctgtatagctattttgtatcaattaaaactgttattttcaagaacacaattaagaaaaacaaaaaaaaggaaagatcatagttttgggcccaaacgaacttagctccagccttgactgcaggtgtgattttacgttagtcaccttacttctctctcacttccccatcactgggtttagtaagagcctgacaaaaccccacaggcatgttgtaggaatacaacaagaaaatgtgtgtaaagcttttgtagtgcctagctcttagtaagggctcaacaaaaatagttttcatttttttttttttttttttgagacggagtctcgctctgtcgcccaggctggagtgcagtggcgggatctcggctcgctgcaagctctgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccatagttttcatttttaacgaaactggaatctacacagtattcacacatcaggaaggtgagtcagccactttaacttaagcagcatcctgaaatatgacaagaaatgtacttgttttattactcttctaggacatccttatgcatatgtccccagcaccagagtgtagcctgggagacaggagtggtgcttgagtctctgcatgccctgaaggtgatgggaccttgacggtgttggcccaatgccacactggcatctgctgttgcttgtgtttgccagcatgcaaagttgacctcctgacctgtgcaatttttcaggctggtaaagaataaagaccatgtcccatcattgcttttttttttttttttttttggagacagagtcttgctctgtcacccaggctggagtgcagtggcattatctcggctcactgcaacctccacctcctgggttcaagccattctcttgcctcagcctccagagtagctgggactacaggtgtgtggcaccacgcccagctaatttttgtatttttagtacagacgggttttcactatggtggccaggctggtcttgaactcctgacctcaagtgatccacccgcctcggcctcccaaggtggctaggattataggcatgagccaccgcgcccacccccatcattgcttcttattttcatgatttcatgccaaaagttattgagtcccgtaagttttgcctattgtctggtcttaccagtacttttatctaaagcttttttggtctcttgtatccttcttgccggtttctcccagaagctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccaggtatggctgcctctgctttctgtttgtttccgctttgaattaatgcacaagtgctgcacctcctaatgcgcctgaacaaccctgacaacttgcttgcttacagccatcctcatgattggttgcccatgcaaagcttagttttgccttgtacctatctgtgcagtggggtgagatgtactggacccccaggaaggcttggccaagcatcctggagaaaaggtcctgtcccatttggccttgaaggactgatgccaatcagtccattggacccctcagatgggaaatgccccagctccagcctagccttggaagttggttgagtaaggatccttttttgagaccttatctgccatctgccacatcatacttggaccacataactgtttctaagcacttcctatctgatgcttgctttatgagcacagccatggtccaaatctcttctctgtggtgaccctaagagaaggaagagatgatgcccatttacttacaaaccctatctaccaaaggcctctcaatggaaacagattaaattgaaccacttgtaatagaacaagtggagaaaatagatgctggaaagcaccatcaatgaaagcaatccggtctgctagagactgtgatggcagcagttctcctaggagatacagatctgtctccagggatccaagacctaaccttgctggtctcctttttggccaaatccctcagagaagaaggagctcttcaactgatcactctgcttttccagaccagccaaatgccaaccccaggcaggagaggtgggcatagaacatacagctgcagcctgttggggggccccatagaccctgccatgttcaagtgtggtgggaagacggccttgggcagcccccctcatgcctgccctgtcttcagtgcttgcccggctcttggctcggtggtcatgattcctcctcccaggaggagacaggccagagggctgtggcctgcctatgatgcagggatgtatgtgcaaaaatgggctaggagagcagcaacaaaacgggatcagtgtgtggttcccagtggttgtttgtacatggatgtgtgtgtctgggagacgtgtgctggacctccagtgagttggcaggtgagttttacactgtaggtcagaagcatcaattggtccaccctgcattgacaggaaggctccccagtgcttgctggggtgggtgtttctccacagtcgctggtcagatggtcggtgcagaaggcaaggcacgtgggcaaggctgcaggaaatgtcctcattataccttaacaggatgttcaaatggaggttctccttgcttttcctctgccccttctttctctccattctttggtccattcctttacaatcgacagcttggagtgaatgtccagatctgtctggccttcatgggacacttaggaggtgagatcaggtgaggcttgagtaagccctttgcagcaagacagattccttatggcaattgctccctggggtgagactcactgggtaggctgtttggacctgctgtgttcacatgctgggtactcctagcagcactggcttctgtggtttttgtgtcagagaccgaaattctgggtagaccttgtcctccagagttgtgcctgctggagatatcagaatccttcttgtgaatcgcccaggtgcccacttaagccagagagggctgggggattgctcacctcaccggtgacggctctgtggctctcctgcacagatctgagaaggtggtggctgtgttctcggttagactttcctggccattgaattgggatccgagaataaaacctctctgaattacaagttggacatttgtggttgaattctgtggtcagcaagcagggtagaaggtgaagcggggtacagaatgagacttcctttaacagcactgtggtgtgggacttgtgccataggaagaaaagcctgcttcatctctgacaaggccatccccaatccctaagcacagtgtgctgactcatagtgcagcgatccaatgcatctccaccactatgggtaaaacacgctagacactagaagacaatacacttgctggctgtatctaagaggcttcaccttagtgaaaggtaacactctcctaatcaaactcttgtattttagcgtggaggcttctgttctctcactttaatttcatttgctcgctgatccctagcccccaaattaaccctgctgtgctgcttctggcattgctgagcttctgaactggccttatggtattgatactgcactgaaccctctctaacctttgtcaatttaatttactaagttgaattaacctttgattctgtgttttctatagttgacctaattttttttctttttatctatttttttctctgtttctgtctctaccttccctttccttctgtccccctccccttcctgtgtctgtcgtcacacttgtcaccttggacgtcactgggacatccccactgccacatttgtttttaaacaaccacattatctctggggacccattgcttgacacctgcagcaaccttgggaggcaattctgcatcctacacctttgtctcattgcttttctctgcagtgactcttcttttgctctgttaggaacttgaacacaaaaattaaatttgcttaaaagcccagttcctatgaaaaagatcagtgccccctttggaagaacctggcaggaccaccatggccacagctgctgagcaaccattctgtgtggaagagaaggttttgtgattggaaaaagctttacctccagacatgtcaccactcacagatacttttgtgccacttcataaggagtttgccccctttttaatggcagtaaaaagaatttgagagctctttctttaaatgctatttttaaaaaccatcatgctagatttacagagaagtttctgcatatctgctacttgttgcattttgggttcaaacctaaatatgatgtagcagaggaagaattctaagtaccttctaaagcttgtgtcagattgttaaaatcaccacacattcccctcattctaactctgtgctccttgtcctcccttcaataataattggctttgcttgcaattaagcatttaagtgcccatgttaaaagagccagaccgcactgattcacatgagcgttttgctgacatgatgggcaactgaagtcacccctgttgcccatgcactggaaaaaaagttgaatttgttggatattttctggggctgatgaacgttctgggatgtgctttcagtcctcgtattacggccagcaccttacactgtctctgtgaacggggccaagccatgatgtgccaacaagtgtcagctttgaaaggtgtttgtctcccaatcggggtgactcccctgctgcctggcagcatgtcgcagatcagcacagagtggggccgtggttcagcagtgacccacagaatggctttgagcatcagtctacaggacaggttggaagcatccactgtgaaccaggcattagtcccctacctggcctgtgtgtgctcagtagagaaggagagggacaggccactcccagactgcccagcccaggagggttaataaattggggccgagccaacctgtcagtgcttcctgaatgccccagcctctgtattggtgcgttggttcagtgacattttctaaactctcctgaaaatccagctgctcctccctgctgcttgggagttcacccaggagaggaaatgggtgtgttttgttaaggtcccttgtggagactcagggctgaatcctgcttggtaatatcagtgtgtgtgcttggggatggaccttctactgaataaaaactccctccctccccccattgtggtcacatatcattctacatatctcatctctgagcatctccatggaagcttgatttttgttctttttggtttctttatgtatttttttctgttgttattattttttaatgttcaaagactagcctttccctttgggattccaaatgatcccatgctgtggtctgaggggcaaagccacctatgttggcgctcgccattaatccccagcgctcagtttagaggctcacgtgcagacatcagaggctccatgctgcacagtagctcaggcagggtagtgcctctcaacccagccacaaaactctccccgctggagtcccagatggcgcttcacaccagggcagtggaggcaggcatggtttttgggcacagggcagagcataaggatcccaggtcagtgtgggagagctactggctcttaggatcaccttgggcagaagtcacacggcttcatcctaggagggcccagcttgggagtctgcctccccctgatcccaggaccacccacaggagaggggcagtgtccatctttctgaagggaccctttggagatctcgtcctaagtgtggagaggactgacgtggccctgtcatctcaacacatcccagggtcaggcaggcctcagctgaaacaatgtcagggtcctcaagggtcccatttagacagacccacggcttgtaacagtgcgctcctcaggaggcagcactagcgcatacccactccccacggacactgagttcctggtgacagctgcagccccagccccgccaggagtcctggagacagcagccctcagagaccctgcaggagtgagtgcaccccaccttgctcagccacaccccactcccctgtgccctgtagttgtgctgcccatgctccacacaccatggggcccctttgctcatttttggactatttatacagcaggtttggatcatgtttttctactaataagaatgctaacattgttgtgtagataatcagtgagggctttatgaagtttacacctttgcattattaaaggaaataacagttcatgtgaactcaccagcgtggcttgattttattcaatagttgtgtctgacaaagcagcaaagaccctttccctccgcctctcatgtacctggatagactattacctagagaaatagtagcctggtgaatgaaatactttttcttcctaacggggagcaatctctttttcccaggcatcctaagagctgttaagaggcattgctgccttggagtccccagcaggcagtgggaggggaaaatgcctttgcagaactggggaggtggtcactatggggatggggccacactctgagccaacagatgcacaactctgtggcaaggtcacctgatgacacagcagcctttatactatccctaacagaggctgcacagagtgagcttgtggagagggaatctgagagaagattctctttgcaaactgtattctattcataatcacacttaactcagacgcatcctgcaagcccctgagaccagccatctgtttagctgattcgaaggagcaagcagacatgtaaagggcttatgagtgaaccagaaccccagctcaacagttccaagagtctgaccatcttctgggagtcttgggggtgaaaagggcatttctgctgcaccagggtctcatggcacaaggactcaggcccatctggatatttataaaatgtgagacccatgttcctatattaaggcatacaaaaataggcatctgtgggtctcattcttggagcaagccagttccctctttagtgccaacccctcccaagccaggaatcacagaagatggacagctccaccttcataatctccctgtcctgggcagctctgacctcgaggttatggggaaactcttccccagaagccttctttgcatccaaggtgcacaggtgagttagtcaagggagggctgagggaagaccatagcaaagacagacccatggaggtttatatttttccttttatgaaatattacacaagaggcaggagatggcctttgttcttctagttatcttggactaaacaattctgtgatagccactgagagggaatgggtgttggctttcgccttcaataccctgctgcccatttcacagcctgtcccttcttcacagcctcttttttgtaaaagccacaaacattctcttcctagcttaaagagcatctcacctgcttgaggagtttagactcagtgttggcatacagtatggtcgcttttcctttggggcatactctttgttttctcttgatccactcaataccttaggtcaagtttgttttcagggtcactgggtgagacagcacagtgcaccctggggtggcaaatcatgggatcacgtgctcctctttgtaatgcaggggagggaagacctaggagcgtggtcctcataagaatcacctgggctgcttgttcaactcctgtttcctgagcctcatacccagtgattcagatcccataaaagtggggagccccagattctgaattgttaacaaacaccctaggaatttgctacaggtggagatatattgagtttaaaggtatttgtcatgcaaaaataaaatcacaaggatcagtgattaaatatgggacctaccgagcattttggtcttccaggaaaaagtctttctcagtccacactctggagactggcattagggaacctgtaccgtgtgccaggcagtgtagaatgtatgacttggaatgacaggctcttgtggttgaagagacactctccacccatgctcctgcccagtgtgggagcctcatccacagccttacagcgtccctgccaaggggtcttctggcctctgctcgagtgccttcagcatcaaggaactcacctctcagagcagcccacactatgttggattcgccctgtttattagtcctttctcagatggagctaaaatctgccaccaccataatttccacacattggtgccatatacagtaagactacttcttccttctggttataacacctttaaatatttggaaatagtattctcgtctccagactaaacactcatccatttgtgcaacaagtattctttgaacattttctgtgaatcaggattgtcctagatgctggggagatacaagagagacaggcagggtacctgctgggatgtcctaggggggatggctagatcataagcatgtaaatgaacagaaagtggcagatagtagttagaagagaataaaacaggctagcagcatggtaggtattggctggaggtgccacactagataagagatcagataaggcttctctgagaaggtgacactgggactgaggcctgcaggacaacagagagccaccctggagggagtgttccaggcacagaatcatcaaggccctaaagcgggttgagctggatgtgttcagcaggcagaagggaggctgccggttcacgccatgaggcccaacagaggagtgggcagagtctgcagcagatggtgggccttttaggccgggagaaagactttgaattttatattcaaatgaaaggggaggccgctgccctacttgtttatgccacagttcagaagccttttccctgcctggccctcccctggatgtgcgcagtgccagtgccgccctccagctgggtctgatgagcacagagcagttgtcccagctgctgtcctctcaagcacatagagcagctttgcaggagtttatttttcctctttagagatatgattagtttcacaaaatcatatttacacataaacctcagaagatataattagtgccattgagtccaaaaatccagacatattccccactgtcatcaaaaaaatactttcagatctttcttcagggagtaggcactttacacctatcgggtactgatgtccggaagctgcagtggcctggagccctgtgtcatggaatggagagaaaacccaaggctaaagtttcttccctgttcagggaaacagctatgggatcctgaagaccaagaaggcctgtgtctcctttgctttttgggtggaatgtgtgaggactctggggaagtggatggttttgttcttatgagactaaccagaaatacctctgcattcatggctgctaagaaaatgacccattctagctgacggctaaggccagtggccagcttcctgctgccaaagcccagagacaggtgtccagagctgggttctccaagcagagttcttcgccatctcaagccttcctgggggaatgcgctaggatcttcagtgcgaggtcagcagggaccagccagagagcctgaggaggaagggctgggaggcaagccaaggtcccaaagggactaaaaacatgtacgagctgcacccaggggtctcaggagtcatttgtgagggatcctctctggcatgctaggctgatggcccattccccaaactgaagtttgaaatatggaccagtggagagggacagccaccagagaagcactagagtgcctggacagagacccctggggcacacagagccatcaataccaccaccctcccgcaaatacaggctgcatgaaaaacaaaaaatgtgtggcccagctctggtgctggttactcagttacatgttccctccactatctatctggcatgttacatggctcgcaagctgctgagcctggcctggtgcttggcaaagcctagcgagctgggttgggagtggggtggctggtggggtgagccccaggtagtgctggctacagttcccatcttcagtctgcagtcctgggtggcttcagttggccctgagagcacaggaagctttagacatagtctactggtggggcagggctgccagttatggaagcaggttgttctggaggaaagatgaattagaagtgcccatatttcagtcgagggtgattgttcccacatcgacttaatggcagagctccacatgggtccttgcttcctgcatcatgaccactgtctcccagacactgatgggaaccaccaagaggtcaattggtccatcccaggcaactagtgtcaatcgtaaccatgggttgatctcccaggggccccagagagctgagtccaggtctctctgtgaaaccatcaatagccaaagaccctggggggattgcagatgggcaccagggaagtaagacacaggctgagtctttcacagtgagtccagccagaaccagggtgccaggtgctagaatgtgagagtgcatgcctgtctgcatgggcatttatcctgcgtgtgagtgtgcctgtgtgtgtgtgcacctctgagtgagtctgcactcacttcaggttttcctgaagtctggtccaagcaggcctgagctcctagatggtgagtattcccagacctttcaccttgcccatggcctggggaggcctccatgtctctggagtcacccaggcttcacttgtcttcctggggtgcagtgaggagggtaaactatgaacccagtgtgctctaatgcagggctcctttggggtcattcctaaagagggaaagaggaagtggagaagtataatggggatgctattgtgatggacaacccaacaagccccaagaaagccccaggaaccctccaccaccccattttgggcccctatccctgagcacttgaggagccacagccccgcctgaaatcagtgatcactgcctgcctgtgctgcaaagccttttgccctggtccaggggaaacacagcagcgccctccaactgcctcattatccggtgttctcagacaggcggggctcagtctgctcccaggactcacgggaggccagctgaccaggctcacccctgttccccaatctgtgagatgatgttgtcatccctccctctggaaggtatagaaagaccctgttttctcaattctggggcatagaaggtccccaggaaggtgtcactctgggcatgaatgccatgactctgtcctctgggccctccccacccgcaggggcttttgctggcagggtctggaggtctcgcatctcagtctgttaaccaccagccatctctctcccactcaagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgtgagtgcagacctgtccaccttgctgaggtttgggctctgctccagcccagggacccagcagctgcaccaccctgcgccatcagctggtgcctttcctttcattgcacgttctccatttggaaccctgatgggggaaaaacattagagaaaagtttctcaaagcatggtctttgggggttacctgtttgaaatgtagactcttgagcccaatcccagatctcttgtattagaatctccccagagtgtgaaaatccctgtgtaggtcaaaatgagggaaattgtcagaactaaacctggggaggagctgccatggggtagggcagcattagagggacacacttaccttgctttcgtacattgtttattcattcattcatccatcactcaacaaatatttatcaagcagctgctgcaggcaaggcactgttcccaggcacataggtacaacagggaacaaacagatagaaattcttgtccttatggagctgatgatccagatactgtccctccaacagcatcttggagaaacagatcctaagccagttagcaagagccttcgaagactgtcactgggtggagcagagctggagcaagccagaaagggactgagcaaggaaataagttgtttagcaccaccacatgccaggcactgtatatgcatatacatgtatgtgcatgtacttagaaatgtatgtataggggtgactcacgcctgtaatcccagcactttgggaggccgagatggatggatcatttgaggtcaggagttggagaccagcctggctaacatggcgaagccccgcctctactaaaaatacaaaaattagccaggcgtggtggcatgctcctgtaatcccagctattcaggaggctgaggctggagaatcgcttgaacccaggaggcggaggttgcaacgaaccaagatcacgccactgcactccagcctgggcgacatagagagactctgtctcaaaaaaaaaaaaaaaaaaaaaaaaaaagaaaaggaaaggaaaagaaatgtatgtatacctgtgtacagagacagatgtatgtatttgagcaatgatctgtgtcaggcactgtgtttagcacttcccatgcatcctttcattgaattctcataactaggcaaagtaacagtgtttttgcctcattttacagatgaagggactgaggcagggtgattaaatctgaagctcaaggtcacacagctagcaagggttgggctgagacttatacatttgaatctgttggctctggatgcccaccgtgccagccttgggttgagtcatagctgctcttccgtgggagcccctccctgcagctgccctagggtctaaccagcagtactgtctccacaggaaagatgagtccaaggagcccatcgtggaggttcgaacggaggaggagaggaccccaaaccatgatggagggaaacacacagagcccaacgagaccacgccactgacggagcccgagtacgtgggctgggaggggctggcacctgctccgtagagacccccacacccacctccccaccctacccccacctcccgtgcccctacccacagctcccggccaaacagttcaggccaggattccaaacccttggccacaagacctgcttggctgagaaatgcctgacctcaggcatttctggttctatttcggtggctgtgggtacccttagaaggctcctgtataagtagggatccctggatccctagcccctgttctcaagttatacacatattctggaaatggcttaaggtggcaaaatctcactgaaaggcttagcagagtctgcttaggatttcttgaaattctagggttttgtgttttccccctgaaaggataagggaagctggggacctggtaaagttctctgcccctcctctgttcagaaacctcggggacccacggagccccagaccagttgtggttgtaatgcctgcctagctgtcaaggatcttatgggcttaaagggaatggagtttcagggaaccacaaaatctgtgactggaagaacccacagctcctatgagccattctgagtactcgtgatctgccttattcgtgacttttcccatcggtgccctggggagccctgcaggacagctgggcccagttcctctgggacctgggaagcctagagcaggtggatgctgaacagaagcctgcccctccttgaatggagatccagggcagggatcaggaagccctaggcaggtctgcaaggacttcagggaaagggagctctatgcagagagctggagagacatcagcagggaagggctagcaggtcccttttgagaccgccacgttctctgtcgtctcctgtgtcctcttctgcccacctgggcgtgtgcttcctctcagcatccttctctctctgtgggcctgtgtccgtgcctgtgcctaactgcatgcccccacccccatggtccctgtcctgggcttcagccctcctcctcgcttctctgtcacgtctcagcttcattgtctattctcttctacttcctgtcctcccacaggctgcctgccgacactacggccactgtcgaggacatgctgccttctgtcaccaccgtcaccactaactctgacactatcaccgaaacctttgccactgctcagaacagccccaccagtgagaccaccaccctgacctccagtattgccccgccggccacggccacgcctgactcaaactctgtaccggctggccaggccaccccttccaaggggcccagcgcctctgccccctccccggccccagcttcagcccccaaggtcgcccccctcgttgacctgagcgacaccccgacctcaacccctgccgctagcaatttgtcttctagtgtcctggctaaccaaggggctgtcctcagcccaagcgcccctgctggtgtcggggaggcctctaaggctcctccggccagcaagcccacccctgcaccagtccccaccccgactggggcagccagtcctctagcagcagcggctgcccctgccacagaagcccctcaggccaagcaggaggctcccagcaccaaaggcccggacccggagcccacccagcccggagccgcgaagagcccggccgaggcagccacagcccttgctagcccgaagagcgaggctgcctccgtcagcaccacaaacccttcccagggcgaggactttaaaatggacgaagggaacttcaagaccccagatattgaccttgcaaaggatgtttttgcagccctgggctctcctgctcccgccgctggggccagtggacaagcccctgagcttgctccttccactgcagacagctctgtttcgcctgcgccagcaaagaccgagtacggcctctctttgtctgctgtcatcgggttgtgtcctgtggtggtgtgcatttgtgctgtgctgtgtcctccttgttagatgtgtcttcagcctcatccagggcttctctgaggcgaccgtcaaccaaggggctgggataaggcagagagagcaggacaggcagctgggccccaggagcagccgcctgctggctaattaggccatgttaattatgttttatccttatcatcctagcagcggcttctgttttccctgggggagcccttgcagtcaggccactgatgagaatagcttgggaagcaggctaagaaggccaaggtgcccttatcagccaccctggggcccccagtcggtgtgttattcagtgccaggctgagtccctaccagaaaggcactgatgtgcaggaagaaaagaggtaggccccaggcccgtggcaggggagggtgcagttcagaggtcccctcacactgtggctcagatgctcaccctcccctcccaaccccggcccccagcccactcttgcttctcctgctcttagagtggctgggaagactcggggctccccagcatcaaatggctgctgggtctcaaagttcaagagaaaggccttaacctttcaggtttgtaagtgtcttgccaaaattcagtggcaccagctgaggctggggtctgtgcctgtccccatgcatcctcagacccgactccctttcctggaactgatggaggcagagtcagacctagatttttatagaggctcctatggctgctccccagataagctgccatgctgccaccatgggctgcaaggggctctcgccaggagccctgaatctcagcatcgggagggaaaaggactctgatagccctgcccactcagctgccctcaactctcgcatagccaccaggcccactctagtaccccaccaggctgccatgaaaagctgcctccatcagtgttttctcaccctacccaggcaggccctagaggcatcatcctgcaacagcacagggtggggtggggaagggacaggcaagagtgggttgcaaaggggcccctgaaatcagtgctgggagcccagcccagcccagcaggctgcatttacatccagctgagctgttgccactgcagctggtcagggtgaggaggagctgcctctgctgcccccttccaccaccccaggtaaaaacacagcctctggcatcaacttagggctggaagaggaaaggactcgttcttctgactcagtgcttctcaactatggctgcacattagagtcacttgggtgcttttaaaagtcactgtgtccggaccaattaaatcaggatttccgcgaacacagctcgggcttgggtgatttttagtgctcccaggtgatttgacgggcagaggttggagccgggtgctgtcactggagaacccctcctcctccctgctgtccccaaggcctggatgcaggggcgagatgtctgcagaccgtggtctcagtggttctgttttcctgattctctgcaggaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttcttttacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttccttt

SEQ ID NO: 37807 - DNA, 221210 bp, Homo sapiens
gatgtttcgcgaccaggtcggggtgctggcgggctggtttaagggctggaacgagtgcgagcagactgttgcgctgctgtcgctgctcaagcgcgtgagccagacccaggcccgcttcctccagctctgcctggagcactcgctggccgactgcgccgagctgcacgtcctcgaacgcgaggccaacagccccggtaagtgtgcggcggccgccgccgccgtcccgcctgcccaacccccgctcctccctccgcttctctgcctcgggccaggccgaggccagtccctgccagccgcgccgggacctggacggcgtggccccgaggccctcggaatccaccccctccgggtgtccccccactaccgccccccacctacttacctccgccggccgctttgggattttgcccactgtgaactccgtcagccctttccgtgtggtagctacggtagcatgaatgattgatttttctctcatgcagtttcctgggaaataagtaagtcaggtcacgtagagtctggattttctgggtgtgtgtgttttttccttcctcctccttcttttgggcaacgtggctcgctggatttcagcaacacatgatagatgcccgggactgcccttcagaagccaagcttggataaggctgtgtgaggagtacatgaaaatccaattttattattcatttttccccacagatattctggttttagagcttcgtcttcagaataatatgcaggtgacgctagagactagtaaaatgacatttgcagcatatatatatatatatatatatatatatatatatatatatatatatatataatgcggttaagcttactgctcgtgacattatccatattgatacggatcttgtagaaaaaaagggtcttggagaaaggacaggcatgaagtgggttacttaatgcttttcgttaggaaactttactgaatagaacagaatcgtttcatattaccctgctagtatttacagacacctcaactagtatggaaagtgaatatagtcgaaaggtccagcagtttcctatttgctagcgtgggtggtgacagactgaaattatatcctggagggtaggaggaggctgggggatggggggaaagtctgatggttgtgattttggatagggggaaattctttagttcatgctgctgcaggagggtgaacagagtccccagtgtttatgcagagaaaagaatgcagggtcctcttccagctgttccatgttggagctgcgagcctgcaaagctcagcagaggtctgggctgccatttgatgacaaggtccagtccagggcagtggggcctgggagacactaaagtgagtgtgccttcagagcagcaagaagcgagccggcctactcattcctcctccctagtatggtgtgcacgatggtgaaaacactagaatgggatgcttccatatatagaatcatagggtggaagtgaccgctggaaatcttcacagttcttttcctgaccagacaggactgcacccgaaagatcctgcatggccaagtatggagggccacattgagggagattccattgagcccgagcctcccagctcacaccaggactcactggggtggcgatgacagggccccctttggttgagctccacgtttataaatagctggagggccagcctccttcactggggtgtggaagcataattgggtaactgatgatccaccctctttgcttccttccttaatttcagcgggaagcctggtttacctgctcggttttactttctcaggtttgacaaacaaggttatataaacttttgcattttatagattgcagaggatttacgcagagtcatttaggttgaatgcttgatttcagtgctggtagggactgttcaaactcatctttaggttattcaaatgttggagcagcactttttccctttgagtaatggagatgacttttcccaatagagcagccaccaggttagtaagtaaaacagttaaatgttaaaataaggtggcctaattttaaaaatctcataatttaaaaaattgaactgtgaattttttgaagtcacttggcattttttttcccttaagacatgtttggccatacttatttgtataagatacccacctgttcatgctgctaaatgatgtagatatacaaaatatagaaccattgtgtaagataggaactggtctccagtttctggattaatccttcgcctagacgttttgcctgcatggaaatctttgcagttgttttgttgtgtggccaggacagaaatttcttaggaggtcatgtgatgatttggtttactttcggagtgtggggatcataaagagcatcaggagttgtcatagcatacctgagtctgtagtgtggctctctgcatatccggaaactagccaagaaccaggaagggggcaaaaagtccacttcgcaaccagagtagatagcatgaaagtccaagagaatatttcaggccctctctcagaatgtacttgctcttattctagacacaatcctaacatttaaaaaatttgacaaataatccgtagtgtattgggggtaacacatttagaatggggtgagggactgctgtaatcagtagtaaaaagtgacccctgacagcctgacaacttggaaagagacagaaaaactgtaactttagacaagaattggggcagaaactttgaaggcttgggaatattagggtgggaaccctcaattgaccttgtaggcaccactctataataacataaacaaataattgctatttactgttgttaacggtgaactatggaaataatacatttttagatacactctttaagaagagaaggaaatgttcaatatactttggaaatgtttacacccagaataattaacctctgagctgttttgatgtgtaaggctcttaccaattcagaaaactaggctgtgcagaatgactcattcattggattgctgagatttcctgtaccgaagtcatcttgtatcactttattttgtaatcatcaatttaaaaaaccctcacattttgtctagtgtttagagattttaaaacttggtaaatgggaaccaaattcatatatgggactcgatctcagtataataaaaaaaaattactagtaatagtatgaatatatctctcgttttatgcaggactgattttaaatagtgagatatcctgcgcattaaacatgatttatttgagatttgtgggatgtaatttggtgctttcattctcttaaatttattgagaatctagtgattcactggttcatcctttgcctcaggctcatggtcattggagattccaagaaatgattgaatcagtccctatggatttatttgtatgtgtttttcttttaacagatatggtcatgatcagttctctagtacagtcttgttcccaggatccttataaccttagataagtctcttcagctactgctccagttgaacattgagacttctggccagtctcagttccaggactagcaggtcatttgatacctacaagtagcaaaaatgcaacccactgactttacctgaagtttccaaaagaaaaatagactttgtggcattgtttatttatggcttttgtcacttggacttgaaatatatttttcatagagatttataagttaatccacaaaaacgtaacccacaaaatatacactatttgtgtatgtttgtggtaagtaaatgacaataaattcctatacttatagttaaatacaagagaaaagggtatccaaaatggtgatgtttgagacaaaaaaataattgtggagcttgaagactctctctcagaatgtaattactcttattctagacacaattctaacttttttaaaaaaattgataatccatagtgtattggaggtaacatatttagaatgggatgaggggctgtcaccctcaccccatatttgtgtaaacttgctgtcattagagggtgggtatgttggttccatgatttttatggttttggtttctgtagtacaagtatgccatcctccaccctgcgttactttttaaggttacaaatggcataaaaagaaagcagcagaagaggttttcctgatgatatggataagatcttgtttgtagttttttcattcatttattcattccacaaacattttctgactgcctgctattttcctgacccagtgttatgcaatggaaatgtaaaggtaacttaactctagtccagtgcctagtacagatagatactcttagtgtggggtaaatgactaatataatatcataggtgttgaagcatagatatggggataaaaagtatgaggagaggcctactgggagcattgtgaacctagccacttattgcctggggaatcagggaagacttccctgaggaggagatacatttgagctgagtcctgaggggcgaataggagttggttcaatattttaatataaaaagattgtaaagaggggtcaagaaggtatctcccatgcagaagatagtgttatcccctttaatgtatgggcctacatgcatgatcctctgagaggcatgagtggaagagccagtttagttcagacagtttccattttggccacatggtggcattatcttctaagggcagcttggttgctgtccgcattggcatatgcaggagaaggaaggatggaaatagagaaaaaagtattctccaggtgcccatctatttatagtcataggagggcataagttgtagaagatttttagagtacagatttttaaatcagcctgggctagttaaataatttctaagcctcagttttcttatctgagaaatgatgattataaaaccttgttattgtccggaagttacttgttaatgatccagcaaggatctattctatccctcaggtttaaatttgcctttaattaatatagaattgatatgaataatatttttctaaatgatcagaaatcttttcatttaaaggattatgaagaagagattgaggatgacttggaaccctaaaaagatataagtctactgggacccaccttctatgttttagctttgttttttcactctgtctcctaaaaatatgcagccctgacccagttttcccaaataacttatcaacactttttccttcagttggtgaatgtgaaaagaagaaatcattttgctgaatgaaatatttaggggctttatatatgaagcacttttcacttagggttttgtaattttctttgggtcagtctgggatgaccctgcagtttactgctgcttgtaagttgtagcaggtcacatatatttgtactctttgttgtgaataatttgggtttggttgtatcgcctgggcactcacggccttcaacaattgagtatatgctataaacaggccccatcaaagcaagtaaaaggcagagaaacttcacaacagtcaaattgacttgtttttgtttaaataaacaaacgaggacacaagatgagggttgaagggctgaaagtaactgaaaacttcccagacagtcctacagaagtctaattctagagagaattgacaacaccagagaagagggaaaatattgcttctccttgacccaaggagaaatttggaggttttcatctgtgggtgaagtgctttgtgtaactcatttgctaggaaaggtatggtgctcgtagaaatcttttcttttcctttttaaaatatacaatcactactttgagattttagtatgttccttccttttcatctctcctgatcattccttccaaggcctcactgagctcatccaattcacatagattaagatgcagaagcagacatctcttctgagctatttttgcttccattgaagctgcctgaggcaggattttcccaaagaaagcagaacttttagaacaggggcctagagtcgaggcttgggccttgctctgctgcctacatcccaagagccagcttggaattcagagtacctgcctgcttttatgtaggaacatgggattccctggaacccggaagctcattctattgttttgttcccattccacatatcaacattttaaaacagctttcttgtcttagtttactaggaaaaagcaatcaaatgattcagtggtttcttttacacagtagataatacagtgccattgtaatggtacctgacaaagtgtatttggtaagaaagtgggactgagttccttggcacatataaatttaccaaataccccagcagagagcccagggccctgtcaaaagctgaaatacacattactcctctcaagtagcttacactcgagttgcagagctgaaacaaacataagaaaatatgtcataattcgatcatacacagttgctaagtgctgtggttctgattagagaacaaaactgaaattgagtgaaaggagagaacagcgtggattgggcagtctgagaagctgaatggaagaagtaaacttgactgtgtcacatgaaataagtgcttttagggcttatgagattcttgctgttgtagtacctcaaatgccagtttcatcaagaaaaccacacatgcagggaactctgtgcatgtgccatggaaggggcaggcttcctgggcctttgaaggatgaatgtgaatagggtagagagaggagagcatgagggatattcaccgtcataagtgattgcttggtgagtggagaatcaatcccaacactctatgatttccagtatatttaaagatacgaaaatggaacatctggtcacctagtattttcatcccgcttaagtatgcataacattgtaagacttagtaatagttctcttggctcctcctagtaggatatttttgtaggatgctttgactctaactagcgttgagcaataacatctgaaacagttagaggaaaagataaagtgtcgtagaccagttctcaaaatttagttgcacgcagatcactttggaatcttgtactgaaaacctgaaaactctgattgaagaggcctggggaggtggagctgaactcctgggattgtagtaggctcccaggtgatgttgatgctgcgtatctgcggaccatactttgagggtagactgttagaaatgaaaggtgcagaaatgaaagagactgttagaaaggaaagaggcaatttggtgcagtagctttcaagttttacggctatgtgtcagaagatttttgtttgcaagtgagaacttagatgaaggtttatgggaagtgaatgtccccccaaccccctactccccaaacctaagtgtcctaggagagcagtttggaaatctgtgaccaagggcagtggtctttctcaggctctgagaaaagacattggtcgacaaagctatggccagcagatctgggatcagaatctgactctcctcagtccgatgctctttctcctgtctcaacccctatcaaatggcagtaacctgttagagcccttgcttagggctgggttttaaactggcccaggtggtttcctataataagatggggaccacttatcttttgcccactgaacttgctgatatgaggaaggtcattttctgagtctctctacagttttctgttggcttcacatgcagagcaaagcaaatctttcttagctctggcggtgggacctctttggaaggcagggggaggagacagacaggacaaggtggacactgtagtcagtcttaagtagtaatgtacaaaagtgcatgctaagtgtctacaggcactttgaggtcactttgccctggaaaatccccatggattgctttagtcagagagtatgctagtagtgcaggtgtgtttcatatgatggaattattgacttaaaaatcttttcaagttttacttacgcatgtaagcactgaaatactgacgctttttagtttggtagtgtggtcactcattaaattatttgagcattttatatactgctctcagcaataattctctcaccggctctttgaactacctctcacagcctgcactgagtttgggtttgaagaaggccggagaatttccccgagctttttgaatatgctgaaatttccaggcactctagcgatcagtgtcttatggaaaatgaggctccaggaaagatttctttctttctttctttttttttttttttttttttttttttttttttttttgctgatgctatgggctgtaaagttgagctggaaagagcaggaatgttcattccagagactggatgggagagttctcttccccctacttccccagagcactcccataaagtgcagtcactggaatttctgaagcagtttatcctgatctgtcatagaatccaagcgtctgtgtgtgcagcataaatacatacacaacattgactttcattgtatacatttctatctgtgtatgtgcaccaaacatgtgatttaaacacagttaaaatgcatgagtaaaatgtcaatgctgaaccagttttgaaattttgaagagtggtaaatgaatgggagaaacaaactgtctgacttcagaaccactccatgtgcctcaagataaataaacttgtctccgtttgaaaaaggaaaaaggagggagaaaccaggttttgcacattgtaggcatctgagaggttaatattgggcctgtgcaagataccagaagaatatttaaaacatgatctatgagcgtatggatgaagaaataggaaccagcatggttttgctgtgagtgggaggatggaccgtggagaactaatgccatttcctatctgatggggcagtgggaaaggggggagatagcatttgctgagagacttctgtgttccaggcagatcacagggaatcccatatctaagtttcagcatagcctttgacaaaacctcttatttcctgatgaattaatggagaaatagcagcaggtgagaatctagttgtgtggctttagcgtggtttcagtgactgttacaggcctgtctccagccactgtctgcctaaagggagatctctggtgctgtacattgaagctcacatgttggacattatcactagtgtcgatggaatgtgacttagcctggggtccccaagaaggcagagcctgaggcaagggctggtgtgcgggtggcttattttgggcactgatcccaggcaacaggagaaggggctacaaagagagaaacaaggaaggaggaagagccaacacaagcctgcattatcaagctggtcactgctgtgggcagtgggggcttaatcccacagggatcctctgaggagccacatagaatgtgcttgggaagtggctgaaggacagatgaggtaggcatgtatccattattcccctctcccttggccaagtgttgccccagggtactgagtccctgtactttcaggtttgtacgtgtttctgcaggtgtctcaaagacgccccaaggcagaatgctagaaagacatggtacagccaaggcagggtgctgtcaggttatacctgtgtgaagctgggggccacagcaagggctgcagtgttatccaagctaagaaggtgtttgtaaagtctatggatgaacctagaaggatagctcatggcttgatgacagaatcatgatcaaaatatttgaatgtaaccagatgacatataaagcattaaagtgtagcccctacattggcatcccctaaacctaagctagagaaggcatagtgcttcaatagcatgcataaaaagggactctggcttttagcacacttacaacttcatatgaataatgtcacaatgtggttgcgcccaaagccactaaactctgtaatacagtcattgtactcagaacaagtctgtgctaccagtcgcactctccctggagtccaggaggcagttctgggtacacactcggagggagatggacaaatcaggatgtggccagagaagacagaatggcgggggggcactcgaaagccagggtgaactgagaagaagatgagcagagagctgtcactgcttactcagaaagctggcttggagttgaagggttaaattctccgtccatgtagagggcagtgagtggaagctgctgttcatttagctcagagtagagaaaaactttatgatgattagggctgcccaaacaatgcagtggcctgggcttcatcagatttggacgagcctttagcatcaagcagaataatcctttcgagtaagactggctcctgtttattgagcacctgctctgtgccagttgtttgcataacatgacctcatttattcttctcaataaccctatgagatgaggtaggaactgccattattccatttgtcagggaggaaacaagcactctggcttcggaaccaccccacatgcctctccactgtaggaatttagtgtctatttgcttaggaaagaagctctgatttcttggatgacttccaaagtcccttctgaccttaagattctatgatttctatgaatcaggaatgaagataggaacacaaaactattgagagcagaggagaaagagagagagagagacaagatgagtaaatgaatgaatgagtgaataaataagggtggttttaaaagttttcttggtgggcgcactggctcatgcctgtaatcccagcactttggtaggctgaagcgggcggatcacttgaggtcaggagttcaagaccagcttggccaacgtggcgaaaccccatctctaacaaaaatacaaaaaattagctgggcgtggttgtgtgtgcctgtagtcccaactactcgggaggctgaggcaggagaattgcttgaaccgaggaggcggaggttgcagtaagccgagatcgcaccactgcactccagcctgggtgacagagcgagactccatcttaaaaaaataaaaaataaaaataaaagtcttcttgatttccagtgtattcctcctgcactttttggcctgtttggaccacagatttgtggctttttatgaaatacacctgtagattaattttcagtttttttatggtagtagacagtcaaaggctagatcactgtgatgagtagggcttccacatttaagaaaaagctgtaatgaagtgaattgaatcttgcttcttttgggtcacccaaaagcagtgataagtgctgagtgtgttaggcacttattaacaaaagtaactcagaattgctgtctaaacctccatatcttttttcttctctccgtgtagttctaaaaatgaccatatgatattccttgaatggtaagagcgtctattcttcttagcatgttctgtgtgtcacacactgtgcagacagcaacatacacacacaaacactatctcctgttattgaatggatgaatgatacaaagaagcagaacgagtggttgtgaaaattaaatgccgtatatttcaataattagataatgggctgacctctcagagtcaagcacactgtaagtgcttaatccctggtttctaagttatatgaatcccacaaagtagatactatctccattttccagatgaggaaacttaggtttagagtggttggaaatgtgcctaaggtcaccagcatctttctgatcccaaaacctatgttgaatccttgctattgcatgaatgctgaagatagattccagttcttaggtaaatgaaaatgttggcaattgaacaaaaaacatgtatttttaatggtagttttaataattcacagtaacattgtatatgtttcatcttggaaaaattcttttcagcttgtccatttaaatattcctcttacttatgacattttaactctccatagcttggtatggcttagctttgtttttccactggctttaaaaaaatgaagtgaaaggcattgatttaaacatctctcttcctttaaggaagactcatggaatggatgcttctgtggcctctgcatgaatgggctgggcttgaggagggaaacaggccctgcacactgcagaaaggaaagcctaaggaatgtgttacataattgctcatgacgtccttgactttgacaaactaggaagtgatgtgctgggtcaggatctccataggatctgcagttggtcaaagtaccagtctgagggctgtaaattaaaatgagctctcctgttgtttgtaagtggtggaaattttcagaacattagtttaggaaaatatgttacagttggtataagagtgagttgtatttatttcatttactagcaacatgcaattaaggaagtagaagagaccttacatactgcagcccctttgttgaagacctgagaagactgaggtgtactggggtccactaagggcacctgttagtaggggaagagctggtgttagatccagtcgcttcccgactttgacctagactttggtatcacaactttctcatggccgacttggctgccacagtgaatgacttcttgtgctggaaatgagagaggctctatttacctgaatttcaaagactacattcattaaaatggtcccctcaaagtcatttccagactcccccacccctttctgtttctttactcacaataaagcacagtttgtttggattggaaagtgattagccctcgtattttgaaattgcagagtgttatagtgtaggaagcatgttataatcactgttccagcaatgtcttcttggtttatgcagaatctgacttggctactctggagttgccctaaaccctagtggagcactgggtgtccttcatgactgcccactacctgtggggagaaatttcattcattcgttggttaaacagttccttactgggtgttaatgtgtatggtggtgtggaccaaccaggagtctccttgtctacgacagctcttcctgagggtcttccccagtctcttagggcttgctggtgccctgctgatacctttgtatagcactagtctcaaggtactggtgttgttcactatctgattaccctgtgccttagtcacttttatcctccagtgcctaatagtgtgtctagcacataggtgatctcagaacgttttcgttgaaagagcggatgaatgaatttaaagaaatttaactgacatccgtaatccacaaggggtttaccatctaggttgtgagataaatctaagtgcatacagattgattaacaaaacaggtcaagatgagaatcctcacgctgttaccaagatacatgtgataaaggccagaggaaatagatgctggtttcccctcagacccttacagaagacctgggttagggtcttggtgtcatcacataaagtatgttaccttgtaaaaattatttaagctctctgagcctcagtttcctcatctgtgaaatggagttaccactacagaaatcacaaggctattaccaggattgtggatgtgtaaaagtactttgtaaactgtatcgtattatacaaaagcagagcgacattattctcaaagtaccagttgaaacaatgggatacaaattcaggaatgtgggttttaaaaggttcaggaaaagatgaccatggtttctttttcagagcttttgcactgttagcaagagctgaaataaacacatggttctcttggtgaacaccaggcccctctgggcctgaactaaggcttggatccgatgatccaattcaattgggactttaagccttgtggccctgatttccacaggctggactgtctataacgtcaaagttaagtttgtattcactttcatccttttcattgattagatcattaaatgtactctcttcaagtatgaaggactcaggtgtccatgctaaagaatttcttttggagaaagccacataaagtgttgtattgtgacctctgtatccctgcctgtaaagattccagtatgagtggtcatgcagccattcaaagcatgccacagggattctatacctattttgatagtatggattatttaaaaatttctgataattttttaaaattctgtttttaaagaggtaaacctagataaaaattactaaacttaaacccattcagtgcaaaacctttgagtatttttggtatacctcagctaaacaagaaaataattatgctttgctttttgttctataatattatttccacttttacctttcactgaacaagcgttcgttggaaaaagagaaggctttcttgtcattgttctttgttgttattattttaacaaagcctccctattttcacattttctttttgtggcagaatgagctgtgttagcacattttgcagattattgtggtatttgcagatgatctgagcacagttaaaatattgaaattctgagctataatgtcaaacttgagcctcatgtgtgattctgatattaagctgctggtgggttatatgggaataattgtggcatatgtatgtttagttcacaacattttagataggaataatttggacaagaattgctgctgctgttttttttttaattttattttttatttttaaagactttcctaccttctcattgagagagagaaagatgcccagagttaaaataggaggtgcttgggtattttgttgaacttcacaagttaaactggcgaatggcgtccatcagctgttattcagtccttgaacagagcagatatgtttgtgcgaggacaaagaagatgcctcaaagacaaagaagaagatgcctcgtcgtcccctgagctcccacacggcatctgcacatcaccagctcagcatttagcacactggattgacactgccatgttaggtgaggtgacggcatgccctagagtgaaggaatctacagcaatatgatagctaaatgccacatgaagttctggattggatcctggattgggaaaaaacatggctctaaagggcagtattgggacaattggtgaaatttaaatgtagtctatgtattaggggataatgctgttatcaattatacatttccttctgttataattgtaccttggtcacaccaggaaatgtccttattaggagacgcatgcagaagtcttttagggatgaggacttactgcagcttattctcaaatgtttatatataaggtgacaaaaattaagaattggtcaatcttggtgaaaagtttatgagagtaaagtgtgctgctaatttaacttttgtatagcttaaaagatgttttttttcttttttgagacagagtctctctttgtcaccaggctggagtgcagtggcgcaatctcggcccactgcaacctccgcctcctgggttcaagtgattcccctgcctcagcctcccgagtagctggggctacaggcgtgtgctaccatgcctggctaattttttgtattttagtagagacgggataaaaagataaattttttaccttttaagaaatcctgcactggaacattggctccaggaggaaggggctgtgctttatctccctcacgtagggttgccaaagaaattacaggaaccccagctaaatttgaactgcgaatggggcatacttataccacatatactagaaagttattcatggtgtatttgcaattcaaatgtaactaggggtcctatagttgtatttgctgagtctggcaaccttgtcctgaattagcagtgccccgagaagcagcagggtggcctgtaggaggtgttcatctgttatgtggaatgaatggtgcctcttcagaattctgttgtgcagtcttctattagagaaaaccctttttatctgagcatggagttgggacattacctgtagttggatatgatctccttatccttctccctttgattgatctttttctttgagctgatttgagctttcttcttttctctgtagttggcggaatcagctcagttacattttttactaagttacccacattctgacactccttgacagttttaagatcttcttctaacacacttgaatagaatggatactggaatctattttgacagctgttgaaaatctattctgttgttacaggaggttaaggaggttatttgtaacactgggattatttaatgaaccttttgaaaaggtgtgcagactgttcaggcaaatagtattttttagaatttaaatgattttggttttcacagttaaattatcaaatgtaatgcttttaagaattatacacctagtaatatttttcattaattttctccaccagtgtagtaatagtacattacaatgttctcaattaccggtgccttctaaaatgcaggtgtagagtctttaaatacagctagtctattgccagctgtcccatagataaccttctctttaaaagtgacctttgagcaatttcataaagaataaatatttctagttttttgttgctgaactgctaaaagatggttctatacatgtaacaggtggctttagttgggttgctttcactgaaatttgattcaaataaagcattgcattattttacctttggaattataattatgtgccagactgacttcatttttggcacactgcatttcagtgttgaggtttgggttgaggatggagtgtcttgcatgtgcaggagtaggagagctttgcagataagacatagcagctgaggcataaaacatcagcgtcttttttatgcatcagaggaatttctatcagaggagttgctgttctactaggctttagatttagggacaactgttcagattaaccccttagacttgaattttctttgatctcaaatccaaagcattaaagaagactctgtcaagttaaccatcagtacagtgcttaacacacagtaggcacacaaaataaaatttgttcaatggaataaactagacaattatgtttgggttattatttaatattaaatgtgatttaattacttgaaatagacgatctttcagttcctgccctttaccgcattgcttggcaacacaattgttaacatgttttctgattaaaataaatgttcttacctaagtttatgctagattatagcataaagatttagaagcattaaatggatgaaatagaatttgacacgtaggctatttctgagaaatctattttattaagtatactttctcttgtgcctgaaaaaatttatcaaattgtccaaatcaggttctagcaaagcaggtagaagagtttttaaaaagacaatgttcttagaagaattatatttctattgtagaaagatttaaaaaagaaaaagttacataaataacacctataatcctatttttcattttgttggctatatttagtgtcttctaccatacacaaatttttcttacacaaatatacaaaattaggtccatttgacatactgtacagtggtatgtatctctacatatatgccatttggtgaaaaaaatatctaaactgccttttaaacttaaactgtcattaatattttaatgcaccatcataaactcttttatgacagtattttaaatgaccgtgtagcattctatagtatggctgtgccataatttattaaaccaaacccttacacttggacatttaggttatttccagtttcttacaatgctgtggtaaacatcctttaaagcacagatttgacctcaggttatatgcctgtaagtgtagtttctggatcacgcttctttaaaaattagcatatgtaatatgttaaccatgacatcattctttttaaaaattttttaaatttttttatttcagtaggtttttggggaacaaatggtatttggtcacatgaataagttctttagtggtgatttctgagattttggtgtacccatcacctgagcagtgcacacttcacccagtgagtactcttttatccctcaccatccccactccttcccccgagtccccaaagtccattatatcattcttatgtctttgcattcacatagcgtaactcccacatatgagtgagaacataggatgtttggttttccattcctgcattacttcacgtagaataatagtctccagttccatccaggttgctacaaatgccattatttagttcattttcatggctgagtagtatttcatgacgtatatatcacattttctttattcactcattgatagatgagcatttgggctcgttccatatttttgccattgcaaattgtgctgctacaaacatgcgtgtgcaagtatctttttcctataatgacttctttttctctgggtagatacctacccagagattgccagatcaaatggtagatctacttttcgttctttaaggcacctgaacactgtttttcatagtgattgtactagtttacattcccaccgacagtgtaaaagtgttcccttttcaccacatccccgccaatatctgtttttatttttttattatggccattcttgcaggagtgagatggtatcgcattgtggttttgctttgcacttccctggtaattagtgatgttgagcatttttccatatgcttgttggccatttgtatatcttcttttgagaattcatgtccttagcccactttttgatgggattgtttgttttcttcttgctgagttgtttgaattctttatagattctgcaaattagtcctttgttggatgtatagattgtgaaaattttctcccactctgtgggttatctgtttactctgctgattatttcttttgctgtgcagaagctttttagtttaattaagtcccatctatttatctttgtttttgctgcatttgcttttgggttcttgatcatgacgtctttacctaagccaatatctagaagggtttttccaatgttatcttctagaatttttatggtttcacgtcttatatttgtctttgatccatcttgagttgatttttgtataaggtgagagatgaggatccagtttcgtttttctacatgtggcttgccaattatcccagcaccatttgttgaatagggtgtccttttcccactttttgtttttgtttgctttgtcgaagatcagttggctgtaagtatttggctttatttctgggttctctattttgttccattggtctagtgcctatttttataccagtaccatgctgtttttgtgactatggccttgtagtatagtttgaagtcaggtaatgtgattcctccagatttgtgattctttttgcttagttttgctttggctatgtgggctcttttttggttccatatgaatttttggattttttttctgattctgtgaagaacgatggtggtattttgatgggaattgcattgaatttatagattgcttttggcagtatggtcattttcataatattgattctacctatccatgagaatgggatgtgtttccatttgtttgcatcatctatgatttctttcagcagtgttttgtagttttccttatagggatctttcatgtccttggttaggtatattcctaagcattttattttgtttgcagctattgtgaaaggggttgagttctcgatttgattctcagcttgattgctgttggtgtatagcagaactactgatctgtgtacattaattttgtatcttgaaactttgctgaattcatttactagttctaggagctttttggatgagtctttagggttttctaggtatacaatcatatcatcagcaaacagtgacagtttgacttcctctttactgattttgatgccctgatgtctttctcttgtttgattgctccagctgggacttccagtactatgttgaatagaagtggtgaaagtgggtatcctcgtcatgttccagttctcaaggggaatgcttcagcttttctccattcagtataatgttggctgtggcttctatgccaattttgctgagggttttaatcataaagggatgctggattttgtcaaatgctgtttctgcatctattgagatgatcatgtgatttttgtttttaattctgcttatgtggtatatcacatttatggacttacatatgttaaatcatccctgcatccctgatatgaaacccgcttgattatggtagattatctttttgatatgctgttggatttggttcgctagtattttgttgaggatttttgcgtctatgttcatcagggatattggtctgtagttttctttttttgttatgcctttccctggttttagtattagggtgatactggcttcatagaatgattagggaggattccctctttctctatcttttggaatagtgtcaataggattggtaccaattctttgaatgcctgatagaattcagctgtgaacctgtctcgtcctggactttttttttgttggcaatttttaaaattaccatttcaatctcgctgcttgttattggtctgttcagagattctgtgtcttcctggtttaatctaggagggttgtatgtttccaggaatttatctgtctcctctaggttttctagtttaagcctgtaaaggtgttcataaccttgaatagtcttttattatttctgtggtatcagttgtattatctcctgtttcatttctaattgagcttatttggatcctctctcttcttggttaatctcgctaatggtctatcaattttatttatcttttcaaagaaccagctttttgtttcatttatcttttgtattttttttttgttgttgttttaattttatttagttctgctctgatatttgttatttctttttttctgctgggtttgggtttggattgttcttgtttctccagttccatgaggtgtgcccttagattgtccatttgtgctctttcagactttttgatgtaggcatttaatgctaaccatgacatccttctgaaagattgggccaatgagtgctcctgtgaacatttaagtattttttttgtacactcttttctacaatggatattgttaaaaacaaacaaaagaaacccttgttgattgaagaggctgtcattattttcagatacatttctttggtgatactttttcatatatttatggtctagtagtttttattttttcttctgtctccttttccatgagaacatttgttttttcttattaatttattagcactctttgtcatatatatggatttccccccattttgtatatttgatgtttggaagtttacatttttatgcagtctattgacaggaaaaggatttttaagagcaaatgatgtttctattagaagtgtattttcttcccttggatggtattgttaagtttaacagaaggaaggaagaggaactgctcaattttagtttaatcctctcagaagagttttaagttattaaaatgtatacaacgtatatattaagaattataacattttcgtacttgcattgtctgtttaaacagtatatcaaagagctcaaattagcacccttatcttagaaagttttacatttggattttggtctattttatttcaacttaagacacattagaggtgggacaagagttacaatggataaacgattcattgtgggtgaaattttctgaagatggagtaatttacacgctcatctatcaggaatgactggagatgaggatggaaacagtgactgccatgggttattcaaagatgatagttctctgattcacagacacctactgggtcaaaaagcctcatgtttttactcccatgagtctaaattttatggccatgtgtggtatagatattttggttggattttccatgttgattttttttggaccattctgcctcaagtttatgttagcaatataagtagcaagactcaactatgagcaaaattatgtaataagcctattgatattaacatccactagagccagtgattctctgtgtgggaagcacgtatgtcttttggggagggaaaaaggtggcttgtgttattcactcattcattcattcactaatttttattttgtgcctattcggaacatgtttttcaaaagaacatatactgtgttagaggttgagagtccagctgtatacaagacacagtcccttccctagtttgaaagcaaagtccattgccctgatttatcttgcatgatttgttaatcatgatatctttactttaattttcatataaggcaggagttccctctgatcgactgcctcaatgtctgcatggtttacttcacatccttcaggtctctgcttatatgtctccttctcagaaaagccttcccaaccatctctctaaacctcttgccctgaattattttattcatgctgtttattaccacatggcatattacattacatatctgtttatcatccaaaccgtatgctagaacgtaaggtccatgagatgagggtgctgtcgattttgttgactgctttttctctagcataaaaaaatagtttgtgggatatagcaggcacacaataaatatttgttgaatgagttaattcactgaatatttgcatgcttgtgatgtgtctggcactgtcaatggtgaaaagtgctataagaaaaataaagcaggggaaaggacagaaagttctcatggttcacgcctgtaaccccagcattttgggaggccaacataggaggattgcttgagcccaggagttcaagaccagcctgggcaaaatcgtgagacttcatctctacggaaaacaaaacaaaatttgctgggcatggtggtgtgtgcctgtagccgcagctacttgagaggctgaggtgggaggatcgcctgagcccaggaggtcgaggctgcagtgagccaagattgtgccactgaactccagcctgagtgacagagtgaggccctgtctcaaaaaataaatggaatatttaagaagagcctaggttataaaaggtgggaagatgctgtgtaggcagctttatcttcccttttctctttcctgagtgtctttgaatccctccctctcctctcctctcttctcctctcctagctggtggtagtctctctgtcagctgtgctgagtccttctagggagtgacattgcattcttttcatgaccttcccatgagtggcataaaaacccagatgtgctccacacatgagctgtgtattccccagactaccaggtagcatgctttccagcacctagcttttttcagaagtagccaaaggccaccttagggtttgagaaatagtcaaatgttagtaaatgttcaagggtgcttttattatagttttctttttctgctttaataatcacataatactgaagcttagttttctgagagctgcatcatagaggaatttaaaagtttttaaaatcagagtttcttatctcagacttttcccctcaattgctgaagcagcttgtcactcaagccttccaagatcttggtcatcgtctctcagaggtagcatgcaaagaggatgaatgaggggctatttttctggctgtcaccgtgattggcttttagcacagaatgataggggtacgtcgtgcgatacatgagatagttgtccacaagagaagctgtcctgcccagaatgatggtggtgcccctagtgagaaatgctgactctagctctatccctggggttctcagcaagggtattcctagcctctaggggtactttagaaatttgtggatgtattcgtggttttcacagtattagggggtggtttgccattggcatttagtgggtggtgccaagggtgctagaaatcaggcaatgtacagggcaattgctccacatcccatttgactttcaaatgcctgccaggcaacagagaaataaaaaatttattggtagtcatcagagcctaaatgatctctataagcaaaaggtattttttgcacaatttaaatggagggaatcctgtattttgtttttttttttttgttttgttttttttgagactttaccaggagttgtttcccatgttggcatcattacttgtggttttgaaattggcgtatcagtcagcatgtgtagctgccccattcatggtgattgtagcctaggggcaagaagctgactacctcattgtgttttctacagctcctgtgcctggacatttacatagtgtagtgtatattgtatcattataagttctttcccttttatttctcctttatattgcaactaggtcatagcattgatttattaaaattatatgcagattaggttatattgtctgtgatttctcatttcaggattgcagagggggcctggagtctgatggggttgaaagccttctctctaacctagttttgcagccatatgtctcaccactcttctccatgagccctgtttcagtcaaagtgacttgctttgtgtgcctttttcccttttcctccatgtgtgcgtgccttaagcttaaactgcccttcctcctcaaagctcccccctcttccccctccccatgtgcatcccacccatccgtcagagccctgttccctggcagctgagcgaggtcatcgtttattcttccttgaccaccatagctctgtgactttctatttttttgaactaccctagcaattgtaagaactccttcaacacttatctacattctggtagcattgagtaccttatgtttaagttgtctcctcaaatggtttgtaagctcctttcctgtggtaaacttgtcttagtcttcttttcatcccatgcagtgtctacaaacactttgcatctggcaagctcacacacatgctacactttcttctcctctttccttccccaaatatgtatcctttcctgtctatcattttgcttattaccgaagtgaaacatttgcattgttaacacattttttttctttttttgttttttgataccaagtctcgctctgtcgcccaggctggagtgcagtggtgcgatctcggctcactgcaagctctgcctcccgggttcacgccattctcctgcctcagcctcccaagtagctgggactacaggtggccgctaccacgcctggctaattttttgtatttttagtagagatggggtttcaccatgttagccaggatggtctcgatctcctgacctcgtgatccccctgtcttggcctcccaaagtgctgggattacaggcgtgagccaccgcacccggccattgttaacacatttttaaatacagagaagtaaaagaagaaaatcatcatcattgatcctgccacccagagccacgcattgcctcttattttagaacatttccttctaggccgtcatctttatgtttatgcgtgtttttaacaatgtaggaatcaagtactttatacagtttgtattttgcttttccttcacatttcatttaatgttatattatgagcattttccaatgtcactaaatagtcttagaaaacatgttttatggaaaattttagacatagaaaaaatagaatgatataataaacccctaaatacccaacattcagcttcagtaattatcagcattctgccattctgaatgtgctatttgtaatggatgcatgccattcattgtttggataatatatatgttatttaaccatttctctgttactgaaaatttagatgatttctagttttctataattatagatgcttatgtttttgttcttctggtcacaattactattcttccttcctggagaacctaattaatttcttcatcattaagtaattcttgattactattagtttcgtattctggggtttttattgtatttcatatctgtggctggtttatttgtcattttcttttctccatccatcaactatttcttgtgttagccagaatgggtctcagtgaattacaacaacaggtttttctattcattttttagataaaactgaaaactggcaatgtaagaagatgatatttactttctaggtgatttaggggcaaatacaagaaggaaagaggagatgatttcaggagaaatgaaatcctgtaaattatcatctttaccctatggaaaatgattttacaaatgcttagtttcgcttaattttgattgaaaaatggcccccctctaaaggctggaatagtcactaagctaaaagtgcacttgaaaccaatatgtatgagtgttttcctcaagctgatttaaatgtatattttgataagtatatttggtattaaaaacacccagcagctcctcttttaaggaggtgcattctcaggcagtggggagagatggtcttcttaggtctggccaggagagaggcatgggaggatgagccaagtgggggagaatcagagcggtggtattactggtgccttgtgaaaaggaaggaaggagtgctgttgtcctagttctgatgggatttcttctgtagtatttgttgaaattttcagaccagatcatatacaggaagatgactcatgtgcctacctacctactctaagaaaatgtctttgtttcttctgttgcagaagtaaaacatgattgctattaaaaaaaaagtacattttcataaatttataatagaggtagataacatagaaagtaaaagtcttccataaccacagacctccccactaaatgaacactgttaacagctctgtttatgctcttcttggttttctttctgcctattaagtgtatattatctgcataaggtacagaacgaaaatgccactctttggctgagtgtgatagcttatgcctgtaattgcagcactttgggaggtcaaggtaggaggattgcttgagcccaggagatcaaggctgcagtgagccatgatcatgccactacactccagtctgggtgacagcatgagactgtctcaaaaaaaaaaagctacttttaaaattgcaagtgttaattagataatcagagcatgttcagacctttgaagtatacagaccacatgcagtttctcctggctagaagtaagatgataagtacaaacagcaggacagaacttgttggatatggaaattgtagtggaagggaaagcttaagaaaagggaggtgtaaaagcccaaatttttattagtattcagaggttaaatttttatcactgaatcagatttaattggtggttgtactttttcccttgggaacacattaaaacagtcactactacaagatgactaaatcatgaatgaatttaaaatattaaactagtctcagacatactaacatatcagcaacttattggtgcataatttttgcattggaatttaagtgacggaaatatgcatggctgacattaacacttttttcttttgattttggagccacttcaaataatacatcttacaaggtctatttccagtttagggccaaccatgaatgattaattatattgctaccctaacaggactttaaataatgaagacaatgacatttttgcaatgtgaaatcccattttattcattcattgaaaaaatacctactctgtgccatgaatattaagagtacaaacttataaaacttgcccctgtcgttctttggtgtgtcgcaaatgcttttccattcatctggaataccttcctctcttccatctgacgacatctctctcagctttcatttcccaacacaaaggtcacttctcaggtatagccattttagttcactctacagactgtcttagcaaatctcagtgattttcttctcacatttgagcacatcttcactagagttttatcttactatcttataagtatacaatcacatacatgttgaattccttgaggtcagagtcctcttatcttcatagcggcagagtcaaaatgggtacagggctggtgccatatatatatatgtatacatgtgtttatttatatatatattattataatatataaaaaatatatactgtatgtatatatatgttgaataaatgattaaacgaactaaaaaaatctagtaaggcagactaatgtccttacactcctaactacaatacaaggaaccaaggaacagccttcggaggggaggaggttcactctagtgtccctcttaatgcagatttttagtttacgatacttagatatttagatacttggattaagcagggtactaaaagtgttgaatggggttaactgagaggaaaagcttcaatataacatatttaagtgacagttctcattcaaaaattgtgaaaaattattaacattcttatgtgggcattttaggaaagtgtaagaaaaagatctttgtcccatggagcatacatgatttccaaattgtatttttaatgggatgatactagttttttgcttttcattttaactgttccagagtgggactgatagtctaaggatcttagtaattcagaactgtgatttggaaattagagttcatgaaagattcaagaaatagtatcttttcaacctagaaaaaatagaattgaagtggcctcactagtggatctcttcctctgtggaattagactcccaggtctggtagagaaggatcttggtcttgtcaatttagtgtggtaactagataatggtatgtggcgtgggaagagtacccgtcaggtcctggcaggaaagaggtggtattctcaaaggaggtaattgaggagacctaaataatggagctactaacaaagatgtaggcaggattcagggaaatcaacacgagttggcaaagcataccagaaataacaacagaagaacgccatcaccactcctagtcctaaagaaacaaggaaaggggccgggcgcagtggctcatgcctgtaatcccagcactttgagaggccgaggcaggtggatcacctgaggtcaggagttcgagaccagcctgcccaacatggtgaaaccctgtctctactaaaaatacaaaaattagccaggcatggtggtgcgtgcctgtaatcccagctactcgggaagctgaggcaggggaatcgcttgaacctgggaggcacaggttacagtgagccgagatcatgccactgcactctagcctgggtgatatagtgagactgcgtctcaaaaaaaagaaaacaaggaaagaactataggaagggccttctctcctaggagctgacgccttaggcagaagatcacagccactgacaaagcactctgccagggagggagccgacggggagatgccccagcctttctctcctcagggtcctgctggcaatcccattggaggacccaaatgaaccccagggaaccacgagatgtagtctgaaggggcagcctcccagggcacacatcagggtgagaagggtggagagtggttcttggtgggggagggggtaaatgcagaatatccagccgggagagaaaagcttcaggttctgaaaggtagccttctctgttcatagccttcctgaggattctgttgcttgtagccagacctctaaatcagatcttatgaaagggagccccatgcagaagtgttttgtttcatgcccattgcattttattgaaaaagaaaacaaacaaaacaccatatatctgtattagctttggggagtgacacctcaaaatctgagtttctttttttttttttttgaaaaatggaagatttggcagcaccaaatatgcattcctatgtgggtacaatctgcttagcgtgtaggagctgtcctgttaggtaggcatgcttcagtttgcctcaatccccacatctctctatctctctgttgtggtctttttctttttcttttcttttttctttttttttgagatggagttttgctcttattgcctaggctggagtgcaatggcatgatctcggctcaccacaacctctgcctcccgggttcaagtgattctcttgcctcagcctcctgagtagctgggattacaggcatgcgccaccacacttggctaattttgtattttttggtagagacagggtttctccatgttggtcaggctggtcttgaactcctgatctcaggtgatcgcccaccttggccttccaaagtgctgggattacagtgtgagccaccgcacccggcctttccttctatctttttttttttttttttttttttgagacagagtttcaccctgttgcccaggctggagtgcagtggcatgatcatggctcactgcagcctcgacctcccaggttcaagcgatcctcccatttcagcctccagagtagctgggactataggcatatgccaccatgcctggctaatttttgtatttttttaatagagacaggattttgccatattgcccaggtctcgaactcctgggctcaagcaaactgcccgcctcagtcttccaaaatgctgggattacaggcatgagccatcacactggccccctgttgtggtcttaagcacacattgcttctgcctggtcctgatagacatctgagtttataatccttggtctccataaagcagtttagagaaggaaggacagatgagtcatgctaatttagaaagagagtgagttctgtcttggaagatgcacttctctacaaagggaagaaagagacagggagactaatcttgttggggacacagtctgagcatttgttagactaactagaaggttttacatagataaataatgtgaaaactgagacacaaacacggttaacatggttctgattaaatatctagaaaatgacacagtcagcgttcaaacttaggcagtgtgtttgtgggtccttgcgtaacatagctgttatgttatactgtccaccaagctaatcccatattgccctggccttctaaatctttttcctctacaaatatatacatgtagttacatgcaaatacacaatgaggtaatactgtatgcatcctattttataattggctgcctttatcttaataataaaagcaagcatcacatttttaataactgtgtaatagctaatcctatgaacacatcatacttggtagatattattatgattaaagaatttagttttgtcccaacttttcactattataacatattgtaatgcacttcttttgtacacatattttaaaacactcattggactcttccttaggaaaaagtagatttgctgtgtcaaaagttactattcctctctctcaccccttttaaaaattgctgtatttttctggttttaaaggaaacataagctcacagcaaaaaacaaaagtcagaaaataaagacaaagaaaacaaaatagacaatctgttatttagtggtataaacaccactatcgggaacgtgtgttatttacatttctgttccctctcccctcccctcccctccccttccatccactctcttgtacagggtctcactctgtcgcccaggctggagtacagtggtgtgatttcagctcactgcagcctcagtctaccaggttcaagtgatcctcctacctcagcctcctaagtagctgggattacaggcatgtaccaccacacccaactaatttttgtatttttgtagagacatggtgtcaccatgttgcccaggctggtcttgaactcctgggctcaagcgatcctcccacctcggcctcccaaagtgctaggattacaggcatgagccagtgcacctggccctgtccttatttctttagcaaaaatttcccaagagaagaattgctgggataatgcacatttaaatttttgatagacattcccaaatattatacctgtttttgagacctttaattcctgttgtcaaattgccctatatatggagtaataaacacgatttaaagaaatgaggactaaaaaaagattatatataacccaacataaaggcaacctcttaggcgttgacagaaactgacaactttttatctgtgggtgcgatccattataagtaacctgagcaccttattttttctttttaaactctaggtaggatacccgaggtccacaaatttttcataagaaatattttttctctgccctatgagattttaaaaaatattatactgcttcaattgcatcaaaagaaatggaccctaatatctatgatgaaggatttggagttagaagacctgagtttcaattttggcatggctgtttgtctagctctgtgatcttggacaggtcaattgacttgtcttaatcttctcatccatttagtggagacagcaccactattcacaggactattgtcagaattacgagacaatagcataggtgaaaatataaagtactttgtaaactaaaatgttacacggataagctgatatcattggtagcaagagcaacactattccgaagtttttgtggtgtagttccctctgattattcttcatattacaggtcaatcaattgggtagacatcctcttaaacctctgttcctcttttcttcttaaaacactgagatctcttcatctgaaataaaaatttcgagagagtttatagatttgtagtcttggatcctggagagaagagacatgtattcctgtatacacccagatcattaatcctacttttaattctactccaaaccttgtaccacatcatttcctactgccaggctggagtgagtaatgacaaccttttggcagatcaaatttcagttttagaattcaggaagcaaagctgtgtcctggcctttctttcttctttttaaattatagctaaatgtccttttctgtttgggggcaagttacatgcctggttctgccagagcaaacgaaaaccaggcaccttctcctgagcatgtcactgtcataaacccaggcagtctggtgaggcagctgcttaagaaataatattccaccattaactgccccacccctgaaattagcatctttggaaggcattatccaaggttttgttgttgttactgtttttgtttttctatttattcctaaaacaaatcttcattaagttcatccagtgcttccattgacccagctgcttggaattcagtgaactgtcaacagaatataatttctttcagaatttgttattctactggaactacactgcagtgtctttgtgattgagttagccaccagataacctttgccctcaattttctagactaaaattgttttctttgttgtccagaactttgagttgccatctcccaagtaactgtttaggatggaaaacatattgagagcttgctattgaaaaataatatgagtcttgttggtaggatccattgttgaaggtgaaagcccctttactaggaggctggatcctttgattttctgacagaacattggccaacagtactgacacagtacattgaaatgttcaccaacaaccttaatcctttcttggggaagataatctgcagggcgggttagtcatgaattactccaggttctccaagagctagcattttatcgtattagcaccagcaaacagcatgcttagactacatcagctcagctatgcatagctatgcctttagtgagctgcatttcagtatctgggttttggcttctaccaacaattagagggagaaatggccatctggcttcagctgaaattgccattccttgtttcttagagtatttcatggaggggactatgccataaattcctcttcgagctcagcagtagaaaatggatggtccctcctgacgaatccatctgcttccacatttcaatttcatttatgaaattgagaattcataacctatcctgtttcctttttagctttggtttcctaaagcttgaagccaaaattagtgcttcattacaataactctcatctctgtttcctggtagttgcctcccctttcttccatgtggattagctctttttttctttatttcaactatcctgctcttgtgattattttgagccattttaaatccattatggaagtaggtagagtccagattataaataaaatggtatcacttatattattgtcacagtcacattattggttcatctttggtgttagtctcctgcttccttctgaacttctcctttgtcctttttgattcattcatattgggtggggatgaaaaacaagaatgagtctcaacagaaacccagcgacattttaaagcctaaagttttgatgcctattgtacaaatatttttatcttcatgtaaatcaaagggccatcacctggcttaggaatggcaggattagagtaattagtggaatttgttgcggttaaacagtggactccatagccagggcctcccgtggaggctccaatgttggaatttataaagtgtgttttatttgaatcttgtgtctgtgtgtaaagaattgctgttttaggcagaaaccaaggctgatgacttggagagaatactctaacccctcagacactcttacatcactatcctaagaactaataatgggtattagagttgtaaaactacagtctggctagactgacttaaagactttggggtgagttgatggtgctaagtccttagagaaagaagaaaactccgaaggcatctggcaaccatgttggagagaaaattgagggaagcaatgtagaaacaaaggagaaagcaggacagaaacagcagggtcctgggatccgcctggtaccagagacttctttttttctctcacttgggctagacccagagacaggcttctggtttagaagaggaatgtgggactggctggccatggattagataactgtggaatcaatgcccttttacttgggacatctttccaagtctggattatttccttaggattaactgggaaatcactgtacaaagaagaagcatatcaatagactgcttccttattttcaacccagaataatgcatttttccattgctagaggactgctttaaaatacacacacacacacacacacacacacacacacacacacacacacacacacacgaaacaccaggatagcacagacagtggctttcagggatgaagatacttcctttcctgtctgttctagtctcttctggttgcgtggaacagaaactagtacaagctagcttaaggagatgaagctttattgcaagaatataaaatgttcttgtgggaatgacatgagtagccccatggacagaaaccttctcagccctgttggggctagaattgggaagctttggagacttaagacattcaccttcgggacatcacacaccggggcctgttgtggggtggggggagtggggagggatagcattaggagatatacctaatgtaaatgatgagttaatgggtgcagcacaccaacacggcacatgtatacatatgtaacaaacctgcacgttgtgcacatgtaccctagaacttaaagtataattaaaaaaaaaaaagacattcgccttcttacattctctctcagttcatgcctgtcaggctaaatgtctggatccttgttacttcaagtgcacactggggaccagtatcaaggacatcacctgagatcttcttggaaatgcagcttctcaggtcacactgcagacctactgaatcccagcctaccttttaacagaaccccctggtgatttgtttgcacattagagtttgaggaacactggtgtaggtttctggttactcatagagttgttccccttactcaggtgcccaccccagtggtggatgggggagcgaggcggaccatgtgacttggcatgaacacactggggccacaagatgcacatctgatacataatctaagactgttgggttttcctttagctcatagcatttccatcaagggtattggtagtctccagttgctgagacaaagtgaatagagaatctcatgatttatttaaaaacaaaactattttaatatgtccccattttatttatatcttactttttattagcccaaagataattaaacccgaaaatactgtagactctgtataatttaggcagttttatgaatatggattttaactctgacctaaatgagctgtctagtgactcaacaatagctacctcttgcttcaagatagtaggaactgatcagcttataaagctgatgctgcccagttctgttctgagtccagtgtgcatagctctggctcccaccatgcccgttagcctgtgaaattgatttttttaaatggttgtacaggcatttggcctatagccaaagaaatgattgagcaagtgagtcctgtttctgtattgctctatgaataagtagttagaccattcaagactgctgtacatgagtcattcattcccagggacacttatagttcttttacatttggtgcattcagcatcctagaaggccttttctttaaaaaaaaaaaaaagaacttttgtatttccattattttatttgtttgtttgtttgtttatttgtttatttgtttatttatttattttgagatggagtcctcgctctgtctccaggctggagtgcagtggcacgatcttggctgactgcaacctctgcctcccgggttcaagcgattttcctgcctcagcctcccgagtagctgggactacaggtgtgtgccaccatgcccggctaatttttgtatttttagtagagacggggtttctccacgttggccaggatggtcttgagctcttgacctcatgatccacccacctcggcctcccaaagtgctgggattacaggcgtgagccaccatgcttggccccattattttattgtatccttaattcccttagctcacccttgctgagcatagttgtctgtggtagaattagccattggctccttgcttgctcttccagtttgtggtgtttcaaggtgctggaatccaccaccaagaatggtggcttcccacaatgccttttaacaagaatgtgtctcttcaatgcacgttgtaactttctctttgaatttattgaagaaccacaaattaagtctgtgtctttattgaagcaattcaggtgatgggaagaggctcttgaatcaagaaagaaaggaagaaccaggagtggtgatattaggtaaggggagatttaggatcactcttccgcaatacaaaatgaacttcctgtgctaagaaaacttacagccctgaataaggagttgatggcatgtctatgcaacgtacaattttattcctgggacgtcgttggaaaaccattatattagatgatcttcaatcttttgtagttctgaaaatttatgaacgcttatacatgttgcttataaatcctaaatgaaaaaagggctccctgtcttaaatttatgttctatctaatatgcacttttaaagtttgagtttttattgcacttctgatctttttaaaattataaaacctatcatacatacaaaagagtatataacacttattaatatgtatagttaaagattaataagatgaatgcccctgtgcctaccacccagcctaaaaaacagaacattaccagtgtctttgaagctgtctctgttaatgtgcatttctagactgctttaacttattggatttgtgcattgcagtgttttatttgtgagcagttatatcagtgaataccaagtgagagtggctcagccatttttaccttatgctcaaactcctttcagatttccaatctgtctgatattggatttaagaacagttaaatcttactgcttggaaactgatctttaacaagctagttttcctgctttaaaataatagtgttgttcgtgatgttaatttccctgtttcacttgacaattacagcgggggtagcttccctgagcacaggatgaggatcagtcagcttgagtatctggtacagaaggcaagctccctgtgcaccaaaaatctactcaggccctggagaaagcaaaaaaaaaacccagcagagcataattaatggaaactatctttaagtcatcaacattaaatgtgattgaggtagcagtatttcctgggtgcatgattggggcattgaagtactacactttgatttctgatgtgaattatttgttgccatctgaagttccaaagagccaagattggatgtacatatttttaaaaatatgtgctttggtgaaaagcaaagttttggaagggtagaaaactttcagtagccaccaaattgtgttattttaaaatgagcagggaaacctcacagggatgagaatacctaaactgacaattctcaggaggccctgtcaaaatgcccatcctgctaaaggtttgagttcatggccaaaggcattgtttttttataaatataattttaatggctataataatttctgtattgctccattgtttggtatgtaactattgtaattaatgttgtcataaacatatttgtgtgtaaaactgtattttcttaaaacattggggcattaaacatgcctatatatatatatatgtatatatataaacatgcccatatatatgtatgacttaaaaaattattttacggaatgatcactttccattacagacattttgaggaactcatatatttacaacatgcttgctaaatagtcaacatttatccttattcctctgactgccctggtagagacagactggagcctaacttagaataaaacaataatcaacctatttcaacaggtgtttattaggtgcccatttttaccttcaggttgttctaagtactaggaaagtgaggaagttgcaaaaagaagcttaatgtgcagccccgccttttagaaaatatgaagcatgtcatttctgttacaaggaaaagagctcattcctctatgtcttacttctgggctgtgtgtgtgtgtgtgtgtgtgtgtgtgtgcgtgcacgtgcacgtgcacgtgtgcgctcatttctgcaatgctacttccttgccatgggcctgcctcatctggtttccaataagaagagttccagattggggagcaccctgccatcctgattggccatcacagattcgtatggcattgatgtttacaagctgtttgcaaagtgttgcttggtgctgcctaatctgtggcatgtgcctgcttccgacacgtcctttgtgggaggcagagctgagattgggtggcggggggaggagtttgcccctgcactgtcaggctgcacttgaggctgcaggccacttgtctgaggcaggcacagtaacctcgggaagatgaagggcacaggggccctgtttggtctccatgttctagaaatcatcaccaggtctcaccatgttcattcagcacctttctttggggttttctaggaaataactctatatactgtccatttcaaagatttagttttcaaagtccaatgagatttagtgactcagagaattcttaatttagcaagctacatggtatgtggcagttaaaagtattttatacccccctcctttagtttggtggctgaaaagaatctacagattgcctgtcttattcactgtggaaattttgtggtcaacacatattcacttatttgccaacatggtcttcagtgctccctttggagggaagatcttcactgggctgtgtcctggctcttggttggtgaggaggtggagtttggagagcagggtgcagcctgccagtggagattctcagggagtggactcaccagagctgggattaccactggactcggaacatgaggccttggccgaacgtggcataaaggagagacaggagttcagtgctttcaaggttatcaggttggaaagcagtggcagggagggaaatagggaatacagctgaggtcagagaatggagcagaagagcatgggctgtgtcattcccatggagggagggcgttcctgatgcgttgctggggagagatgggaacgtagccctctgaggaatgaagttcctcatgtgagatcgtggcaggtagatttggttttcattttaaaatgggaattaaggctgtgaggagacaggaatgtattggaaaatgcctctagtcaggagatagtaagaagtatacaggatggaaagggagtcaaaaattaggaaaagtggcactttgagaggctgaagaaggtggatcacttgaggtcaggagttcaaggtctcatttttttttttttttttagacggagtcttgctctgtcgcccaggctggagtgcagtggcacgatctctgctcactgcaagctccgcctcctgggttcatgccattctcctgcctcagcctcctgagtagttgggactacaggcgcccgccaccatgcccggctaatttttctatttttagtagagacagggtttcaccgtgttagccaggatggtctcgatctcctgaccttgtgatccgcccgcctcggcctcccaaagtgctgggattacaggcgtgagccaccgcgcccggcctcaaggtcttattttaatggctataataatttctgtattgcttcattgtttggtatttgactattatatatgggcaacatggtgaaaccccatctctactaaaaatagaaaaattagccaggcatggtggtgcaaacctctaatccccgctactcgggaggctgaggcaggagaatcacttgaacccgggaggcagaggttgcaatgagcccaggtcacaccagtacactccagcttgggtgacagagcaagactccgtctcaaaaaaaaaaaaaaaaaaaaattggaaaagtaacatgccatgccaggaaaggaggaccctcagccactagtgtcgagaggacagaagcgaagagagcaaaccatttggactaagaaggcctgaatttgagtcctgggctttgccacctactttatggccttagctgagttactgaagctttttggacttgaatttcctaccttcatgttggggatgatcataatattttccatacctggcccagttgtaagtggatcagggagatggtgtactggaaagcacttggtgctctgtggtgtcctgtacaaaacatagaaaatctgcctccagtctctgtctcagtccaggtcctcacctgtcataataacaattactttttgttatatactgcctaattggaaagattcctgttgcatatatgttcttaatcgtatgctctcacatatgtattgaaaggaaatggggcataaataacagaaaatagcttgcctctgtatcgccccgggaaatattggaaaatgccatgctaagcccaataacagcagggagtatgccacttttgtctaatactggacatgctgtgctggcacatagtaggttattgagtttgatatttcggtgaatgaaggtcttgccaaattctttgagcaatggattttgcatttacactagctggagaaagggagttacattcagagcagcccaactgtgtatttttagtggaagaagaaggctctttcttaggtaagaatataaaaagaatcgtagatatagaggtggaagggacaaaagaagaagcaatagcatggtctccatactaatcccactttaaaggtgagggcgtggagaaaccatagctggacagttagcaacggaagacagctatgagtccagaccttttgagatgatgttaaagtcacttaacaagaataagtaaaaggcgcttttcacatgtcagaatgttttttcttgaaaattaatgaaggcaaatgttcattttattcctggtaactaacagcctctcagagatgtgtatgtcctaatctccagaacctgtgaaaatgttatgttacatggagtagggggatttaggttgcagatgaaattcgttcttggttgagtttaaaataggaagattatcccagattattgtagtgggctcaatgtaatcacagcgcctttataagtggaagttggaggaggaagagtcaatgagagagacgtgatgtgagaaatactcagccagccactgctgacttcaaagatggagaaaggggctatgagccaaggaatgcaggcagcctgaagaggttggaagaggcaaggaaagagattctcccctagagcctcccgaagatgtgaagccctgctgacactttgatcttagtccagtgagacccatttcagacttctgaccttcagaactgtaagataataaaagtgtgttattttaagccactaaatttgtggtaatctgttacagcagccaattggaaaagaatacaattccagcatagcctgctcctgatggtcaccttgtgaagaataatgtactgtttggcattcagatgctttaatggagggctaatttatgacgtctggaaaggaaggtaaatttaacaagacaagtttgaaagaaatagctgtaattgacgagtgcatcattacaggttcctcttggccacgctgcccttttttctctgccacacaatttctctgagtggacccttcttgactgtcgaaaaaagtaattaagtcctttatgagtcagactgacagcaaaagttagcaatcttgttacagtattaaaacttgcttacaggaccaaagactttatttggtctttgaaataaaagtaaaatcaccatctctttgtgggtttcttttcacaatgaggcattgatttgcttttggagagatgggagcccattatgattttactttttttgttggcgctgctgatattaaatcagcgtacctcaggtgatgaggttatatatgccgtgtttttaactttcatctgcttagtgaattccttttgtcttttgatctctctcagcaacctagtttttgtttttaattttagatatgaccctgcttttccagaactagatcactttcattctgttttgaatacttaataaaagttcccaaaatgaacacgagttttcgtagccttttgttttccaaacaagcgagggctcatttcttccaattagaatgaaactaaaatgcgaccaagtcagcattttcattggaaatgtcaagaatgtatttctacaaaaatataaactgaactttaccatgtaaagaaggaacaaagtcatctgtcgaaaagcaactccaggccccggagctcacagagtgcccattatagtcgtcccagaaaagcgttttctttaccagagaccttaccagctagctcagcctggcaccgcaatgggctgacaccagctcttactattctctttgctcggggtctgaaaagtattttttggcacatatctctgatctttggttctctgcctctacaactgggggttgcttatgactaaatgttttctgtgataaagttaatttctgaagcttttaattttttatgagccaagtcacctgtaacactaactcactgttgataaagtctcgctactataaagtccgtgctgagttttttaaaaagtcagacagttcagttctcctgtgaaatagcagatagtcaatgatataatcatttgaatctgacacattcttacaatagctcagctccagtgcattttttaggggtgagtgtggaaaaaataagctatgaaaagcactcatagccagatggaaaaagagaaggttttggttttctctctctcaacagccaatatgcccaaatctgtagaattaaaataaaaagctgttaggacccatgataggcttacatttttttctgaggtttcacctaatgatgatagtgatcaaaatcctgcatgatcatcattagagtttatagcatgtttaatttgtgcattaaaaatcacattaattgtgattactcaaggctatatataataatgacacagaaatattgtactttagtttataaaaggaagcctttgaatcttggctgggcttatgtgtcctaaagagaaaaaaaaacctaaaaaattcaaagattagttaatgaagaagaattaatgttaataatgtcatagctctctccccttttaatccataaagccctgtttattaatagcaacagcaataacaagaatgagcatattccctctttcccccaccagtggccttcacagcttgacagagcgcttcattctgctgaatgagcaacactcaggacaccagtggccttccgagtgggcagaaattccttgggcagctccagatcccagcaaaccacttaatcagcctttacataaaaatcgtagcctagagaaggcatttgaggaaactcttccttatgctagccttttcccctccattgtggcctctggaatcagtaaggttaaaaagagaacctgacatactagactgtttctatcaaacactgagtttgacagaaaataagccagttggggccaggcgcagtggctcatgcctgtaatcccagcactttgggaggccgaggtgggcagatgacttgaggtcaagagttcgagaccagcctggataacatggtgaaaccccatctctactaaaaatacaaaaataagctgggcttggtggcaaatgcctgtaatcccagctactcaggaggctgaggcatgagaatcacttgaacccgggaggtggaggttgcagtcagatgagattgcgccactgcatttcagcctgggtgacagagtgagactctgtctaaaaaaaaaaaaaaagaaaaaagaaaagaagccagtaataactgttgtcattgctaatgattaccagagatagatctactcaaactgcagatagaaatcctctgatcatgccgtcaccctgattgacaccagagccgcacagttatttactgaagggagccagatgggcagtgatgggggccttgcaccactggaatggagcttctgtttgtttctgaattgcatttatttactgcagtggatttgagttgctactttaaaagctggttgttgatgtttggaaaataacaactaaaaatttacatggagaaaaagttttttttcaaagaaaagcctttccattttggtttaagttgtatatagttagccagtttcttctacttttttgctttccttcagtctgtcccttaatgttcttatttttatgataagataccatcatttttatattcacttgaatatgatagactaatctacatatgtctccaagtcttctttgagtcattagaagctctttcctgcttgatagagtttgggctattattaatttgatttcttattttaaaatctcatctttttttgaatgtgaatgtcttcatttcccctaatgcctgttcagtcaactctaatttctgtttcttgaatctagggtcatcttcattagtttaattactgtagaagcctgtttcctaaatgtgctaatagcatgaaaatgacttatttccatgttctctgttgtgctatgctaagaaacaggcaaaaagaaaaatttgtacaagaagactgaaaaacatctgtttttttcaaatgacccattcaaagcagttgcacccaccctcatccatctgcgtgctaggatttgggtataaggggctaaaattggcatagaagatggggtgggaagactacccgaggcagtcagtagcagaaagagctgcattcctcagagaaagtgaaagccggccgggcatggtggctcacgcctgtaatcccagcactttgggaggctgaggcagatggattacgaggtcaagagatcaagaccatcctggccaacatggtgaaaccctgtctctactaaaaatacaaaaattagctgggcatggtggcatgcacctgtagtcccagctactcgggaggctgaggcaggagaatggcttgaacctgggaggcggaggttgcagtgagttgagatcacgccactgcactccagcctggtgacagagcgagactccatcaagaaagaaaaagagagagagagaaaggaaggaaggaaggaaggaagagggaaagggaaaaggaaggaagagaaggaaggaaagggaaggaaaggaaagaaaagaaagtgaagccaaggagagcagagatgctcactgattctgacaacaatagaaatgcatgcaggatcagaaggcttggtgcaggggccgggtggagaccagagggaggtgggagcaggttagggtgaaatgaagcaggtagcaggtatcacctctactggtaagtaggttcattgtgtgtgatatgccaggctggtttaaagggctagggctggttatgaacagtcctgatgtaataaaaatatctttacaattcacccaagggttctcacctattgttgaaaaagttaccttctctgagatgtttgagccattatggtgcaacctctattccaaaactccagctaaggccatttctctgcactcctgacttatagtgtctgtcttccagttcccaggacgtgaagttagaagatgggatgaatgatatgtttgcatttgatctttcttctatcccttctttgcaagattatttcaccttgttccttaagtttcacatggtattgcttttactccatcgattacacatcataagacaatttgtatctttaaagtgaagttctcaaagtgtggtagggactcaaaggtccctaaggtcctttcagaggatctgcaaggtcaaacccgttttcacaataacgctaagacattgtttgctcttttttgctcgtgttacctcacgagtgtacagagtacaaattcacccgtaagattttagattccatgtcgcaagtaacctttaagaaacgaccagttgtcaagttttagtgtccgtcaaagaacatcaacaattgtctaagaaggctattgaaatactgcttccttttccatctacatttctgtgagcctggattttctttatatactttaaagagcatatcctaacagattgaatgcagaaggagatatgagaatctagctgactgcaattaacagatacatgaaagagttttgtaaaaatttaaaaactgtggctcttctcacaaagtttttttctggaaaagataatttttttcataaaacatgtaatttatgttaacatataatggggttattgttattttaaaataaattaatgaatacatattttttaagtttcttggttttgtaatatggttcatctcagttataatccacataaacaaaactctttggtgttatcagtaatttttaagagtgtaaatgggtctaaagactaaaaagtttgaggaccatggctttaaagtaagcatttgtttggatactggaaaaattctgtttgtttaatgacacgaatgcataccataaacttgggtattaataacaaaagggacttttaagagcacttatctgggcctcttctttcttctgtgccagtggtcggcacctttccctcctctttctataaacgtgagaaacatttaaatactatctattttgttttcataaagtgtttcaggttgcctataatagtttaataaaagcaagtggttttgcccttttttgcctcaggaatgcaaagccttacaacaaaaatttcattgattctcagttatttataaaataaaggccaaagtacccacttcctgagaggaagactggagaaacccactgttttctcccgatttagagagagacctgtgacatgggaagtggctctgtgattgtctaatgaagtcctcaagtcagaggggagaccaggatgggacctggttcttttgagttcagctcaatcatctcaaaatgtgccattcttactgcaccatctttctttggtagtatgcccagtgtgtgtttaattaagattaactaacaaaagggtggtcagatgccatgtatctagtgaagaggagatggctgagaagttgagtcctggcaccttctcttggcttctgacaagttcacctggaaccttggaaagttgcccagcctccctggcactcttggtcatctgtcaatgaagactgacccacctggagaggtgggatgcagctttataatttacatggcaatttttggctgctttacctcatttaattctcacacagcaaacctcttaaagtaagtagggcagatgtcattacttccattttgcagttgaggaaatacctgagattatgtgatcagtaagtgatgacacttaattctattccttttcctaacaatacaaaacctctgccaatgtttacatgaaccacgtctcttggtccatgaaaaatacatgttcagagcacaggagatgtatttgactcctcaagttgcaactctgaattatttcacacggaaatacctgtggtcctttagaattgatggcactgtaagtactatgtttcaggaacatcctgggctaagcagatgtttgtggattgacataggtccctgatcacctcttatagcatgatttcttaaaagggtgttccaggttccacacaacctatttataaatgaacttttagaacacaagtcattctgttgttgtgtttattctttttattttgttaaatgaaccgcatttactcaatgttctctattttaatgtttaccatttttatttagtgactttcttgaaatagatggtattactaatattttaagcattaaaatattacttaaagtgagagcacgggctctaaaaatataatatttaaaaatgctttactccattattttaatacgtatagggaccctcccctcccccccgatagaagacagatttaattataaaatagaagtgagtgggaaaaattctcttatcagaaatttcctatgtaaaaataaaagtttgctgtattccatcccctttcaggtaaaatttacttgtatttataagtagctatctaatatatggtgtatcccatgtgactctataaaatcacacactatttctagagaagataactgcaggcaaatagcttcctctatttaagtttcatctcaagaatggaaacataaaccttcccataggaaagattataaattgccttgctccctctgctcatgcacattttatacctgtctttattgttctctttaaaactattcagcgttaaccccacactttcttatattctagggggaaatacctttctataactattgaattatgggacaatgcctattttttttctttttgattctttagaagttcttaaaactttcaaaaacagacacatctgcagaaaagatcacatactaatacactactcttatttgcctttttcattgcattagaagcctattctgccagtgaggacttcgtatcattgtatgtagctgtgtgtgtcttgatggttgtgtccatcagtgctctttaaagcatgggaacgtgggaaggctccctcctggttgaggccccaagctggcaaggtgatatcccacataatcccaaacaaattgttctatctttagataagcagatatagtcataattaccattattggctcactccattacttaataatatggaacccaatagttgtgaattcctttggttaagctatgtttccatagaattaaacttattgatttattaataattattttgtttggacaatttaaagtcttttaatgcctatctggtcaccaaccttgtagtttttattttcactccaattttctgaagtagcaatgtacgtaacaggaattctgaatttaaagacatggaaaattccatttaatgaggtactaatgaagaaatactgtcctttaattacaaaataagaattttgaatatgacctagtgaaagctgaagaagcctggacctcaaattatttccagccaatttacctttgagggtaaaatttattcttgttttacttatgtatcaaacaatttattcaaaccctgatgaattacaaatatacaaatatatatttaaaaaccatgggatttttaaaggcttcaaaattaaatatttaattgtgtggtgatgtttaaatatagtaatattctttacaattctatgagaataaaggagggaagatggaaggctcattcatttccttgaaataatgtattcgtaggataaaatatggtatttctttcttaactgtatatggaaggattgtgattccccaaatacactggactctttcaacaaaagtaaatataactgtgcattaaaacatacaaatgatcaacaaactatattacaagaacatgcatatgtgaattcctattaatattgaaagcactgaaccattttcttcactcaaagttcagggtaggtttgctagaattctgtaagaaagaatctgtaaggagagaatctttccctttttttttcagagaaaagtgggggagcaaggaagacattttaagttggccaggtccctagtggcttcacatttttgtcttctttgaaattgagaaaatgaacaaatgtcttgtattccgtgtactgatattgcatgcagtcagtttgatgagtcattagatttcatgattaattttaagaaatctttcgacctcttcctccattggagttctcactgccactactcacactacagaattagtactcaggccctactgatgacaactttaaagtgcacctggatcaccatttaacaggtgttcccacaacaattcatttctctgcactcataaccatgcctagcttgtgaatttcttgaaagttgggtgccttattttagccgtgatataaattgttttcacaactttattgataactacactggttggaaaaaaactcaaagccttcctgacatcgaaatagatgatgccttttaggcctggccctgagttattggagaagattagtatgatataatttgatctttaagaagccattctatttattaccatgttttttcccgaaggagtttgcaattgattgtgcccaaaattatcaatattttggtgacaaactttgtaagaataaaatattaaatactctcaacttgagtaagatggcttctggtgcaactcagattaaaattggcatggagctatatggtattgctgatgtactttatttccagtggtgtgctggagccgcctcccaccagctcccgtgagctgatcatgcacagctttttccaactatgctttcaccttggtagtctgaaatcagccatgttaggagtatttacaccaaggaaattggcatatgctacaaatccatccctctgccccatgagaaccagttgttaaaatatttactactgcttaaaaaccaagagataataaatttacagttcttagatttttcagcagtatctactgagaagcaatcacaaaggaaatatcaggtaaggtctttgactttgagaaatcacaggtttagccaaaccatctccatctaagcatttatcaaatttctctttaaacttgaaaatcaactgaagaatttaagtcaagtttagaatagataaatatgtctttgagtatattttacaatgtctgtttgatttagtagatccttctggggacaggtctttctagagtttggagagttaccaagttactaaggtgtatttcctcagggctgcttcttgcttgttctcagagaagttggccaatcactgacaaaatgcatttcttttcccccttttcctgtcgtttgttttatttttaagctagcacttgtattttggaaaaattatttactcaaagatatcttgggcaggaaagaaaaatgttttacttcagttatttattggatctctataaagcaatatgatttctcctaaggctaactatatagtaggactagcatcataaaaaagtcatgtctttaaaaatgccaaaaatttgattttttgtatagaaagaaaaaaagagcccctttattaatcaaatatatgtccctttaaaaatgttttgagggtaaatttatagaatcatttccaatgtgtagacaactgccatcaaatgcattcttaacaatgatttaaaatagaatgaactgtaagtgggaaaattgctaaggatgataatctcctgatacaactaataggtaattattttaagtcaaaatgttaattcatcaaaatcagtttcttaattcagatatggttgttatcaagactttgaaaatgataactttcttttcatcctatccaaaattctatttaaaattctttaatccctcggggtaggaggagtaatcttgagctcttgccttctcatctacatttttcttttctgactgtgtctatatgctgtaacttagtgctcagcccatttcacatagcaggtgttttttccctatgtaacatattcttagagggaatgactataacaagtttaaccaagggcatgttaagaaattggggaggggactgtgccttggctagggataaccttttttgttttaatcattttttttaatttaattttttaaacttttaagttcaggggtacatgtgcaggttttgttatataggccttgtgcccactagttatttttcctgatcctcccaccctctccactctgataggtcccagtgtctgttgttcccctctatgtgtccaagtgttctcatcatgtagctcccactggtaagtgagaacatgcggtatttggtttctgttcctgctttcgtttgctaaggatgatggcctccagctccatccatgttcctgcgaaggacatgatcttgttcttttttatggctgcatagtatttcatggtgtatatgtactcagcctattttgttttaactgaaagacaaaaacagggtcaggtaagtcagttaattttttaaagtattgtttattttcctttggacttgaaagactttttttttcttttttttaattgatctcaggggaacttctatcatctagatgaccttaaatttagcatttcttctaccagtcatccaactaaaactgatggctactcttgggtgggtgttacgtacattctaggcctgtgtgagccttatatacattatttcatgaggttggcattattataacccttactttttagatgttgaaacagaaggcttgggaatttaactaccttgccccaggtctcacagttagcagccgctgagccaaaacccatctgcaaagggggcctagtgtcagtaaccccctcatagggttgttttgaggattaaaagaaaaagcaaacagaaaactgtccataacagtgcctccaacaaaaataagcaccatgttggagcatcatcatcatcatcatcatcatcattatcaaaactaggtcagtaggatccccacagcaatgctggtaaggcctgcataaaatgccaagtgaacagaatagttgtggcattccttcccgctcacatggctgtagacccagaagatctccaaatgaggcaaatgataataaatgccacagatttatatggctctggctctgccttgtcaggttaagaacagcttctcgtggtatagggcagagtgttttaggctgtttttaggtctgagatctttattttaaaattgaaattaaaccaggcaggaaagaagtcgtaagggacatgtgtttgaaactgtggtgttttctgagcaaacttgtctgtaatttaaaattgaacctagaaaaaaatcattgctccattcatttatttatttattttagagacagagtctcactttgtctgccaggttggagtgcagtagcacaatcatagctcactgtaaacttgaactcctgggttcaagccatcctcctgcctcagcctcccaaatagctgggactgcaggtacacaccaccatgctggctgattttaaaattcttttgtagagatgaaacatttttttgtcttgctgtgttgcttgggctggtctctcaaactcctggcctcaagtgagcctccatccttggcctcctaaagttctgggattataggcatgagagccactgacatttgcttttgagcaggtggagaaaggagacaggaagggctgacatcttagggctgtttggtaggcacgacctttaaggcgaaggttttgtgcatttcaactccctgatttcctttccaacttttcaaatagcaactcttgaattcaaacatgacaatcagagagtagtcttccctcactggcactcaccacagacagcccagatgtcacaaagcaagaccctcctggttaaaaatgcctgaagaccactctctatgtgtttgttctcagaacatattttgtttgttttgttttgtgttttgagacagggtctcgctgtgtcccccaggctggagtgcagtggcatgatctcagctcactgcgacctccatccgctaggctgaagtgattctcccacctcagcttcctgcgtagctgggactataggcgggcaccaccatgcccaaataattttttttttttttttggtatttttagtagagacagggtctcaccatgttgcccaggctagtctcgaacttctgggctcaagctatccacccgcctcagcttcccacagtgctgggattatagccgtgagccactgtgcccagctcaaaacgcatttttgatgtacataagcattcccatattctagaccagattctttctttactggtctcctttacccaaagaaaataaatctatcccctaatatttacaggacattgatgctttcttatgcattatctgagagataaaaggcaaaatcttctggttttgtaagtgtgtccaagttcaactagactcatatctgttaatgccagcaaagcaggaggggggagtgttttggggagaaacaactcatcttttaaaaatatccttactcattgtgtattgtattttgtgttactcatattatatgaaatttaggactagaataataaacatttttctctagagcaaatgaagtattttgctgatttttcatgtataaaaatgtcctacctacacacagtcttgatgattttcactcaagaaatgaattttcttgaatgggaatattttgtggtagggacaccaggataagtcttgttaatggggagaaaagcatttttctttatattaatgttatattttgtataaattagaaattaatcatttagagtttgttacatcaactttgatgttttactggaaagcagtggttataaatgtctgtcttccatttgtgttcttaatacgtggtcattcttagagaaaactcttctcagataaccaggcaacgaatggagggactgttcagggcctatctagggaagcaggatgtaggattatgatgggcctcagaggcaggcgtgtgatgttatcttcaaatgagcttatacataaagttgtgctttgtgttaaaggcactgacttgataaatgtgaacatttaaaatatgtcacatttgggtaattctgctttggcactgaagaactttgaaaaaatagaaatagcccaggcctccgtagaaagagctttgttgatttgttcctgagtgtgaagagcagtgatttgggctgagagaggactcctgcccctggataagcatctgggcctgtgggtcacaactgtggctcccctaggaatcctcctggagctttgacatcactaatttctggtttcagccctcatggttctgatttgactggtctgtcgtgcagcgtaggcgtggggagttttgctcctcaaagggtgtctgtgcatcagcagcactggtggcatcacctgggaggtgttagatacacagattctcaggccccaccctagccctgctgaatcagaacctgcatttcaacaagaaccccaggtatacatgttaaagtctgagaagcactttttacagccatcttaggccgatcggtctgaatgtcacctgaaaatgaaagtgttctaggattggttgttttccgtcacctccactagactgtcagccctgtgagggcaggacctgtttggtttaacactcttctcccagctcccatgagtgcaccagccctgccggggcttgtgtgggttctgccagtgtatcccccagggactctccttgccctgttcccacatcaggccagccctctttcttctgagaccctgatggccttgctgctttgtggtcccatgaggcatctctgctggtctgcccatctatacctggtattgctcctatgtttttgctctcagagggccatcttattgctcccacttccagcttctcaatagggcctcagtgtaatcttcatgaactttccaaattgtttttagtctcacaaagcccacttccattcattaaagaccctgagcaggttggagagcatttatagtcacagctgagtctgtgaatataaccaacaactgtgatgacccctctgttaataaataacttggacatcagcaaaaaaaaaaaaaaaaaaaaaaaaaaaaaagcagggggaggaaaggtataaaagattattccaaagtattaattgttggccactggaaaaataatggctaattctgttggtagaaataaagaagccaaggtagggatcagttggggagggtggggacaaggatatgcctaatttgcacttgctgaattcgagggaaggataggtatccatgtagaaatgttctgaacatagctgggggataacaacatgggaggtcccagttattactgcaaaacctcttttagagtctcttgacctagaatgttatcattctttccattcttcctgaaacattagaaggaaatggactatggctgcccagggccccttctcctctaacttaaccaggaagaaaagagaagaatggttctgttttcataagttagtgtgaggggacaatctaacagacagtatctgagaggaactggtttgatttcatccactcttatttaattccttttttttttctttttgagatggagtctcactcttgctcaggctggagtgcggtggcgcgatcttggctcactgcaaactccgcctcccgggttctagcgattcacttgtctcagcctcccgagtagctggagcacaggcgcctgccaccgcgcccgtctaatttttgtatttttagtagagacagggtttcaccatgttggccaggctggtctcgaattcctgaccttgtgatccacccaccttggcctcccaaagtgctgggattacaggcgcaagccaccgcgcccggcccactcttatttaatttctattatgccctctccggtcacgtgataacttacatgccagtgtgcgatgtgggaaagaaaaagaaggcatcagacatcacggaagggctctgtatatttctctttcggaaccacctccattgacccttattacacaaaccctgactgagccaaggagcccaaacagtgcagatctaagaactttcgaagactacctgccctgacagctatttcaatgctagcggggaatttcagcaacaaccaatttaactgagcacaaatgatgtgctgactgaagtttggtaaaaagcatgtagttgagattcaaaagtaaatgctgtctcctctctgagttgcttgtgattgttaatagactgaaaactgaccaaattggcaagaaagcaaatagttttacttatatggctatacaattatcctcaattactaaattcagttggtgagcaccataattactttgtaatataaagggcaacctggggagaagagatttttttttttgttgtttggaggtaagtggccataaataactaaatcagaaaggatacagcacggatatacagtttttgttgttgttgttgtttttaagtatcagaaaaataaatacaacctttcaggatgctttgcaaatgtagggattttgtcactaatagaagtctttgaaatacatatctggaatgacagcaatagtcagtcagtgtgtgcttcaggatgaatttatgacctgaatttggtttcccatgctttctttaacactgtgctactatggcaaagttatcatttcttttttttaacacctaaccatttttctggtggatggcttcctatgtccccctccccccagctctttccccacagcccataaaaggttttcaggagattaggcaatccccaaaactgccaatgatagtattttgctaattctataaatatttctgtagacttcactccagtgagacataatttcagcagttggagtaatgggctttcctgctgttgcgtgcattcagatcgaaagctctctgacttgctgcgcaattactcctatgtttctgcatttctgcttcgtgacattctgtcattagtcttccctgcaccagggtgtgaggttgtagggaatggaatgtaaacattgtcattctgagatgagctgcccgaaagttcagcagtgaaaatagcaagaataagtttccttccagaacctggcaaagccattttgatttgtttgtgaacccaggtggggcttgtttattgacaaactgtgattcttcagatcaccaggtgatgtttacaaaatgtaatgttaaatccctccatacctctttaaaaatgtgtccccatatttgcaagtttctcagagaaagggccacatagttaagcagctgctggtttgaaatgtaaagtacttagaaagtacctaaggaaaagagctttataataaattttttaatcaaaattttgaactcaccttgtgcagctttgctcacggggcatgttcagctcatgactaatggtcactcttacttgactttgcctattttcttccctacttcatttcccccatgcattgtacctttaaattgtcccgctctaatttggtatctcttgacttctgcttcaaacttttagttgtttccgaagcatgctaagcaaagtctgtgtttagctcctgaccgaggcttggtgttgactgtgggacatacttacagaatagcagctctactgctaggtgtgtgtgtgtgtgtgtgtgtgtgtgtgtgtgtgtgtgtgtgtgcgcgcgcgcgcgcgcgagtgcgcacatgtgcatgcatgagggacagaaagagacatcttgtttttttttagactctagcttccaggaggtcaggaaaaatagtggctctagtttaattaacatcctgttttagcaccagttacagggtcattaccacagtaaatgttagatgttagactttatctcttctccatcagaatttcactttccacaggatactgtatttctttcaggctaatctatattttaatggcttctaaattgtcaattgagatggtaattagttctaatttagtgataatgctgtgaacatggagtaagaagctaattgacatggcatgctaccaactagaattttatgaactaaaacttcttatctcttgcacaacagtgagtgttctcattataaaggtgccattcaggaagggagagtggctttgcccacaggtgttcggtaccttgtggatacgttgctgattgctaggtgatggccaactttgactttccaagtcgaacgggtctcccttaaacctgcttttggaaacttgtactaaaaacccctcctatatgcatatttagttaggacatgtttgtttccagttgcgtttgtttttcctactagatataaggaattcctatggaggctgagggatatacaagcaggagaacagcaattctctgttcaacacatctggattctggtagaatagcaatacattcactgaaaagttcttaatagtttacagaagacttgcacatatgtgacttcatttgatctcataattgaagtcagggcaggcattattatacccattttagagctgaagaaacagaagttcagggaagttaaatagtttgtccgtgattatttgactgggtaagtgggagagccaagccaaggactggagtcttctgactcttgcttcagggtttttctcccaattacatcttatttctctgacctgttcatccatataatcttattctgtaattctaagcaattgctatttccttaaaaattcggaaaaattacataactataactcaactaactcattacctttttacatccaacccccagactctggaattaaattttccttcagtacttaccctaccctagctcaagctcagaaaaactgtcttggaaaaagaggtaaaaaggacagaaagtaaagagaatcagattgaggggtgcttctgactttttttttaaagaaattttgtcatacaactcccctaagatgtgagtcctaaggttaaccagagtagtttttcaaagacgcagcttgtccgttacatttgctgctccgtggctgatcctgtcctggactagcctaccagaacgttctttagcccattcattagatgatctagctcctgaatatctagcacacagacagtcttaatccctgatttgtgtttgtgtatgtgtttgactctgatttgcctttcagatagattccttagaagctctaccagaatgtggacaggaaaacagtggtgtgagaccctaacaagtcagctcagctttttgtcagcggctgttactgcctgggcagggtagaagtcattgttgaagatgaggtctttcggttaccaggcagttttttacatccttccttgccctcctcctgctcctttaaaccagtgggagatgagaaagccgaagctttatctgtgtctctctgttagtttatttgtaaactgcaggtcaaaaagtaatattatgtataaaatccagactagacaattgctcgtttcatgcagagagggttttaaaggaaatcagctgacttcctgacttgctgaatgaagtgtgagttttagtttctgtcctgttaggaaatgacatgtgaatagagttcttgtataagcaggcttttatttttgtcaatggttggaaatttgggaaaaagagaagagaggtctgtttattttagcatatcaagattcatttctgtggcacacacgcagaaatgggtatttctgagtcttggtggtctcgggccttgaaattccatttcctctcctctccttctcccagagttgttggattgccatagcaacatgactcctcccccacaaccctgtaagagtaactggttacagatttagcagcaagtcaggccgagatcaaaatccaaatatagggccctgatcacagaaggtgggaggactgaggccgaagactgctctgtgtcccttcctggggctgcatgtgaagtgacaggcgctttgcccggacggtctaggtggtgctgcttggagactccgccggccttcatgagcatcactgccatgtcacagaggggtctgcaccaaggaagggaattgaataatggcatggatgaagaatatttactgcagcagtataactctgcatcagatgaaattgctgatgctctgaaagtcaagcatgagactattggggaagcagctatggaaataggccttcagtaggtgctataaaaataaagcatgctctgtccccaagaatgcttcctaggggagtctttgggatgctgaaaatggtgataatcatatcaacaattgctcatgttgattgagtacttagtgtgtaccaggcattgtactaagtacttgataactcatttaatcctcctaacaaccgtttgacctatgtgctgctattttacagataaggaaactgaggcactgggaagttaatgaactgcctcaaagttatgtagcttgtaagtggctgagctgggatttgaacctctacagtgtggctccttaatccaggttcttcattctcatagtattgtctctaatggatctgtatgggctcataaatagggtgttcaaggaaccttaactgtagttttggtttttttttaaacacaaatattgttacaggttgaattgtgtcctgcctcccccagaatgtcaaagttctaacctccagtagttatgaatgtgaccttctttggaaatagggtctttgcagatgtagacaagttaaaatgaagttatgacgtgatggtgggccctaatccaatgtgactgggtatccctataagaagccgacaatgccatatgaagagagacacacaggaagagcaccaggtattaataatcacagaggcagagattagagtgaggcagctgcaagccaagcaatgcccaggattgacggccaccaccagaagcttggaagaggcaacgacagattctacttagtgtctcagggagagcatggccctgctgacacatcttgatttcagacaacctgatttgttttcagaactgtgagaataaatttctgttgttttaagttacccagtttgtggtattttacagtcatcctaggaagctaatacaaatatgtttttattgtaccagattcaatcagtaagccccagtatggcatacagagtgatacatgaatatttcgttttatctgtcccttcccatcttattggtaactgctaatgacagtttatctcctttctatgcatgtatatttatgttagtttttatataatgaacctatattatattcattttctgctattcttttttttctttaaagcttactggtatattctggagatctctaagtatttggcttaaaaatttttttttcaattgcggtaaaatacagtttatcaacttggccatttttaagtgtacagttcagtggtatgaagtgcattcacattgttatgcagccattaccaccatccatctttagaactcttttaatcttgcaaaaatgaaactgtgtgtgtatattaaacaatcacgccccattacttccttcccctggcacccactgttctattttctgtctgtatgaatttgactcttctagatacctcatataagtggaatcatacaggacttatccctttgtgtctggtttatttcattagcataatgtcctcaagcatcatcatgttgtagcatgtgtcagaatcttcttccttttggaggttgaataatattccattgtatgtatatatgtcattttgtttacccactcatctatcagtggacacttgggttgcttccaccctttggctattgtgaataatgctgctatgaacaggggtttacaaagatctctttgaaatcctactttcaattattttgggtatatatcgagaagtggaattgctggatcatatggtgattctatttttaatattttgaggaactgccatactgttttccatagcagctgcatcattttacattcccactagcaatgcacaagggttccaatttctccatatccttgccaacccttgttattttctgtcttgttttttaatagtagccatcccaatgaatatgagatgatattgcattgtggttttaatttgcatttcccgaatgatgggtgatgttggccatcgtcccatgtgcttattagccatttgtatatcttctttggagaaatgttcattcaggtcctttcccaatttttaaaatcagattgtattttgttgttgcattgtaggagttctttatatattctgagtattaaccccttatcagatatacgtatgagtctttagcttttaagctgttgtttctctctgcaccagctgagaatgctttggtggtggtggtcatggggatattgtattctcattatcaggcttctagtgataggttgtatcaaggggtatttcactatggtgagttttctaacagaggaagcaacatgtattagtcagggttctccagagaaaaagagccaataggatgtgtgtatgcatatatgtgtatattttataataaatataatgtaactacatatttataattacatagctatatttattacacatataataaatcttgtattttatatgtgtgtgtgtgtgtgtgtgtgtgtgtgtgtgtgtgtgtgtgtgtgtgatgagaaatcggctcacatgtgtatgaaggctgacaagagctgcaggcagagccagcaggctggaggtccaggagagctgatggtgtagttccagtccaagggctgatgggctcaaaacatgggaaaagctgatgtttccatttgagtccaaagcaggaaaaggctaatgtcccagttcaagggcagccaagcaggaggaattctcccttactcaagggaggatcagcctttctgttctgttcaggccttcagctgattgggtaaggcccacccacattatggatggcaccctgctttactcaggccactgatataaatgttaatctcatcccaaaacacccatataaaaacgttcagaataacatatggccaaatatctgggcacctcatagctcagtaaagttgacacataaaactaacaatcacacagcactaacaaatgatgctgtcctcctctgcctctgctaattagtttgaagatgaagaacattctcagggtcttcattttcctataggttttgtggctcaagtctgttattgagctcattccttttcatgtgaaggtataacaagacaaagcaactttggagggctccaggtggtcatttctagggcagatgtttcccttagaatgatgtggcctcaaagaaggagttttccttttactgaatcaataataatttttataatcccaaattacttaaataataactgaaactttgtacatgtccatgtagcttctctaaatctctcctgctttttaaggcttgagctgttttctttttctttcataacctcactgcttcttgcccactatcagcatttttctgaccctgtataagcctaagtgaaatcccttgggacatacatagcttctttatactaagaaacttaagtgttggtctaaagtattaacaatttttgtgcatttttggtaaagaaagttcctacagttttactctctgtctcacccctagatttttgggcactaccgttcattcattcagagttactatacaccaggtagggtgctaaatgctgggggtatggcactgaactgtacacacagagtccctgccctcctggagcttacattctagtggggtctagtgagcttacaaagctagtacaataaacatgcattgccttccccacactaccacagccccactacaaagaaaaaccaaagcattttagaggatgactatagtagagtcaagatgaacatgcactaataaacaaaccacttactattagatatacaaaaaaaatgcaaacgattatacggtaatgatttggctgtaccctttttccttttggaaatctcaatctggtaatctgtttgtttttcattattaatttgaatagtcagtatgtgcatgtttgtgcatacatgacaaaaaccaaaaggcacaaaagaatacacagtaaaatgtaaatctcctacccctgccctggccacctatagtttccctttccagagtagccactgtttttacataatttcccactgttccttataggtctttgcatagaagtatgcaaacatacacatttgtgttcttaaaaacaccccaaaactccaacaggttaagctctacccatttgttctacacttcactttttttttcacttaacagcatgtcttgatgatcagcccataccagtatgtatataatgcatcattccttttgctggctgcatggtattccaccacaggaatgtgtactggcaggcagtattgcatagagaccaagaacctgtggtctgaatcctcaatttaccacttattagctatgcatcttgggtaagttacttaagctcactctgttttaactttcttatctaaaataggacgtataacagtacttaactcataaggttgttgttaggcacgtagaaagtacctaatgtattttatctgtcactatgtatagtaatttatttaaggagaccctattgaaggatagtgaagtttttgtcaacattttgcttttagaagcatcacagcaatgaatagtcctgtaatatatatcatttcacacatgtacaagtttatatttagaataaattcttagaagtagaatagctggatcaaacagctaggtatgtgatttaggttctgatggaaactgccagctggctgtctgaagaggttataccaacctacagtcctaaccataatgtataagggtgggcatgaggagtggaggcaggggagctattttagtttgggtggtcaaggatgtgacgttgggattaaatcctagatgatgaaaccgagccagccacgtaagatctgggatcacaacagctggggctatgctccacagcagaaatggccctgctgtgttcaaggactggaaagcaggccagtttggctggagactggtgagtgaggaggagactgcagggctgtgagtagacaggaaggcaggattcatatagacccgatttaggattgtgttctaggtgcaatggaagccattagggggtctgaacattgtaagatcactctggatgtggggtcgtgagtagttggggacaagtagagggagacagggagattagttaggagctaatgccatgccagtcagccatgtcagagagtggggtgcctggtgcctagggggtagtggggatggaggaggtggagcctgctggttttgctgacagatacaaaggatggggagggggcaggaggagtcagggagagataggactcaaggactatgtgccctcctggctctgtcatttactagaggtatgaccttgggcaataatctcttctctctctgctttactatcctttataaaatgaggagagtaatttcacattttcatatggtggttatgaatatatcacttaacatatgtaaaatgcttggtacctgctaaacaaatatcagcttttattaggtattgagatggggaagattggaagtgttggaggggggatcttcttgtctgtcttattactgtgtcctcagcatttggaacagtatttggcacataatagatagtcactaaatattgttgaataaaattatgtatattcagctgggtgcggtggctcacgcctgtaattccagcacaggtgggcagatcatctgaggtcaggagttcgagaccagcctggccaagatggtgaaaccctgtctgtactaaaaatacaaaaatcagccagggatggtggtgtatgcctgtaatcccagctactcgggaggctgaggcaggaaaattgcttgaacctgggaggcagaggttgcagtgagcccagatcatgccgctgcactccagcccgggcgacagagcaagactccatctcgggggggtggggggaggggggaagtactgttgaataaaatgaatgaatgaatagaaataggacccattggaaggggaatgggattgggtgattgataaggaaagctttacattatctgtatcagcggtcccccacctttttggcaccagggactggtttcatggaagacaaagtttccacgggccagggtagtggggacagggatgggggttggtcataaggagtgtgcaacctagatcccttgcatgcacagttcacaatagggtctgcgcttctatgagaatctaataccatgctgctttgacaggaggcagagctcaggtggtaatggtcgcccgccgctcacctcatgctgtgtggcctggttcctaacaggctgtggaccagtaccggtctgtgtcccaggggttggggaccctctatctatctatctatctgtctgtctgtctgtctgtctgtctgtctgtctgtctgtctatctatctatctatctatccatccacctgtgaaatagtgtgaatatactgacacgttatttatatagttaaaaataaattctaaaaatatactaacatagtaataaacttagcagtgtcagcaagacttttaagttaaaatgtgtctttgggtctgattcccagaaccatgagccaagaactaaagtttggggatctgcagatcttggtcactgtatcctgctatgcattcagggctcatcagttacatcattttgaacccaggaacttgtttttcaagaacatttgtagataaaagtgagtctcatttcttaatagttcacaaatcacttttataattaagagcagtgcctttaagacataatctcaaaacttatccagctgggcgctgtggctcacacttgtaatcccaccactttgggaggctgaggcgggtggatcacttgaggacaggagttcaagaccagcctggccaacatggtgaaacaccgtctctactaaaaatacaaaaaaattagctgggcatggtggcaggcacctgtaatctcagctactcaggaggctgaggcaggagaatcactcaaacccaggaggcggaggttgcagtgagctgagatcacgccattgcaatccagcctggacaacaagaatgaaactccatctcaaataataataataataaaataaaataaaaaattatccaacaggccaggtgcaatcgctcacgtccgtaatcccaacactttgggaggccgaggtgggcagatcatctgtggtcaggcgttcgagaccagcctggccaacatgacaaaaccatctctactaaaaatacaaaaattagctgggtgtggtggctcatacctgtaatcccagctacttgggaggctgaggcaagagaatcacttgaacccaggaggtggagtttgcagtgagccgagattgcaccactgcactccagcgacagagcaagactccatctcaaaaaaaaaaaagaaaagaaaaaattagccaatgaatgagaaaaataacatcagcactgcaaattaaaccaccaggacttgaaatttcagtgatcctatttttgcataccacagcccagcattcatttattcaatccagaaatagttatcaagcaactgctatgtgccagacacaggtctagacacttgggatacgttgaataacaaaacaaagatcctttccctcgtggagcttacattctaatgggaggatgtggggagacagacaatgagaagcaatacgtagcgtaaggtaagtaaatcacagagtatgttagataagtcttgtggaaaaaatgaaaagtcaggcaagctatggttgcttggagttttgccaagagttgtgattttatatagtgtggtgtgagcctcagctagaaggtggcatttgaacagagatgttagggagggaaggcagtttgcatttgcatttgaggggaaggttgtttcatgcactgggaacggccattacaaaagcccttaggttgggatgtacgaggaggctggtgtgactggagaggagtgatcaagaggaagggtggtgggaggcgaaaccccaagaggtaagtggtggtgggggagtcgtgcactgggaatcatgcagggccttgtaggctaagtgtaagccctttggcttccacactcagaatgaattttggagacatcgcaggttttgagcagaaaagtggcatgctctgacttatactttaaaaagagaactctggcttctatgttgagaataaactttaggagggcagatgtggaaagcaggaagacctgttggaaggctggtagagtaagagatgatggcggctcacacttggctgacagcagtgtaactggtgaaagtggtcgtgctctgaatatattttgggtacatcttgaaggtggatttcctgacaacagaatttcctggcagattggatatagggtgagagagaaagagaggagtcaggaattatcctaagctttttgacctgggcaactgaaaagatggagatgccatcacagagatggggagggcattgggcttggcaggaaagctcaggaatttggttaagaacatgctgaaattgagatattgattatacctccaagtcccattgttgaataggcggttggatatataagtctggaatttaaaagagaccgatcaagggggcgagatatacatttgggagtttactttaaataccaactatatggcatggaactgcatgagctcaccaggggagtgacggtaaataaagaggagaccacagactaagaactgagtcatttcaacattaagaggcaagaagaggccaggcctggtagctcacgcctgtaatcccagcactttgggaagcagaggtgggtggatcacctgaggtcaggagttcgagaccagcctggccaacatgatgaaacctcgtctctactaaaaatacaaaagttagttgggcatggtggcggacacctgtaatcccagctacttgggtggctgtcgcaggaggattgcttgaacccgggaggtggaggtttcagtgagctgagactgcgtcattgcactccagcctgggcaacaagagcgaaactccatctcaaaaaaaaaaaaaaaaaaaaaagaggcaagaagaagagtaggaattagcagaagagatgagaaggagatgccagtgaggttggcagaaagccaggagagggtggagctctagaagccaggtgaagaaggagtgttaagaaggagaaagtgtccaaagcatctgagaggccaagcaagaagagtccgacctctttccacctggagaagagacctgggagtccgcaccatgtgtcagcacagggaatagtgagaaagagcctcgtggacacagagcttgccaacagcagccccagaagaaaaggaaagcatcttcttccatcagttctggcctcacaagacagagaggaatgagcaggggtggaaggtagctttgtaagtgacacagtgatgtacctctgaccctattttgatactagttacattaaatcagtcctaaatggccttttggaatccccagttgatgaaatttatttctcctttgtttcatgtgccactcaggatctcttgaattcgtgaaatttttattaagaaagcctcatacaccaataaacaacgtgtgcacagactccatagcctctctgctaacacattgctcttgtatatcaggaaggtctccagcatcaaagtgagtcagttattgcacagagtcccaaccttgccagctttttgccaaatggtcaccatcctgtacatccttccttcctggaagtgatagaaatctctatggctatttttgctacaaggagattatggcacagcatatggagtccttactctccaggggcaaaagaaaagtcttgtctttgcttaagcaagtcacacagtagatgccacaggcttagggcaactgtgtgtctgcatgattcatgggggactgcacgggggagccgcagcacacggagcagctggtcttagcagcatactaacctgatgtttcccataaacgttgcgcatggaatttcccccatttgtcatgctgagttggctctgtcaatcctatacaaatccctgcgtgcattaatatttccttgagccagagcaaaggaattctagaatattggcattctgagggtgaatagtgatggatatagtaaacttttagcattatggatattgtcatcttaaacaaaataaacatgaaagaaaaagagaagttatgataaattatcagaggctgtttgttaaattccctgatttaaaagcatcttcctctataagtcctcggtttaaaaacaagaatcaacaaggaacaagatttgtctataagtaaaaccgtttctgttgctattttttgaacaacaagagacatttctctaggagattaagccagtcgtttatcatgttgtttcagggaagagtatactctgagttataatgtaatacccagactaatttatctcatcatggaaactatttacaataatttctggcctagctagaaattgaaaagttcattttattacctgaattcaatgtataccgatgttctaagagagtggacattcggcagttagtgctattttaaatggtgttgttgaagagagtttactgcctaaattaaacaggttggttttgcttcttggcatttattatttttttgaaatctgaccaagtttaggtttattaaccttagggcacagaaactcatttgtctcactagatgcctgagcaaggttggcatgctagagagaaaggacatggtttagcagatccatggaccatgccatttggtacttattgaccccagcaaattactttaatccctccaagcttctatttcttcatctctattgtggggaaaataacctgcatcacagagttatgtcagaatccataaaatattatatgtaaagttctgagcacagtgcctgttgcgtgggggcacgaaataaccggcagctgttattgttgctgctgctgctgttgttacaatctcctctagcctgcagtcatggagatgtaagaaacatggtggctgagcctggtgaagtttctcagcgtctctgtttcttgcatgtgtctcacacccttgtctaaaatgccttgctctcatctaacccagagttctctctcaactaaggcagcagggttggcgtgaggggggcaaaggagggaggaggaaggcaaccagcctcacaagtgggggccactcctcacagccacgagcagctgggccacatgcagcactggcagcccaggtggcctgttacggcgggcagtacttccctttgcctcccttcggaatctgtcagcacttttatgtggagtcttcatcccatgttcagccctggggttttaaggtgtttctcctttgctttgggatttcaaacatggcagctcatagcactgtactgtcatttctcctggatgctagggatgcctgctacttgcctacctcgagcagatgttctgaatgtcaagtcagcattgcttgaaacacacacacacacacacacacacacgtacacaccactgttactagttctgctatgtctggctcatagacaaggatgtaaagaagcagtctaacattctgccattgacaaactactcctttttaaaatgccaaattcttgtaattctgcttattttcaataggctatgtctggccaaaatgtctgcttgaattggctaattaaaccaaaatatctatgtttgataaaaaaaaaaatagccttgggattttgtttgcagtgtaccctcaaatcaccatctgcaagtctgttactccaagcaagtcagggaagagtagcttctgttggccctcccccgaagaaacaaaaccaaacctacaaccaggcctttactctttccccagaaatggttttccctcttccttcatctcccagcgccctcgtgtctctctctcaacagtacctggaagtttcgtgctatgagatttttatgttttactctgggtttgtaaatccgtttcataactgtaaagatctgtagcttatctctaaaatctcttatctgtgtttgggatataagaggtccctattgacacagaatcaattatttattgatttagaagaagaaaaatgcagagtcgcagagacattgtcaggatttatagatctcattttggttgatgggactcactgcgggggaaacctgtgctgagtggaaagggctccttttccaaatttatgctattctggttcgattctggagaagccggcagttttgtttgcagactttctggttttcattagcagtctggtggtaacagctagctttagctgcttcttcctgtcactgctcacgggaatggcgctgaatgctcggaggtggcacgaggctttggggatggcagcagcttcatcagcatgccctcaccccagccctcaattgtcacagcagcaggtcctgcctccgagaatgagaacattgctgattagtgtgcctggtgcactgggcaggccgtggggagagagaatgctatggtatatctccactgatttcccaacaattacattctccctgcttcctactggccttccccttacacacaggctgcatcttgtcttccattatcaagagtttccttttggtctttcacactaggagttcacaggtttcttctcagtgtctgtaacttcattccacctcctgctcttgagcttcacctctctccaattcaccctttcagtcctgctcaataaaagctcggctgttcctccttaatgcctttatcctctcattcagcagtctgttgaaaactgtgcactcagagggaattccacttaatgatgacttgaactctctaggctttaacttgttttctcatctgtaaaatggggataatggtattacacacctctcagggctattgtcaggtaaaacaagataatacatataaagtgctcagattaatgccagatacatagttatcagtaaaggcattatcatcagtttcttcttcatcaccaacatctctaggcatactctgggtctataagcagggaccacctgtacttttggtgctatgagtatatgtttagccctacagatcacaacctagtcttatttgaaactcatttaatgtgatgccaatttcctgtcctatcttaattctagattctcaaagaatagtctctttgtctctttttttctttactgcttcactacactcgtgcgttcactacattaaagtttacaaagcagtattaaaaatcttgttgcatttagtccacatagtggcatatgagacatggagcattttacatatgatagcattgcagacccagagagtacatattttgcttaagacaacccaccattaagaggcaaacccaatattcacactcaagtcttctgactccaagtccagtatagtttttttctatgtggaacaatttttctgtggagaatcagtgacctttaattttctacacaggcttttatcaagaagtcagtaagtttattgttgttgttgttgttttttgagatagagtctcgctctgtcacccaggcttgagtacagtggtgcaatcttgggtcactgcaacctcctcctcctgggttcaagcaattctcctaccttagcctcctgagtagttgggattacaggtgcacaccaccacgcccagctaatttttgtatttttagtagagaaagggtttcaccatgttggccaggctggtcttgaactcctgacctcaagtgatccacccgtctcggcctcccaaagtgctgggattacaggcgtgagccactacacctggccagaagtcagtaagttttaagttcttggaaggtagatattagttctaagtctctcactaagatgcttatgtctagtcatgtatcagcatgatggcttgaactgatttactggatttctttcctggcatctcactaagggcaggggactaaggtcatgataatgtggaggaggctttctctaggctgggaaagtagtcctaggggagcacagactactttgttgactgaaggggactttgttcaatgaagagttacagtgtatactctgggaattggtggtgggtagaggagacacaaaagtggaagctggtgttacaaacccgacataaactgctgctctcaagttggtctggcatcggctctccatagaattcttttgaattcatccttccctgtaacttcttgtccctgactctgccctcaaatctccaggcaaatccttgcctttcaatgtggtttggatagcaatgggcactgagttcatctatccattcatgtactgatttgtggagattcattcagtaccagctatgtgcctggtactgtgttcatcactgagataacaggaatgaaagatcccgttgagtggatgatccagcttcctggtatcaggttgaggggactgggagaagcagaagggatggagagtcggacgaagagaaaagcgttcttagtcaagaggaagcgagtctgctgtaacccaacctgcagaccctgcatgcgtgaacatggtgtgatcagcctgtgaacattcataaacactgagagctgcgttacacagtgtcactggttcaccagaacctctggatgacagagagctcagcagtgagcccaatatgtggggtaatggtgcttggaaagccctggactgtgagggaaacaacctccctttccccaaaggtctcaaggcaacttgctgattcagctccgtctttgcttcctctaatatttggatagaaaagcagatactcaataagaataaagagttgaatcaacaaggcaggagggggaaagtctttaagacaacaggcaagggccagggagttagaacctggcttcaagcacgccatctgctgtttactcaattcacttctctttaaaacatctaggtttgaaaaagaactctaagggggacagaaaagcatacacctttccaaatggtcttccccgatatggagctcactgagtagcctcatgatgagcctaactcaatacaaacaaactgcctgtgaagcttctcctccacccagttgttggtgaaagcaaatgcatacctcccatctttgatgcttaggtttcaaaaatccaaagctgttcttttgactttgtcactaaaccagacattggcaaatgtcagtccttttatggaagtaccagccttgagctaggaggtctcctaggcccggagatcctcagcagcccactgtcaataggtggttgttatcagttccagtaaacatttttaaatatcctggaaatgcctcaacagtggacctagatatttccctttcagccggtaggcaagagtcggtatgctctttgaagttttgcggtgttataagacactcaagaaaaatgtgtggtaaagtattctaggtatgtttaaattgtcagttattgcttattctgtttgtgccttcaaagaatgtttttgttaaggaagtcacagggatttgacttacttctccctgactgaagagaatagtggaagactgcctccagatttgaaaagaaattagtcacaggttttttttgtgtgctttcagcctggagaacagacgcctttccaccaaagaaagaagaaaagaggggctctaatgtagggcaggtgggagagaagggcttcacactgggcggggaagactgtaggtccaggagggactcggtagaacaaatgcttattgcggacagctgggagaagcagtcaaaggtcatttgggtgatctggaagtttcagggcaaaccactgggaaggcctctcttgactaccggctgtgattcagggtaagctaaaaacaaagtctaccttttgtttaggaaactttgccattttccagcattttcacacacatttcttgaatctgagcatctcagcccttactgctaaggagaatgggacagagaggtgtatcttgtctaaggttactaacttgtggtaaatgcaaatcttctcaaagatgggcacttctaatcaaatttgggggttaaataccatacttctaatagatttaaaatagaaattaggttctaaattgcacctagtttattaatttaaatgttgacgggtaatagctaactattattgggcacttgttacgtaccaggcacctggctatgtacttgacagaaattcgttcatttcaccttcacaacactagtaagtaggtagatgtttttaatcgccacagtgcaggtgagaaaagaagacataaagaggctacatgcaattagtcacacagtaattagaggagtcagattcaggtagaaagtcccaagtccaagacccttccataactgcctctgtgtggaacctctgcatggccctcggtaagggaagggtttaattctagtgttcagctttaattctaatggagttatgtttttgtaaaacctgtagtaagttagtatgattcagatcttaaacacatgagtggtgttgcaggacatgtgacaggcaacatgatatgatttttttaaaaagcataaattgagaagtcaaaggactgagggcaagtcttgccttcagtatcagtaaattggatggtgtgggaaaatctcttaatctctctgggcctccgtttcttcatttgcaatgtggctaacttctaccactaccagatgagaatctactggtatctggtgatagtgtactcaaactgttaaaaaaatagttatctgaaatggcgacctgaagttcttaagtgacattcagtgtgatgtgtaccaaaggttgatggtgtaataatatggatttattatttttaagttaatttatttctaactggtgtagttttaaaaattatacaaaatatgtatgaaaataaatttgaataggacccaaggacttaaagtgaaaaaggtaaagtttggacagtcacagtggctcacacctacaatcccaggactttgggaggttgaggcaggaggactgcttgagccgaggagtttgaaaccagcctggcaatatggtaagatcctatcgctacagaaaactactttttaaaagtagtcttacttctctgccatgcctatccctatcccactgttcagacataactactgttaaggtttcttctttcagaaattggagccatatataactatgcaatatcttttacattaatttacgaaagactctgctcgtttctctaaattatcttaattacaaaaatatgtgactctaagtcttgcttaaaaaatacttcaaagcctgtttttttaaaaagcataagaccttaaatttatgcatattgaattttatttccttccactaaaatatgaataaggcactctgctggagaatatatttgaattgtgaaaatataactgtcaacattatggaagcatcaaagtattaaaataagctttcattttgttttggatcttttaaaacatgacaacaaaagtcatttaaggcattgttgcttataagtcattttgtgtgattattcatgcgatccagaatacttctctgtttccctctgagttttgactgttaagaaatgttatgtcttgaaaaacatctgaagagggttgcctgtatctttccttgccgttttttatatagtcagtgggaatttgttacataattctgtgattcttttgcttcgcaaaattattcttttttcaaataaggaagtgttagaggctttcctaaactaactgcaatactccatcttttatgtggttatttcatctctcattgtagatcaataactcttcctatggaggccaagtaaattaaaccatatggttttgggccaggagttttctttgtgatcgacaaaatgaataattagggttcgctttctccacatggcccaggtttgtcacagaggccctacttcctaggcgctgctgaacattatgtgattccattaattgtcatatcagagaattgagttatagtgaggaaggctgagtccatattatgtgtcagtgcaaatgagagccagttgaagctttctcagtactacctaagaagaggcctaatggcttctctgtggaagctgcccccaaacagagggcataaatgcagcccaggtgtacttcccgtgctctggcaccagaacatctgtaggaattgttcaaacacattggtgggccccgccctcagagtttgtgatgcagtagattgggagacccaagcatttgcaagttcccacgtgatactgctgccattgatccagggtgcacacgttaagaaccactggcctagcacatttagaagccgtagcaagagaagaatggatggccagttaggcagaattaatgtactggctttggcttttgagtccatatagccacctctgaatttcagctactggaggtagggagaaagagctcatgctccaaatgtgtggactgtttgtgcctatttcatcagttcactgggagaatgggcctgtaagcacttaatgcaaaataatgcctacatgtgctttgaattagaactcttcttcttgttttgtttttcaaatttttaaaaagactagtatgattagttgtatcctgcccgtttaaccactttcacatttcacttttaaaatgaaatcaccctgcttgcatttaactaatggaaacttattcaacctgccaaacaaggttccactatccctgagacaaattttccaaagggctggaaactcaatgcagcttttatacaagaaacagaatggaaatgttcgaatttatgttactttgacacatattttccaaggtttgatatttaagtaatatctattacattgtatctgaaggcattcatttgactctataagacaagtacttaacatttgggataccttttcatcttgcttttaacttccacaagtattatttaagtttatcttgtttataataattttaaatgtttgatacgttattatcatcatcaactaatattaatgagtggtcattatgaaccaaccattgctaattgatttgcaggtgtcatcacgtttaatcatcacttctctgtaaggaggatagttaccattttctctcttttaccaatacttaaactgaggatgataagggattaaataattgtcccaggtccccggctagtaagtggcagaacagttctaggcctgggtaactccaaagcctaactgcttccccactatgttatcacccttatgaaaacacactttttaaagagctttctgtgcttggcaccattcaatattggttctgcccctaaaaccattcaatctaaaatagtcaacatgttaagtacattgactatatgctcatgcataacagctgagcagaataaatatttactctgcgtagaagagaagttttatgaaagggaagtcatgtttatgtgggatagggagacgggtgtgtaatataccttttccttaaaattagggtggatctcagggaggaatattttaggacctccttaaaattgaaacatgaggtcttagtaaaaaatcaggttcaaagggctgattgggtatggaatttactctcatagattttgttgtgggaattgaataggtttgccagaggggataggttctgtactatccagtagaacttcctgagccctacagctgcgctgttgataaaagtgttgggttgtataaaatgttgagttgataaatgtatgggggataaatgcataaaagtggaatgccctacagctgcactgttcagtagggtggccaccagccacatgtggcccttgagcacttaaaatgtgcttagtgcagctgaagaactggatttttaattaattgcaatagccacatgtggacagtggaagacaataggaggattaagtgggaggggaatggaggctgactccctggcacctgtacatggatatagacagaaacttttgtgagacttctggaaggatacttgttatagcaataggaggaaactaagggcagctggaagaggtgtggggtttcagtgaggagatgaccaggacaggcacaggactctgaatagaggcaggaggaggaaagggcagattgagacttcagtgctggggaacacgggaggatttggcagccaacttattgtgggttgaagtacagtgaaggttggcagctacttcaaggcttccagcctagtgatgggggaacagctcctttttgcattgtctaatttgtgctggcataggaatatctagcttgagacaccttgtagacagaatgtgtatcctgaggctgtatcagagaagcaggttggtagatggatcaatttaatgtttgcagagtggtagtatttaattcatgtgcacagatgatattcagagttgtgtgtttgaaaaatagtagagtcagtgtgactggaatggattgaacaaggcagagtgtggtaggaaatgaagttggagaggtaaccttgtaggctctggggctaccaggagctgtgtgggtcgtgtaaaactttgggttatgttctagatgtgatgggaagtctctggaagagttgagaaggagaatgaaggcgcttcattgacccttgaaaatgaccactctgaatgcggcacagagagtaatgaaagagtaagtgaggaggtgggggttcatttaggttgtttcagtacaccaggtgggagaggcggtggctcagacaggatagcagtggcagctgtggagacaagtggttggattctggataaattgtgaaggcagagtcgcctggatttgttgttgaatgagatgtgtggtgtgagagaaagaggggagttgaggatgattccaaagttttgtcctgagcaactgagtggtatcattgactgagatgggaacactgaatgagtaccaggtttccaaacaagataaagttttggacataagctagacatgcccgttagatgtcctagtgaggctgtcgagtaggatttgaacatgtgatcctggagctgtctcatgatttggtgagttgtgacttatttttaaaggaagatttttaaaggaaggaaggagccagaagaggaagagaagctaaatgacaaaagtattcaagagtgagacagaggttttagggagtgggaagttgcaagatcctgttgtggaatggaggagttgacccaggagagaaacacgccattctgcttatactgtcgttgaagctgcaaagctatctttcgaagggatgtgcatcgtgtggggtggtgatcactggaaagaatcccacacttagaggctttgggaacaagaaggagagaaggagtgggccacagagtatttgaggtttagtacctgacgacatagcaactgggtagaagtcaagctataggatgactttgtcgtgtcgcaagtcaattggtgcctgctccttgtgcatgaatgtattttggggccatttaataaaaattgcatgccttggggttgaataacacagtgggaagtgttgactgaaattgtttttgcaagcaggcataagtgtcagaatttaagagaattgtatgctgtaaaaagattattttagaaggaggaactttttctaatttttctcatttgcctgtaagtatttgtcacacaatcatttgcctgcttttataaatgtgggatttctatttacatgtcatatttcatattttcccattaaaatggcacatcttgggtttatttggcatttgttcttagtctacttagacttttaggcattggaatgtttacttttaaaaaaacaagattttctgttattgttactgacttatgatataccactagggcaagataagggcttttgaagaaccgtaagggaatacatattccagagcgtattttcttgaattccacttacctcctctaattcactgatccttacctgccaaagtcaacagaaagaaagtgaatgaaaagaaattaaattgatcagactcacaacttgttggcaattctgataaaagacttgagatagaggatttacatattgttgataaacctttacatcatttattgactcatagtcccctctgtttctgaacctgcatgagtaaccaatagttgcttaaatagataaaattagaattctttccatgggattcctttctgtttataggataggatccccatgttattggctagtgatttttcctttcttgcatttgttggaatggcccattgttgaagatcaacaggcattaatcagtagtgaatcagtcttgcctccttgtcatcttgttatagcagctcctgcgactggactgtggtcatgcctcgtgggttggcagtagggaacaggacttccttcagacactcgtgcttaagcagctgtttctctttctccagaaaacactggtttccccagcccccaactggttcttccctgctgagaagccaaaatatgccaaagtcactgctagaccagttccatcccgtgatagtgcaaatgactccagtgcctttccctcccacccagattttcccaacataagcttttctcctctttgtcaagagcttattctgtcatcttgtttccctttccctataaataatctattttttcccaccagactcacggaacagaggcgtgccccacgttgtatgcttgcactgagcattctttcagcgttctttacttgcttgaccttttagttattttctttcatccctaccgaggtctccaaactgaggtcgtgaaaggtcagagttttaaaaatatatatcaactgaatgcttttcttcagaaaactgagcacctcactttctggatattcgcagaggttccctggtctgcagtgacccttgccacacatttcttcactattttcacttcatggtttagatgccctggtgatagtgaggaactgtaaataagcacggtctgaaagtgtcaggaggagctcagatgatcctgagctctttggtctttctcttggtttagaattcctcaagacctattgtagtgacttcttttactcgactcagaattccagggctttggtgctccttaagtctcagaagaaacgcatggttatggtgtctgtcaacttgctgtttattgaaataccttttattgtaatgcaccaagtaaagacgaggtgatgtgggcactaacttaatgatattacacaaacacacttaattgcacttagggagttcagcatgacattagtgatttcatacagtgaataagtctcttctcttttgtttgacaagttttgttgtcatttaacagatttgcttcatgggaggtaaacttatactttctaaggatgaatgagtgctttgcaactaatgggtcatatgttggaatttaaacatattaaagagttaattcatttcaagaacttactagtaaatatgcactacccacaagagatttttagaataacctcttttgaatgattaatatttatatgtaatcatgtgcatattttatttgagattttcagggtataaatgtcgatgcaatttcctttaataaaggaatgatatatatgagccaaagtagtgatgtattcatcatagataacgtctcactgatttccatttgcccccgaaggcatcccaaatttggaagggccattgttgtttcatcatagactccttggccatgactcttatatagacatctgaggaaatgctgtggcaagtttcttgtacctactttggtaattgtaaaccatccaggaccgtatcctttaggtttaatttatcttgctcctctttgcccctcttttccaagggagggtttagaagatgaattatactcaagagttagtgtttctccagaagatcagaccacaagttgtagaaagcacaccagaactttgcacttctgccctttatcttaattcctagcccatgcttaagccttttaggatctatctacatccacctcacataaccatctagaattctcccaaaatcttgtttcagtagcctgggaatcatggcagttatatctgcatttgtgtgtttcctggccatatagtaaaaatggcaaaagagatttatatggtcaaatccctagcctttccattcctttgctttataaatgaataacagtgatctaaaagcgaaagaatgtagctaaccagtgtcatttgggatcttctgaagtagtacggaaactccacattcttcagaccaacttgcggcatgccagcacattcctctccgatgaggtggaggaatactggtggctggcctgggacttgtaggactggggcggggagctgctgtttaaaaatacatttaattatattccttctctgcagtaacattgataccatttttagcccattacaaatactgtgattttcatttaaatcacgtccattatcttattgacctagtttttattttgtaatcaaaatgttctatttctggatagcctcacccagaatctttttttttttaaaggttacagaccctttgtgcagttttttcctttcgtatctgcgtacagatgggctgcatctgtgttcacacagcagaaaatggtactatattgttccctttaagagtgtgggttttctctacttaatctcggactcttcatggagacacagctggcaagatgccacgagacctcgcatttggtaactgttttggtgaatggatattgggagagttaagtaatcctatttctattcgaaatgagaatcctgattctcttcttccatttttgctctttctctgttcgtctgctagttccctctgtgagccttctctttcctccccgcctctccagccgtccactatgaacctcacgtagccctgtcttcattcatgccctctcgggtgctccctgctgcttgtaagatcccacttatttctggcctttgctttttctacatttctttctctcctgtttccttctttccctcttaccttctcttccttgctgtcagccatgtatttctgcactctggttggaagctcaccctgcaaagaacaccccggaggtgtttccagggctcagctgtttttcactcatgtctaggcagggccttgaggcccctgaggaactttcaactttgccctcaagacttcctcttaatattattattattattattattattattattattattattattattattatttgaggcagagtctcgccctgtcacccagggtggagtgcagtggcgtgatgatctctgctcactgcaacctccatctcccgggttcaagcaattcttctgcctcagcctcctgagtagctgggattacaggtgtgcgccctgacgcccagataatttttgtatttttagtagagacaggatttcacgatgttggccaggctggtcttgaactcctgacctcaagtgatccacccaccttgacctcccaaagtgctgggactacacacatgagccaccgtgcctagcctctcaatattgtttttcactgtccttcttgacacatgaaaataggctgtgcttctcttgaggcaataattggatcagaattttaggatttttgcatgaccagccattttattttgtaggcgaggaagcagaagacctgagaatgacttcccctaagattctgaggcaatggagtggcaggaccaagtcagccaccccatcttccccttcccactatgtggttctcctcttactgccctctgtcttagccggggaatcttacagatgttgcatctggtgcttcctggtgttcatttcttccaaccaccatttgcccttgcaaataccattcggtatgaaagtattttagagcaactgagtcttcagtgtgtcactttattgccaaaagaagacacaaacgatggagtacaatggtaggagtctccggctgggttctcagggattttctcaggaattatgttttgctccaagtcgtttcagttgacgtattcattcctcagaaccggtagatgactatgacatataatacccaagcttgagctctttcctgtctaactggagtctcccttttaatcaggaaaccacatttaaagctgtgtcctgaactctgcccagcatgtcagcttggccaggaaggacagggaattcctactggtagtagccactggggactgagggagtcacgggaggtcagatgggagcttagcaagaaagacagcagcagcacagggtacattcaggctgctaggattgtctttttgtttgcgaaactccctccctggttgaggtcaggaaaaacctaggatagcaaccccctgggccggtgaccccacactaggattttgtgatctaaccatttaaaaaaaattgtttttaattgaggaggtttaacatagtgtttagctttgatcttgagaagtaaggatattaaaaacagcaatgttgagattgtcatgtaatgttacagtcctttcatgaaagaacaggcacttcagaatcagaagtaggaagaataaaatctcagaatgaaggctagtcctctattctgtacacacgtagcttcaggaaaaacttgtactgtgttatccagatatttcctatttagccacaggtcagcaaaaattctatcacagaagcagtgttggtctgtgatacttgggaaccaccagccttcactccatggttggtgcatccctgcccctgtttccaggagcagtgtgcatgaggaagatggcgtaatgacagcacatcagtgcctggctcatatgtcatcagtgctcaggaaattgagttgatttttattctcttagatagtccatatagcagagacataaattaggctggatgaccatttcaggttggatttcaagggacaccgctcttccttggcttttttcatcggagactaggatcttagcctcagctttgcagatctgaagctggatttttatcatgtattttatggatgacctggaaatacttacacgtccaagctcacaggaggctaccccataaacaaaaatatcagctcattattttgcggatgaaagataggctttttcagagaccacattgatggatcagtctgcctcccagtcatatgtccttcccacagctggaggtagggagtggatgctagggtggcaattacggcacacactttccttgaggaacacagaatcagtgcaatggcagttggttgactgagtttattccagtcaagttaaggaagagcccattctacttcattgacattgttttctctttgttgagagacattaaaacatagtggttaagaatatagatccaggagccgggcgcagtggctcacgcctgtaatcccagcactttgggaggctgaggcaggcggatcacctgaggtcgggagttcgagaccagcccgaccaacatggaaaaaccccgtctctactaaaaatacaaaaaaaaaaattagccgggcatggtggcgcatacctgtaatctcagctactcgggaggctgaggcaggagaatcccttgaatctgggaggtggaggttgtgatgagccaagatcatgccattgcactccagcctgggcaataagagcgaaattcagtctcaaaaaacaaaaacaaacaaacaaacaaaaagaatatagatcgggagtcagaatgcttgtgtacaaattcaagccttgcttcttactacttttgtggtattgggcaacttatttcaccaccattttatcatctgtaaatggggataataatatttgcctcataggtttgttttggtgaggaacaacttaagttttggtgaggaacaaacataggtttgttttggtgaggaaaggagttaatacatggaaagtgcttaaaatagtgtttggcatataataaatggcaataaatattaaatattaacatgtaatgttaaataatacttaatattattactaatattaccaaggaagctagttttgtggtggacgtggaaaaacgaacacaaatcagacaggcagaattggttagagtcttaccctttaactttccttactgtagaattcactctccactaacctatggtttccatttgttattcttcattgtttcagtggattttccaactgtgtcactctgtctagattgttctttaatgattacatttagagttgactattccttgttgacatatggagagacgctttgatctgaaaccatcaaaggcttctctctccatgtcacatctttggagaggcttctggtcatggtatgtggacccatgtcagcttctctttctaggtcaccaccttttttggcctttaccccttgagtttgaactttgacttatttagtagtggcaagagaagccccatggctcttgatataccaagtaccaacctgtctgccagatactgaaagatgccgagatacttacacagttgttctttaaaataataagctgcacaaataatagtaaagctgattctgaaactagtttttttgtttgtttgattgtatgttttttgagatggagtctcactgtgttgcccaggctggagggcagtggcgcgatctcggctcactgcaagctccatctcctgggtttacgccattctcctgcctcagcctcccaagtagctgggactacaggtgcccgccaccatgcccagctaattttttgtatttttagtggagacaggatggtctcgatctcctgaccttgtgatccacccgctttggcctctcaaagtgctgggattacaggcgtgagccatgaaacaagctttttatgtgatttctcatattttgccaaaccaatagggcaaagaaaccactgacatgattttttttttttaatttctcctctcccaccccgccggagaaactaaacaactattttacagtggaagccaatagcaaattgactggtattcaggatgccttttgtagaaggcatgcattccatcttatctgtagatatgtctaacacctgtaatatgatcatttttcaatttcctcactaaactcacagtgataaattacagttaatattggccattaaaatattctactgtaaaatattccaggtaccttggccactgaagcaaattaatccatctaccacctatctgtgacataatgagaaatttaaaatgataatcagctgaaactttccttctgtaagtaacactgtcaattcctacatcgaagaattttttcttaaagctctattgccttcccatctcttcaaggacaggtgtttattccttgactcctatatcactttccactccagctagaattaacgatgtaattgggctgtttacttattttttttgttcatcgccagatgagaagtcagagggttctcccaccagatgctaagtttctgagaagagaagaggtagtaggctagaagcactgactgtttccagctttgcagtcaaggttttctactaaagagtattgcatcctgttgtcaagactgtgttgggttttctgcttaaggcatggacatctctctggtcttctgcagtgatgtggtccatgtaaaatgaccagcagtctcctttctaggggtcagctgtgctgtgtaagtggaaattaagattttcatatagggaccgtccacatcagccaatgaagagccactcacccttccactaatcctctggaggtgagactgtcctatttggggtctactttgcatttgttgggcctggatagtctaaagactacttgtttgtgagatcccatctatcccaggatctgaggctctgtaggtgtgaaaatatctttaacagccacagagcagctcaactttaggttctaggaccttgtagtcaagaatgttcatgaattgaactccacgaagtagatgttagagaagttttaaaagagaatgtggccggccgtggtggctgacgcctgtaattccagcactttgggaaagtcgaggcaggcagatcacttgaggtcaggactttgagaccagcctggccaacatggcgaaaccccgtcaccacaaaaaaatataaaaattagccaggtgtggtgtcaggtgcccataatcccagctactcgggaggctgagacatgagaattgcttgaacccaggaggtggaggttgcattgagccaagatcgtgccagcacactccagcctgggtgacagagcacaactgtgtctcaaaaaataaaaagagcatgtaactatttggctttccaaataattgtgtaaggccaaggtatcagaccacccagacctcctcacactggctcagtgacccccttgtaagacaggtgctgtgctatattctcctgcagggcctcagccagcctcaaaattttgaccttcttttctgaacaaatgaccactgagtcccacctctagctaggcccccatcctaagcatgggacccgtatgtccaaaagcttgtctgacatcctgctccaagtagccagctggcctcatcacagtcaacttgtgcaacaggagcctcttccttacccagccactgtcattgacttctctgtgccactgggatattcccacagtcactctggctgagcaccttggaacttctccgaataccgtgtccactgagtctccaaatgagggtcattccatctccccagtgttcctccaagcctctctactcatttcccatcctaacgtccttactcttcaccctcttgcatagcctcgtattactattgtcactcattagaagtcaggctgaggattcgagcatgcccgtggctgggcaccttttccacgctttgtggggggcagaagaatcagggccaggcttgtgcttaggcaggataacctggccaagtaacctggcctctctgagattcagtttgcacacctgtaaatcaagaatgcctggctcacagggcccttgagggcttgatgtcataaggaagaaatcaggcaaggaaggaaatagacaaaacctggaatccagtactatatcctgtttctgactgctagtaatattaaaaggatatgtgttttcttggtcccttacagaggtttccccagcctttttttatgcccagacacaggctaacatttgttgaagacactagggttacccagctatcctgggtcttgctcggctgcttgaggactgatgagatcaaaatctctatgggtgtggaatgcatttgaaatacatcatagttggggactcagtctcacagttcctgagcaatatgccatcttcccttggtggtatccattcattcttatcagagctctgtgtgtgtgtgtgcgtgcgcacgcacacacatgtccgtctgtctctctttttggtttgtttggtttcgcagtgtgggttttttgtttttggtttctgagggattttgattatttgttgctcttacataaccttcttttacctggacaatgaataatcagtcatcaaatgactcctcatcctgtgtctcattcttcagcaaatatttactgtggttattctacgtgatgctttgggggaacaaaggtagatgaatatgtctcctccccaacctcaggtgctgatagtcatgaggtataatgtgaaacctaaaaatgagggggaagagccaaggagcccagctgttggagtgtggggtaaccctgaactctggaaatttagtttggaaactacttgtgctgcaacattacctggccaacctcagaaccctgtacaatagcacacccagagacagagttttggtggcctatggcctgatgtcctcactgtgggtcatgggggcttggtgctgggtggcgagggagaagtcaaacaggccttttgattagccgagcatggtggcgcatgcctgtaatcccagctactcaggaggctgaggcaggaaaattgcgtgaacccgggaggcggaggttgcagtgagccgagatcgccccactgcactctagcttggcaacagagcgagactccgtctcagaaaaaaaaaaaaaagggccttttgtcaatcatcattctcttgtttcaggggtttggtgtatctaatctcccagacatcaatgatacctaaagtcttctttctacggtgctgtgttgttcacaacttgccttatttcctttcatcctcataggaacatgggaagtaggcattatttttattttctccatattttaattgaggaaaccaagaatcctctgagaagctaggtagggtagcttgtcccagagagtaatgggccagggacataagccagcccaggcagttgtcactcaaccatccgcttctctggaggtccatttgccccagcataaagttttgtcacaaagtcacttcagtgtgcaaagagaaagtttcccctaatactgatgggacacttatccccttgtggggagcaggagtccaaggagctttgagtttccagaagaggaggatgacaggtcaggaaagactggagacagactttcttgatgctaccagtggtgaagaatccagtcatcacaactcatttgccagcttggctgactttgacatttgctgtgctctggatggaaggactggagaagacatcaacttgaaagtttaaaaaaaaagagagagactgtctagaatctgattatgtgttttaacagcagcccccttgaaccacatttacacagctattttacaaagtgagatccgtgcataattttccaccaacaactttggatggcttccattagacttggtatccaagcatatccctccagtcctgtcagccacagaattgtttgcctgttaacatctgaatttctgtgtgtaatcattgcattgagagctcagggaagccagttaatcatacactattcaggcatctttttagttctctggagggtttttccacctatggacttgatcagtgaagtcctgtttcatgaatggtgtgaacataatagagtgaaaggcactgcggactttaagtcagaacaccgaagttcttgacctcgggcaaatcacttgttttttccaagcctcaatttccttatctgtcaagcaagatcataaagtagctttaagaattttagaagtgctttataaatagaaaagtgtgattcaaatctcatcttttggtccacatgcatttttatatctaggacaatgatataactttacttaccttgacttattagattaacataatacagaacaaaaattctttttcatacctatattttagatacataatgtggattctatagatttctttgatgcctttttattcccaaagagttcgaagctgtgcccctggtatgcctgctgtatttataagtctgtgattggttagtcagttggttagaacagagggctaattagcagattaaagcaagcccctaaagtagacccttgaggaatctgctattccagagtctcctattctgtgaagatagttcccgtcctagttaatgccagcatttggatctgtggtctgtgcattaacctcaatccttatcgaaccttctagtgtgggtcatggattccttctttgtgcatgcaagttggctttgtgactattccacagtcacagatcacacccagagattcagccgactattcccggatatctgatgtttgttgcaaaaaggttagtgggagcgtgtggatgacttgccccaaacccatccccactactggagaaacacctctacatggcctgaagcatctctgttctgaggacagccctttacattaacaattgtttaccaggtgccgaatgcttatcatctgagagagcagaactcacaggtgtgcaggctaggtaacaggaatatatgcttgaaagcagtgctttatccactatctggaaaaaaaaaaatatgttgagcaggtattgagattggcagccgccattcacacaaagaagagccaagagcaaggggctgggagccagagaaggtgatcagatttggcaggtagaggtgactctcagacacagggacactcagggcctttttactgcagctacatgtgggagctctcacctgaagttcttcaaacatgtctctctctggaaggggttttgatcgcttagttacagatggaaaactccagcatagttaaggtagatgacctagtcagcccagagatcaatggcagattgaaataacacctgtggatattttgctccatttagatgagacttgaagggatagaggtccacagggagctgagattgaggctgtgcctttctcttgtttcacattaaagagtgtatgattattgtacttattggcagagagactcctactggatgggacacttattttttttttttttcattttttttttcctgagacggagtcttgctttgttgcccaggctggagtgcagtggcactatctcagctcactgcaacctccacctcccaggttcaagcgattctcatgcctcagcctcccaagtaactgggactacaggtgcatgcccccacacctgggtaacttttgtattttttttttagtagagacagggtttcaccatgttgaccaagctgttcttgaactcctgacctcaagtgatctacttgcctccgcctcccaaagtgctgggattacttcctgagccactgcacccagcctgagtgggacacttattgatgtcttacatccgtcacaagggagggtccttgtggccacctttggctccctcagcacagggtgtggggctgctatggccctgcgattcctacacggtctgcacaccccacgttgacccccagagaggtcttggacaccaaaggggatgccctgggaagttctgccagggtttcctgtgctgctgggctgctccctgcactgggcagtaaaccaaaggtcacagactctgcagacgtacagcctttgttgcacagtggaagtcccagaccacaggggtccaagttaattaatcacactggggaaactactccattgaagttggacataacaggatgagagagaagtgactgaaactgattaagaatgggcttaactgaagagctaagctgcctcaaatccttcatggaagttgacaggatgtaaataataaattataaataaacaaaatgtaagagctaaataaagttccattaaatataccatccctcacagatgcaaatgtttcaaggtggaattagctaacttgtgcttgacattgagagcggatccaacctcagatacttttcatccaagtatttttatccaagccctatagagtagcaataatgagtaaaatgatagaccgcggtctaaagtactgaaccaaggcaactaagctgatttttcaacccagcctgaacttgagggattaaagttttttagtcaaaagatcttaagacacaacgtgaaccttcgcaccacatgaagcatgagttccgtcaggtaagtatacattcttccttataatttttctctacttagcttgactacttttttttctgtcctatttgtagcattgtactgcaccttaggaggggatttatccaatagtcagtgagacaaaaactgagcaaacaaaattactcttccaatccctagaaaggcagcaggttagagactgttaggtctcacgtggtcattttttcccctacattattggaatagataattagctctttctttggttgaacctaggggaggtactgtgggagctcacttaatccatctgccagttaacatgttctctctcttccctgtgaatgagcgcaccaacctctatctatggcagtcagttaatgggctgctctccagtgagccatcccacccatcccatcagctcagttgggggcctgttgagagtatgtgctcccaaacctaagtatgccagttgtacttattctaagacatgtagctaagtaacgtttaaacaaatgaaatatgagtgggagaaggagagctgtctcgaaaattatattgttgccttgaaaagacttgttaatgatgaatttgctaaaaaataaattgaggccaaattaaatacaaacaagataactctaaaagattgaggagaaagtcaaaaatctaggcagattctgtggtcagatggcttttcagttgcctttgggttttttttctcttctttaaagaaagagaacctgaaaatcatagcaaatttcctggtttatacaggaaagataattaggaattccagacagtggacccatcttcaaagataaggcatggcccctgtacttctaccaagtttgagatgagtatacacttatagtttggattaaggatgtcttttgtaggggcggcagccggctgcgttgtataaagtatacctgtctaatgagcatataaagatgctgtcactcaacaggttaccagagaactgagccaggctgaggagcgcgcagacacacatcgcccttgacatgctcatcgggacacagaccaattgagggaaactgggcagaaccatctttacactttctcacaaatgcacttcctccctctctccccacttccttctcttcctcctgtcccccaccccctctcttcttctctctccttcttactccctaagcaatgtagttgagttcaaagaacttaatgctcctatgatgtgactctgaaataaacagggagaaaccatttggagttgaccaacagagtatatttcaaagtacttgttccatggaagatctgatctttggctttaaaaagttttaaatatgtttaattatgtgaatccaacacacacacacacacacacacacacacacacacacacacttccttaaaataataagctttaattttttaaagtgtgacttaacattagatagttcaggaaaacacttatttctcctaaagtgagatcaggttgtagtgaaacaaatcttatttgaagtgtcctaaaatacagtgtgttttaagttgttttctgttctctttggtccaaaaacattttgcaaagaccttcctctgtctctgtgtcgtgtctagattctatagtggagcacaaacaactgcaggaaaaaatgtgagagtgcctgtagatactggaacatgttaacagaggtatttgagaaccctcaggaagaataacattttacagtgaggtgattgttatctttaacaataaaagccatatgaatgtgctataattaaggctaatgtggaatgcttaaaatcataaaacaggtatgatcattggattcctattcacccagggaatgcagatcccaaagataagtatgccggaacatgaactttgtgagaaaacaggaatccacccacctccaataaacaagagactgtccttcatttcagttatagctcttcagggtttaatttggatagatgtgaggtgttttattctagagcataaactagatgcttctttcaagttaatggggagcaactgatggctactggattaactagaaaagaaatgttcctctctgcagttctggacaataccacaatttaatgacattttacctgagtggacttttaagaaggatagatttgtcttttgcctgtcagggcatagatccaaattcagagcagatggtgggaaagatgaatggccacagagatctccaggtagaattggttggatttcctcaatcctcattaattcctgattgatagtcatccatctccatcttctctaaccatccctaatgaaccctgatttctgaggattttctgggtctagaataactaaaatgtgctgacttaaacccagaacagataagataactacctgcctgatgtttcaggcttttgaaagaaaggggcttgtctcaacctgaaaccccattttccttacgtttagcaataatacagtcatggattttctgttctgataataaagagacacaaatgggcaggatgtgaaccccaaagctcagggagagtgtttaagagacaaattgcttctatgttgttcaggtaaaacctagtaaaagagagactttttggttcttagattgtctggcaagagactctaagccatccttgaccaagcaggactgacagggtgtcaccccagctatgggaatgaggcataagaagaagcacatgattgtggggaaatcccagaagtgttctgggccactgaggtgaagagagggccccaagatcagtggaaggagggacccagaggaagtactggatatagcaaagctacatggatttaaaacaatgcctgtgtgggcgtcttgattagtggcctgatattcctcattacttccatattagggcaggcttagtgacatacagttgtccctccatatacaccagggtattggctctgggaccccctggatacccatatccatacatactgaagtgcttcagttggccctgcagaacccacctataggaaaagtcggccctccatatgtgtggatttcatgtcctgcaaacacggtattttcaatctgtgtttggttgaataaatccgagtataagtggccctgcgcatttcaaacccttgttcaagagtcaactgtaattgtttttgcttatcctggccattctcctgctaaccaatttatattattattttgattataattgtattagctcccattctgagccagatgccatcagcttataaatagcatgtattgtcagagacacttaactgagaagacaaatgattcccatttaggatgggaatttttgtgcaattgacagggagcattaaccctttgattaccataagcctatagacacataggtacccccaaatgttggaggaatggcacaagctagcaaaccaaacactgtcaaatcatgggagcttaagaccctggaagaaagtgcccaggagatggactcttagttttaagaaaagttaaataagtgtaacatttttggtggtccttttcttcacttgagcagaatgacaatattttactagtccaccaagaaagaaatcgagatttaaaccaacttctcaccttttgtgcaaggcctaacctcagtagctattaaaaataaatgggatttaaatagatgcagaagcacctatttaatttttaatttcacgctcttgtattttgcagagcaattttaggtcagcttgtgagggctggttgaggggaaaacagccctaagagacagctgggagagaaacaggttttcaagtgcaagacaaagtcgttagctcagggttcagctgttaccaactctgcaagtgacctcagctcaatatccttatcttgaaaatggaaatgataatgcttactgtgtctttatgagatgtgatggtatccatgattggtggctttgagctgaaagtttgagggtggaacttctcttttcttccctaggggtctccatgtttgtaggtcaaagttccaggtacagggaaggcattggctttgctctgtcctgtgtctgtgcctttgttacacatggtgaccaggacagtcagccacagtgtccagttaccctgggtcatctcattgaagagccaaggagaggcaaatgtcattcttccacatcctgctattcacctgggatcaccagcctctctgttgccttctccctgtcacccagggcgagtgacttgtggggacggctctgtggaacccttctctctcttgctgtcatgtgcaatttgtttcaccagtaactcaggtggatagtaatttttcaatcacagcttatctcacaccctttactttattttctgggtcctgcttactgagtctttaccacacaccatgcattcatgcttagcctttgcttatgttgtcttctttttaaatggagagaactgtggacaagagaggttacgtgagcgccccagactggacagctgttcagtggtgggcctgcctgcctcgggagccctgagggcctcaccctctgtttctcatgccttcctggcacagttgtcttccagctgttctctccaccccggccctcccgcaggctgccaccagatgcatctccacacactgccgttctgatcggatttccgcctcaaaaactgcccattgttttataacacaccagccctctacaagttgaccttgtgagtttttgtccctcctgctttcccaaaaccagttctcagatacagccccatgttctgtggcctagttcctacatacaacttgtgcctttgcacagtacctttcctctacttgaaacagcctctcttcacctccatctcccaatctccaagccatcctcgagggccgagcacaaattctgggtctctgatgccttctaggactggcccaactcgaagccatttctctccccttggagtttagggggtacttatcatagaatcgctcagatggcatgatatgtgaggcctggcagtgaacttattttctatttgtcaagatcccctaaaaggatcttggagtttacaggtgagaaagccacagaggggttaatgacagtattgggaccagcgtccagtttccccaaatgccagactggtgattttttctactgtagctttctatctctgtccttacttgggcaaagactacatcctgtctgtatttatttgtattagctagtggatattcaataaacatttgtagaaaccaaggaaaagaaagaagataggaaggaaaaaaaatgctagttaacacctatgtggcacttactgttttaatttaatcccccttctggttttcttcctataacatccttatgacatagatactattctcatcatctctattttacaggtgaggagaccgaggcaagagaggttaagtaacttgcctaaagtcacaaagctggtgagtgacacagttgggtgtgaagccagggagtctgactcctgagtccatgttcttctctctccaccatatcactctgcagggtcaagaaggaatgacagacagggaactctgaaatgttcacaaagaaggctgaacctccaatcagtgcccgaggccatagagcagaggacatttaggttaggctaccatgctttatcttcctttaatttaaattgaggagaaataccaccattaagccattcgtgggagaaggaggcgcagccacagggctgtggagtcagtagctacagcttggatcatcatgaagctctctgaacccttgacccacattttctcccttacatcctactcattagaggagacacagctaaggtactgttcagtggttcacatgccccagcctggagcccgttagagaaggggaagctgctgctgtcctccttggaggctctccctgagcacctgctttccacggaatgctcaggaaagaaaaaagtcacagggttgaaatgtgtaccgaatgtgtcaagtttggctgaaacaagctgataaagaatatttaaggagagctttatttttagaagcaacgcttctttcttttttttttttttttttttttagagagagacaggatcgcactctgttgcccaggctggctggagtgcagtggtgcgatcatcgctcactgcagccctgaactcctaggctcaagcagtcctcctgcctcagcctcccaagtagctaggaccacaggcgtgcaccactacgcccggctagcactcctttctttagtccactgttggtgttggtttttaactaggcccccactaggtattgctgttcctgcctataattagcacctcttttctctcacacacagaaaagtctgtcttaaacatattgtgagcttcagagcatgttaaagaaagttgtctgtcgcttagtagcatggaaagatgacgttgccagcatgcagggaacgctttgcaccaagaatcccggagtgaatcgaataatattccagattctatgaatcagagctgaatcatgtttaagtgtatgctgcgttttgagggattcccttctgcccccccagccccctggggtgaaaagcactgcttttcctgtgtaaagaaaaaacgttcacacccagaccagtgaaatgtttttgtggccacgttgtgaacgcactgagtgtttgttgtggcccaactaagacaactttatagattaatgaagagtgatgtatcctttcttccgaacagaacatttagttctcgctctgcctgtctgaccccaagcaagtctgtctggccccatccctcattccccgcccccatctgcaccaccctcttgtaaatctcttagtacatttttgtgatcgccgtccagtctgttcctaggcattaaggactctctgagctttgtgaaagtaggttaccgttcatctggtttcttggaagaaatgtgcatgtgtaagggtagcttttcacataaaagaccaaaaccacgaaatccaggaagccaagaatgaatgggcccaggtgacttgcctttcttaactcttacagaaagcgaagctccttcagggctaagaaaggcattgctgtgtagaggacggagccagacgaagcctgggggaggcagaactgggttcaagcctcagcattatgttttaccagcttttgacctcggccaaatgacttaacttttctgaatcacaattcccatctgtaaaataaggataataaagcctggcttgtaggcttattgaaagaattacaaatataggatataaagtgcctagcacgtggtatgtgattgatggtagctgttgttattgctgcaattgttgtcttcatatcattgttaccacctctacaagtagctcttgtatgtggagggaacagaggagaacttaactgctgttgcctcccatgctcataagacatagctttgaccttcaagactacctgcattccttaccaatagcagctaaaattgctcctaaaacaacaaaagtaaatataaacattgcagccacatagagatgaacacaaagaaggaagtgttcctcattccagcaggagatcccttagctgagtgaattctttttcccctccttccaccgataaatattgacaggcacccaccgaggatgtgcagagctcaggcgtggctgaggggacccaagttgaatcagacatggattctgtcttcaagaagcttaccatctgccaggaaagatgaaaaatgaaagataagtgtggcgaaagtgaggcagaaaatggttagatcgtaagagaaagatcactgaagggctctggaacttggaaggaaaaagtaattttagctggagttgggacatgggagttttatggaagaggcagcccagcccagcagcatcactgttagggacacagattctggggtttgaaccttggctttactacttatttgttgtggcttcttgtgcaagctaggtcccatctccatgcttctgcttcctcatctttgaaatctggataataatagtacctaggggtgttgtaaggattaagtgagatatggaaagtgcttagaacagcacctagtgagtgcaatgggagtgattgttaaatgagtttgtcaaaggacaggtatagatttggccttcaaggagaggtgggcagtgtttgtccaggaggaagcacagccaaggcagaggctgggctgagtgaggcacagggttagagaaggtgagaggtgcagagggcagcttgggacaagtgtcaggcctagaatcttggactttactgaacacgtggaacgaactcagtcttccagaattctgtagtgggtgtgtgtgaagcctgaatctgaacctgtctcagagtaggtttctacatctcagtgccagtgaatgtggcaatgaaccagctgccagcaggcatgaaatcaaagcttggattatcagggctcaacgcataggcctgaattgacacctcagggaagaggtgcgacagggccctagcaggaagctgaactttggggcaagagaaggggtggtgctgcagaggcattggggtgggggcaggaatggagagtagtgttagggggagattgggagatggggagaaggaaaatgtcacaccattacccccatctactgcttccttttctgtttatagtgtttttttttttttttttttcttcagggtatagtcagccattctgctttggaatttgtttttgtttttaatttaaatttatttttttttgagatggggtcttgccttgttgcccaggctggactggaacccctgggttcaagcgattctcccacttcagcttttggagtagctgggagtacgggcatatgccaccacatccagctgttttttttgtgtttttttccctcttttaaattttttcgagccttgggatgcctgtcagccacttaaatgcagtcatctttactcttcctaagcgcagaagggtgtacgagggtggagggaaggtgggaagattaaaaccaaccgtgggagactattttcagtcatctgcagacgtctcactttgtcatgatgtggaatctgtcactctctgcctcctcttctacctatctatagctggaattccgtaagacttcagaaaaggctgactaaggttcacagggcccctgagagggtgccctgtcatcctgggatttgttttccaaattaaaaattggaggatttgaacactaggtttgatctgcttttaactttagctgcataaaggttatcatgaattttttttaaatctaacttattagacaagaatagtattattttttaagggttataaggatgtagggcaatttctaagaccacatgtaagtcatttaaaattctttttggtacaaggtagcatgtaaataagtctatgtatgtactaaatcaagatcaattaccataaaatgtctgtctgtaacatgggaacaatgaaatgatgaagtgcaactgtaaagtaatttgttgctctgaaaccagctatgcatcttcccacgaagtgactaagagtgaaatatcaccgtgttaacagttaggagagtgattttctggcccaagatacattttgccggcattagagactcaccggaagagatcttgaatgatctccagagaggtacctgggaccctttctcgaaggttaccttgcaggcttggaaggtagacaagcatatttgtaaatgatgggaagtatttgctgatttgggctttaaaggaatttactttcatattcctccagtggctcttttccagagcactataatccatgcttggaaactattctttatccatcatatccttgctgaagagtaaagtttgccccacagctgtctgacagccaagtcaccccaatttcaatgggagcagcacatgtttgtccagagctagaatttggctctttcacgctcaggcctaaagggcctgtttaatatattatgtaagaaagaatgagatcatataaatagtcctggctcctaccttgcaccaaaagtcatccttatttggtgcttccaaagttagaaaacaatacaggcaataaaaacattctcaggatcatgaataaataatggctaccttgtactcaaccatgggttttgtgacggcagcgtcagcatagcgggctgcctgctgcttttagcactggaaatttggactggtttcatttaacctctcagctgcttagaaggaacactctggaagtccactgaattctcacctgctttcgggatgcccaggcatcactgggacaaagctgtctaccgaagccctgggtcctgtgggcaggggtgggagggctctgcagcccttaggagggagcagcagcccagccccagcaggccatctacagggccttaggcagctgagtctaagaagagagagcctagcacttcttccggtcatcttattgactgagctgaagggagatcaaatttcggtcttctgtctgtgtaaatagtaatggctatcgctcttaaacttcagacctcagctcatggatctggattggtttatttttgagagctgaactctggaggccactcttccctactttctgaagcgtttgatgcctctatctgagcatggaacctactctgagtcatcagacgccacgcttagggcacatagaattaagtcgggggagtgatgaaaattcattcacttctctcctctgggacctaaatccattttagcattccacttgaatccaacaaggaatgccaaaatattaaagtgtggcattctcattcttttctctggaaagaagtgtttatgcaaaggaggcctaggtccctgcagagtcggcaagaagcctggcaagaggtttgtctcatttaagcagtaaatatattcagtggcagcagagatactgccaagtaagtttattccatttttagggagggaagggcaggagttttgctgctcctttaagttgctttttgcttttaaattttttgcatgaggttctctaaaaaagtaagactgtaaaagcagcttgttcaaaacttgacctcttcggcatgcccaagaatttgtgaaacaaaagagaaggcaatggataattgattctgttctctaaaggcccttctgacactggtcaggtactggtgtggtttctactggtgtagaaactggtgtagatactggtgtagatactggtgtggtttctactggtgtggtttctaccatgcaggcgtttagtctctgccagcaggaggacacagatggtgtctacctttctacagatgtctttaaatgtcaaagacatgagaagagaatctattgacattcttatcattgtgacaatgtggtagatcccttagcattacctatgccctaaatgatactcaaataagtgggctagggaaagattttattttatttttgagacagggtctcactctgtcacccaggctgtagtgcagtggcatgatcacggctcacagcagcctcaacctcctggaaatcaagtgatcctcccacctcagcctcttgagtactgggaatattaggcccgtgccatgatgcccagcgaattttgaaatttattttttgtagagatgaggtctcactgtgttgcccaggctgctctcgagctcccaggttcaaacgatcgtcccacctcagtcttccaaagtgctgggattacaggtgtgagccactgtggttggctcagtagggagagattttaaaagaaagcagaaggccaggcatggtggctcgcgcctgtaatccaagcactttgggaggctgaggcgggtggatcacctgaggtcaggagttcgagaccagcttggccaacctggtgaaaccccgtctctactaaaaatataaaaattagccgggcgtggtggcgggcgcctgtaatcccagttactcaggaggctgaggcaggagaatcacttgaacctaggaggtggaggttgcagtgagccgagattgtgccattgcactctagcctgggcaacaagagtgaaactccgtctccaaaaaaaaaaaaaaaaaaaaggcagagaatcccctaccatggagagcagcttattttatgaccaacaagtcacagaacctttgaaatttttgcttgagagtcaaactttaaacttattccttagctatgctttaggtctgactaagcaatagtgtaaggacatgagaaacaatgttgcagcaggggagagcttcaaagtctttactttgttactaaatgtgagatttaggaactgtgtgatttaattgaagtgattgcttctggtagaattcaatagagttgtcatatcaaattaagttttatcgagtttcaccagatagggatattcactagcctgaataccaacacagtatgtgctcaccacatttttgaaagtgaggcgagagtcaccctgcagtacaaatgagcttgccataattggcctgttttaatactctgtggttatggggacatcagagctcccatgaacaagtgagaggtttgttaggaagatctcacggtagagagtccttgctcgtgaggtttggaaaactcagttcttcagtcagtgtcttgcacaggcacaaaccttagcctaaatatagaaggctaaaaaagaatccttccacgggagggctcccttaaattagctcagttaatctattcatctgtgtgtgctgactcgtgcctaaacattagaggccaaatccaaaaaaagaaaaagcaaggccgcgactcaatactaagaaagatggagaacaactgagtatgatcctgtacaaaggagcccctgaataccacagcagctccatgttcgatctgagatgtactggctcctgacagtcaccctaactacttcacctctcattttggtattaaaagtgcctttggcgtattcagatatctccatttttcatggttgtactcagttttcaaatcatcctatggtattggtttcaaacaagatcagaagttctaaaaagatgttaaccattttatgcttttagtactttcctttcttttcttttttcttttcttttctttgagacagagtcttgctctatcacccaggctggagtgcagtggcacaatcttgcttggctcactgtaacctccgcctcccaagttcaagcgattctcctgcctcagtctcctgagtagctggggctacaggcacgagccaccacacccagctaatttttttttttttatttctagtaaagacagggtttcaccatgttggcaaggctggtctcaaactcctgacctcaggtgttccacccgcctcagcctcccagagtgctgggattacaggcgtgaaccactgtgcctattctgcttttagttctttcagtatatttccaccttgccaggaaattgctagccttctaatattgctgatttctttatttagtaggtggtccaggatgacaatgctttaggccttcatctcataaacacagtaagcaattctcaagaacgtgtagggttaaagagatttggactccaatttccaaaaccgaaatggcagcagggaacatgacaggatgcagaagagatcctcgcagtctagagccttgcattatgcattttgcttcccactgaagccagagatccatttttatagtcaggtttgttgttcctgctgaaacacggcacatgctctgcctgaattctggccatgtgtttccgtcgtttagttatctaacttgttatctcctgacttcccatttctctgtgaaagtcaggtggtgtaagacacccaaagaagaaaatcaggaaaggagaaggtgtttggaagtggttcagaggtagtgttctctgtgttaagggggctgtgggactgtccttgaaaagctatttttgatcctagcagttttactacactttgtaatgtttgggcaaccaaattggtcatggtgttagaatccttataattgggtggatctatgttattttgctatcttcagagaaatgaattttatgaatatttctgttttaaaagaacaaaacagcagcaaaaaccaatccctattaccctaactcctccacgcacatagtattctaatgtggtttattcctgaaactgactcattcagctttctcctggaagttgtcagaatgtacgcctggttaatggagaaaatcagtgcactgcccaggctgcacaatgccatgactcattcctggcatttcagaggctttgtaatggaaatcgtagttccaagctacggttcttaccaagtggatatgtgaatgttaatgaaacaaagcaaaagtctccgaggatcctgcataactctcaccatagatgtggtgtttgcttgatgaaatgaagatttttgtggggcagattgttcctctccataacccacacattctcgaataccacaatattgttttaattagtcttataaaacatagtaaaatatttggctttgaagaaagaggaacattctctcctatgttggaattgtttggttaaaagggcatttttttctattgaattagtcttttggggtttacactagtatctgaatcctttctaaatagcttctaatgttcttcagcaatttgcattcattcattctgtctgtctgtctatcaatcgtaaaggaaaagaaatatctttctttcccaacactaggttcgtggctgaggctcctacaacaaaagacagattttaacaagagaaaagcatacaaattaattcaaatataagttttgcatgacatgggaggcttcagaaaagaagacccaaagaaacagagaaatctgcatattttatgcttaggtttgataaagaatgcacagttgtgcagaagtatgattgggggacaaaaggatgtgatctaatggtaataaacttaagggagtttagcaaggcctgtttgttcagattcttcttggcatctctgtgtcgttaaaaataaggatgttcctttcctccaggtacagggagggtacctctagaatgaaggttttatgacctgcctcaggggagaagggaggagaatttaaaagtgaccttcctaattctgctgttttctctaataccaatgtgtcgtattttgggcagtcaccatttgtgtgtgtgtgtgtgtgtgtgtgtgtgtgtgtgtgtgtgtgtgtgtgtgtgtgtgtgtgtgtgtgtgtgtgtgtgtgtgtgtaggtcaggtggggaggggtatggaatatatgatcttttttttttttttttgagacggagtctcgctctttcgcccaggccggagtgcagcggcgcgatcacggctcactgcaagctccgcctcccgggttcacgccattctcctgcctcagcctcctgagtagctgggactacaggcgcccgccatcgcttccggctaattttttgcatttttagtagagacggggtttcaccgtgttagccaggatggtctcgatctcctgacctcgtgatccgcccgcctcggcctcccaaagtgctgggattacaggcgtgagccaccgcgcccggcctgatctttagggaaagcatggataattgaaaccctgcataatcccagccttttatgctaccttcttgtggactcgatcttgtctccaaacttcattcaaatgccattcctctttctctgtgctatgtaaggtttaaaaatagtaaatagccaagagatagcagggagaagtgggggaaacaaggaagacagacagtttgaacacttatgttttattgactcggatttggattttgtttatgacagactagtaggactttggggaaactcgcagataagctgggtttttttctatcatttttggagattatagcaggaggtcaaatatttaaagttgttttgggtgattctaatgtgtctacaatgcattggaccaggaatattctggagctgctagaaagcagacatttagaagcaagagaagagcatgagcagtatcccttatcacttagccacttgattctgatcctggcttctctaacaatagctccttgctatgtgctcttaaaacacaagtgctaatattatgagaaatgaattatatgaaaaacagtctagtcttttctaaaaatgccaaaaataccaatctgcaaccaagaacgtgtaagcatgttctcccctttccagatgatgcgggatgccaggcaaagaccaagtttccatggctaccctgaggcctgcatggaagtggaggccttagtttataggagtgaaggtctttaaatgagggcatccaaagtgaatgcctatcattatcccagtactaagtctttagatgcacaaaccattgttttccatgtcatcctttggaagtggcgggtgatggaagaccattttgtgtatttttaataggaggaaactgaggcacaagagattacattcccagagctagaaccaagtgctgtgtccctgaggtcctgtctgcaattgggagacaactctgaactgaccccttttgcattcctggtctctgcacagtaactcttccctctgctcatcaaatccatttcagaatgtgtatacagtaatacttctgtttgaaagtcttcaagatttgacaagaggattctgtctgggcctaagataggacatgatgggatagtgacctcgaggatttggaagccaaatgatcgtggacaggtgtgtgcatcaagaaaagatggagcatgtgtgctcacagtcctaccggggccacactcccttatcttcagatcatgggtggctcatgcccaattccccccaccatttattcccttgttgtgtctgttggaaaaatctcacaggcttgcctgaggtcactacatttttctttatacagaaatcttttcttaggcttcatgtagttgtagactaagaactatataagtgaaaattaacagtattggttttaatacaattgccagattttctatttgaaaaaagtcactgctcagaaaataaaaattattaaaacaacccatggtgaattgggcctgaattgccactcattttttaacacatctgcagtggagttgcttcttaccaatgtggtgtaattttcaggtctgttactgaaagacagattgagtatgtttctggactgtgagtagatgatgtttagggttgcaatatgggtattggggctattcttttcctgtgtcattactttttgataggtttgttttaagagaaaattaatgaaattgaagttacttaagtttggccgtatttgttaaatatccttttctgagaaattgaaaagtgactattagttgaaacaagatcaagaaacttccagcatatttcagcacattcctcagtttataatgttaaggttttaagaaagcttaaagaaaccagcatcactggtagttaagcggtttatatttttactgtattttcttcagaagcttgttgccatgtagagtaaaagaaacctcatgttaatcttttcagaggacactgccagtaagagtgttgttattgttagataatcataatggtatgttctggagtctcttctcccctcactcgacacacccgattcactcccaccctgccagcggagccagagagagaagaataaagcaggatcttatttgctttcagaatttgattctgtattgctttggagacatgctgggatttgttcttaaactattattaaatttctaatgtccgtcaaggtttagattcctttgtaagagaaccaagaacgtaagtgaaactgtaaggcttcgctgtgcagacctttcttccagcaagcatcagcttaacctcagcagtgaaccgatgggggaccagctgttgggctgggaaccaggagtaaggctgcagaaagaccccccctccagccccccagccccccaaccccccaaccgtgtgtcacttcaccacgatgagcctcagtttcctcaccacagtcccacttgtcttgcatttgagatgtgataatgtttagaaagagatcttgcccacttttgaaaaaagtactccacagatgatagatactaatcagacatgaaagcagagattaaataggtaaatgtgattgtgtgtgtgtgtattgatcattatgctcatgagacactgattattttactttatttatttttctttttggagatgcggactcgctctgttacccaggctggagtatagtggcatgatcatggctcatagcagccttgaactccctgactcaagcaattctaccaccttggcctcctgagtaactgggactacaggcatgcactactatgcccagctaatttttaaaaatcttctatagagatggtatctccctatgttacccaggctggtctcaaactcctgggtttaagtgatcctcccactttggcctcctaaagtactgggattacaggtgtgagccaccacgccctgccttttagaaaacttttttattttaattagttttttgatggagccccaaatgaaaaatatgcagggagatgagtttagcagggcttaagttcaaacaaagtaagaattggaactctcccaaaagataagcggtttaagtaagctgtgacagaccactgctctggaggatggaaagatttatgactgccgcaatatcccactttaggaggaaatgcagagccattgaagacagaccacaaaataattatgctgtcataacatgcagtacctgggtctaggactggccttacagagtgttaaggatgaatattatgaacatgtgcctgaggtaggtatttcattagtgtgtgactcaggaatctccggatccctgttcttatcccacaatgtttggggttgtggcctttaatgtttgggattgtggggagtctgctgtgtgcacagaagaatcttgaggtatgagtttataggggaagagtccatacgtcacattcccctgactcaaaaagcaacagaagtagccagaacttgctcagttccatgtcggcctcctgtctcttctgtttgattccattttcactcctctgaggcctttctatcttccctgagccatgcctgtgtaggaggcagccacagaataataagcaggtttccctgtggctgttgaacactggtaccaatggtagccacgtgacaaacacaccaccccatctgggtcccaaactctcaaccagtgcccctctttgcacacatcccattgaaggctcattttgtgaatctgacatttcccagttcctgataaccctgttgataataatggttgctaatccttgtccatactgtatttgaagcatttacttatgcatacctcagcttgttccaaaaagtattcaagaggggagtttctgagcacataatcaagtctccaaggtgttcgctctggatctgcactctgactatggctgtgtcctcaaaacagtaaaaagataatgcagtggaagatgaacatgtaccaaattaaagcgtaaaaggaaatagaggccaaattcctacactatcaacataggccagccctgtttttcagacattcagtgacttatgcaatgctgtatgtaataggcctgctgaaagaaaggaaatgaatgaacaaggataaacatgggttttggtattgctggtacctgaataaccaaccctgtgttccctgcagccagcatattgtcctctcccattgctggctgccgtgcagtgcttccgtcatgtgctgctggagggggccctccctgggaagctgagtgccccaagggtaccctgcctgggtcttgagggacagagtgtgtactgacactctgggcttcatgggcttggactccattatatacacgtctgcaagataccaaaggagggccaccatctctcagtcatctcctttccaggtacccctgaaggggatgaaatagggagtggcattggatctcaggacgatccttatagggatggctgaaaatacaggtgcgagcctttgtgaggcaggatagagtctgaggcacaggaccatgccaggttagtgagagtctcccagaagacccaagtggatggcagtgatgtctggagcccaaggcagtcacataggatttctaagatcatgactaaaagggatagttccaagaaagattgaggaaaaatgctggtcatgagatcaggaatccagaatgactttttttctatcagatctataaccatccacgatacttcatggagaatcactcctgagcttgatgtattcctgcatcacaacctgtaccacacaaactcatccccttcctggcagagctctgagtatactcctctgtctccatagtttggatcagaaaatgtagattccttcctgaggaccgcctgtctcatgaaggaggaggagaaggtggcacaggagtctttttaaaaggattttaaggtgatcatttgagccataaagaaaccaagtttttattcttcaaggcaaaaggctttttcaagccaggtgatgaaagtctaaattgctctacacagaagaacaggaggcacgtctccagatagatccaggtgggcacagtcttagtgaggggtagatatatgagatcatccgtatgggatcccagaagccaaaagactcacaggaaagggagttttcaaaccccatcatttcaaactcccagcaaaatattgccatagaaaagagttttccaaagtcaatccattactggctcagatattaatagaaaatcaggagtcaagaaaaggaagaaggtagagattttaaagtcaggcctggttttaatttatttgtggttattctaactagtaagtgaaacacactgcctgtctggtgccctgtcccaggcataaattgctcacccatcagaaaggaattaatttttttcaagggtgctaccttaaagccattagtttagcaaattaactgatattcctagaaaagctccttgcttgtgccaataaatatttaccgagttagtgacacctctaacagcacccccaaatcgctgggccacttccaaagggggagcagcttactttcaggaaatggattactcacttgtggaatgagaccaacacccaggctactcagtttcaacacactttaaaatgcaaaagggaactttcctgcctcaagctttcaaaccttttccagatggaccgaggcgggtgagcccattgtggtgcccaacaggcctggcttaggctggggctgcacacatctagctgtgcctcccatccctgccctgcacaccgtaccatgaagggggttacagacttccagtgggttgctgataagaggcatccctgagggcctgccctgtttccattggccagacacccccgcccccccccccaaccagaaacgggaaacctatggaaagggctcagctgggtgccgccccctcccccagatgctgttgttagtttcacttctcagctgcagctgcccacagctgtctggggatggagcagcagcaaggtagtagggtggtggcatctttttattcttccagacctgggcctttggcctggtagccagagtgggcaggcagcaggcctgctctgtgcagcgtttgacttgggggttaagccgggtgcctcagggcgggacctggaaggagaagctgagcgcagtccaccattcagttctgggtaccaggttttcaaagaggcattaagtgtagccagaggagggtggccaggaagctgcaggggcctggaaatcataccacctaaagattgttagaaaaaactggagactgttagcctgaaaaagatttaggtgaatggctgtcttcccctgaagggagagtagatttatctttttgtatttttttatcataacataaaatctgccattttaatcatttttaaatatacagtcctgtggcattaattatattcacaatgttgtgtgaccatcacagctatcaatttctagaactttatcatcatcccaaacagaaactctgttcccattaaacaataactccccattcttcctgcccccccccccagctcctggcagccaccattctgctttctgactactcaagagacctcatacaagtggagtcatacagcatttgtccttttgtgtctagcttaattaacttagcacagtgtccttgaggtccatctatgttatagcatgcactggaatttccttccttgttgaggctgaagaggattccattggatgtatattccgcatgttgtttacctattcatctgttgatggacatttgggttgcttccaccttatgacttgtgaataatgctactgtgaacattggtacgctagtacttgttcgtagattttttttctttgtggtttcagaaaaactgatcttagccaaatggttagaagttgcagagaagctgattgtggctttagtaaccccagctctcttcagtggtggaaaggctccccatggttgggagtggtgtgtggtaagaacacttacaaccagaacagagagaaccagaaaatctctgaggtcccttccatctccagaattccatgattttcaggcagattgaggtatgcatccgaagggtaacatctggagaaaaaggaagtggtgtcagatcagcttcagtttcctgaggaagaaaagagggaattgggatgttaaattatctaccagtcaggagaggttacttgctaaactatctctggcctggacttgacaacagaaagtgatgctcctgtgaagctcatacaaaggtcctatgtagtctcagggagatctttctaagctccagcgaaagctttcttgtactctagcttcctgggggatagggtggtgagtccagctttctcagcacaaatccctcatgtctgcctagaaagaagggatgcctttagaggacctgagccctgtctccatgcaggttattctgaatgtgggtgagggagtgggtgaggatggggagtgctgggttgggaagtttcaggagtgaatatcagctgaggtggggatgccctggctcccaacacaattagcttcattctgctacagttgggggttttcttatcattagtcgggaaggcctagccagagaattccagtattccagagcaagtttaattgtgggtgatttcattctgccctttttatgtcgcagccaggggcttgcgtcatataacagtgaattcagggagatttttatttgcatgtgaatcatagcttttccagctgaatgtcacttacttggaatttttgtctgattttgtttttgtttttgtctcttggtgtttttccatcgggctctttggctaaccagaaaaaaaaaaaatagaggaagggctcaatctgactgaaacagggtttgagttggcaactcaaaaggagagtattatgaatgtgaaaaaaagaaaacggatgctttattttgctttgagggagggaccgaagccaagtcaaattgagagctctaatttgggaatagtgttattacaggtcattgggagttggttacgcgctaaattgggaggccagtcacatgaggaggcagcagaggcagatcacatgggggacagttggggcccttttataatgaaattttgttttatttactacacagttgaaatgtacttatgtcattttgagaaaccaagtcaccttattggctgggagttgctccctgccctggcccatcagttgtttgataaataagccagttcttccaatctttgtgctttccggggcttgattttggcagtgggatctgtgcagtgattcatggagctgaccctgtgataggggttatacatctgcccttcccctgactgactccaaggggcttgatctcttctcctccaaaggctctacccattttagacctcaaggtcaagacatacagaaaacttctaacattatataaagaagtgatgacctttgttttttagattatcttccattttctcagcactgttcctcttaatgtcatcttgcaaaataagaaagagaaaagatggatcctgcccctccatgggcagttatgaaccaagtatttcttcttacctcaaaactgcagactttggatgttcttggcatctcggggaggaccaggaagggtggtgtgtggtcagctgctgattttccttgaagaatcaaagttggcattcttggtgtccacagccctgattagttagctgtgtttgaaataaaaacaaacaaaaaaaggcagccaaaaaacaatatctagaattcagttaattcattcccactgcaaacaagttgtgctcatgctcctaaatggggtatgttactaagccggtgacacagagcatctgggccggcgatgcttgtgatcgaggttaggaatagaaggtgtgtggaaactttctataaaaggcagccaggtcccctggacaaggggtcaggaagcttcagcactgttcacggtggcaccagggcattactgcatgatttggggcaagtgtctctgcgccttggtgtcccctaagtgccgtattgatttgggggaatgggagggtaagggcctcaagaaatgtttgagatgtaaaatgttaaatgtttgagatgtgacatgtaagataagtggagggagcgtgatgtcacaggagctcaaatcagggccacgtgtccctgaatggggctgggctgctgtcccttctcaggcatcaccctctgtggctgatgcctctgacatcataatacccagccagacactcaataatgatgagctgtgcccagtggacacctgaggagggaagaaaaggagaaggacaaagtggagagggaggagatggagcaatctcttatgtgatcattccatcaactcacaaatttttcacctaacacctggttcaactgtaatgtgctcagctccgtataacctggacagcagctgtgccctcacccctaaactcagcaaaatattatggtcctctaatcaagagaattttgctcctgttactgcatgtcttgtgggttcatcgtcagaccagtgagttgataccaaacttcaccaaacggttctccggagcaaccgtttagaggtaacgtactggctctcacgcccaggcttctctgggcttctgcagactcatctcaactctcctccttggagcagcacataactggggattgtgtgggggtggtttgtgagggtgtgagcctgtggtaaagatgctttaaaactgaaattctcaccttcgtttgattcatgagccagcacaggcttggccagactttgtttattcttatggcactcttcaaacccaaacgggccaaatcgtggcttccctgtctatccttagatgcagcgattgctgcttttaactgggtaggttgctatgaatagaaaacttgagagatcagccctgtcttagaaatattatgacattttgcttatttattgttgacttaaaaaaaaatccaacaacttcctctaaaaataggtccttgccactctttcaactgcttcctcctagcctttctcctggtaagaaatcatggttcccacctggtttcacatcagccttactcgatcctccaaatgctatcaattggaggccatgattttcttgggttctcaaatgtgaacctggatcaaaatcatcagggggctggttaaacacagtttttgattcagtagatctatagagagggtcccagaagtcgtaattctttttttttttttttttgaggcggagttttgctcctgttttccaggttagagtccaatggcacaatcttggctcactgcaaactccttctcccgagttcaagcgattcttctgcctcaacttcccgagtagctgggattaaaggcgcccgccaccatgcctggctaatttttgtatttttagtagagacaggatttcaccacgttggccaggctggtctcaaactcctgacctacaggtgatccacccacctcagcctcccaaagtgctgggattacaggcatgagccaccgcgcccggcccagaggttgtatttctaacaattttccaggcatgcccctcctccatactttgtgaaccagtgccttagggctttgggtctcctcctgtccccatcctgtaggagagagccccatggagcatgatcctggtcccttagattggtggtgagcagctaacaaccacatagtactcaccatgggccagatgatggtcccatgctttacaaagattaagtaactcaaacatcaccaatcttaggaggtagcccattttccagatggaggaactgaagcacagagtggttaagtgaattgcccaagttcacacagctcattcaatggaagctcagacaacatggctagcatctgtgctctcattccccacgccatattatcattctgttttccccaagtcacttagagcacctgatactcctacagttcttaagagtgaataccttagaaaggagccgccaagacaactgaacccatcttaggcgctaacaaccagcatcttgggctccgattgtccaggtgacttgactaccctacctgtgtctgtgactgagtagaggcaagaggagggggctcttagcagaaatacattggacatgtgacctggtgaaggccaagggaggggtgttgatgtgaagacgctggggacatcatctgtgaagacaggccagccctccccttctgctggagcctcagtgtcccctcaccattctgcgctggtccagagatttcctgctattgatacttatcagagacacaaagctgaggaggaacagatgtgccatgtcatcagccataatagaaaaagtgcatgaatcttttttggaccaggttggtctagcaaggctgtgtgatcagcactaacctgggtgagggagtaggagacacagaagtggatggactgtccccacccacaaggaggggtgaagtggggggggtgttatacagatatgcaagtcactgagctcaattgtggtagagaaaaggcaatgagggcccaaatgggtaaatggcatttggggagagaggtggattcttaaactacatcacagatgatgataggagcaggagggggagggttcagatgtgtccaagacatatctacagcagagagtatgtaatgataaataatagtgatctcttttgagattcaaacagccagaggttaagtctccactggtatagtgataatagactaagctctttttttttttctgccaaataatgtgttgagtcctggctggagggcctaggagtactttagaagatggattctactccttacagtgttgcctgttggttctagaaatggagcccttctccaagtatttctctaccccattggtctgattctccccaagttatttgtgttacagacacttctatgggtacaaaactttccctttggctatctctgataccacaaatgtcattgaaaaggacagatcctagcactaggccatatacattgataggaaccaaagacagatatctgatagattaataaatacaaccacttccaaaggtgatggtatgaagctagattcaaacaacacagtaggccagtgctgtcactcccagctcagaaccattgtggctagaagttagctttgtctttctcctcactgagccatgtgtctcagaccctggggtagagttgagggagggcagacaatggttagtttccaaactccctggacataggggccccttgctgccttctgccttcctccatagagtttagaaggtttgtttccaggaaggagctccttcctgccaggtttgtcctctctccagcttctcagcagtgcagggtgcttacaacacagcccacaggcctgcctgcactgggctgtgtgggtctgtagacaaggttctcaactctgcctctgcgtctgctcctctccgtcctactgggcctttctgctcccccttacctttccctgcctgagccctctcactgtttttgtgcctgcctttgttgtagaattctagatggcagcatgcttgcaacttgggaaggatgaggcccttgtctggagacattatccctatgagctctgaggtcttgtctccttctgtagcatccccaccaatgtggccaaagccaagggccctcatctgatcagtcctcctgattctggtccagccactgagccctaggtctactcaatttcatggcaggatacccagaaggagggaaatggcctcagccattctcattcctatttagagaagtgcattcttcaccatcatccttcctaccttttcttcttacccactgcccaaggacttcagcaatgaaaaagtagcttcccttctcaaaaaaaaaaaaaaaaaaaaaaaaaatctgaaaaatcttattctgattgcatcaatagacctactaacctgaaaatgagtttggtgcacaagtaacaggtgaaaatcagcagccttttactgcttactgttgcagaaattcccagcattggctggcggctggaggggaagcaggaagggaggtgtgcctctagctccctctacagggctgtgccccaggaggacaggagagccaggctgaatatgttccagggtcacccaactctgtccttgtacagttagccaggcctttctttccaaaaagagtatcagttaatttgtgactatggactcgaatatcctgcctccacaaaattgttcattctgtcccccattggatgacttgtacgtgtatttcatatttcatacctaaatgagtgatacatacattttactatcaacattgctaacatgcatattttgggaatatctacatgctgttccttggtgacaatatttacatggttacacaccacaccacagggctcttacattcacacttacactttggatcccatctcttgagttgggaaattttgtctataagttgttgagcaacttcctcgttattttagaaagcgtgggacccagtgacttcacagttcacagtcatgtaaagatatagaatggctccctggtgtcaggggtgggatgtgtgcactccagcccttcccagacttcctgaggtgtataaacctgttgtgtggcatggctgttgttccgtttgctccactgaattaagcatgaactattcttttgtgattcagtctgtttatactcctcccaagatactcctctgttgactgtctggacattgccaaggatgctggccttggagttctttgtaaaatattattgcagttaggttacgtggacaatgccgtgctccttttgggactctcatgtctagagcctcttgtgcaacaggggctaaatctaagtgtagaagcagaaagcacacttttctcctttgcaaggtcagcatgaggattgctaattcattattttaaggtactattggagtgtcactctgtggtgtgtggggttttggcagtggtggtctggagtgtgagggcggcgctgaagattagagagtgggaaagcttcctgtgtttagaacacttccagcctctcctctgaggggtttttggtgtaaaaaactagtcgagtgtggtttacaagaatgtgtcttgtgtttgtcgagtgaggtaacatttttttcatctctaatttatataactcttaggagacccattcctatgaggccttattgaaacaatcacttagtgcccccccccgcaaaaaaatcagacatataacagtcttaaccctgttgacattgtttttctttccttcttcaacagatgtttgcaagagttgtattaaatatatttcattctgctgtctcagcctctcaaatccttttcacgaagattactttaatgggtgtcagttacaatcacaaaaagcacccattttgcttttgttttctagcaaaaaacaatggggaaactttccatcttaaacagaatattgaaaaggggggggtagtaaagactttgaaaattgagctaatcattttattttcctcttttccatgttcctgtttttatttgatgttaaagctaaaaataatcagaatacaacaaagttgaatgagaaaggggcaactgaacagtttgtgtgtgacagttggtacctactattgtttataggtcgtctattctatcttaagccttccatttaaaggaaacttctaggaaatacctaacattttgaagaaatccaaacgactattaaaacactatcaaacaaaaggccataattagctgggcgcagtgcctcatgcctgtaatcctagtactttgggaggctgaggcaggaggatcatttgaaactaacctgagcaacaaagcaagactccatctctacaaaaaatacaaaaattagccagatgtggtagtagatggctgtagtccgagctgcttaggatgttgaggtgggaggaaggcttgaggctaagaggttgaggttgcagtgagctgtgattgtgccactgctctctagcctgggcaacagagcaagaccctgtctcaaaaaaaaactgtaattaagaaggaactattaatgcatgaaaaaatggagacaccctcattaccctcatggagcttgcattctaatggagaggggccagaaataagcatactgtacagcaggtcacatggtggtaagcgctatggaaaaaacaaagcatgacctgggaataagggagtgtaaggtgagagagtggggtgggcaatttaaaatagtgtagacagataagatctcattaggaaggtgacatttgagcaaagacagagctgagagaggctaaacatgggtgtgggggaaacgtgttccaggcagaggaagcagcaagtgtgaaggttctgaggcaggcacgcggctgatatgttgaaggaacatcacagcagccaggatggactgaaacaggagagggtcagtagtaagggtggaggctagatcatagagggactaacaggccatcataaggactttggcttttactctgagatgggaagccattgacatgtttgatcaggggagtgacatgacttaccttctagttttaaaagatccttcttttagaaatgattgttatggttgataagagactactggagagggtggggatatgcagaaacatggtgaggggtagtcacattccagatgtattttgaagattcagcccataggatttatggagaggttagatgcaggatatgagagaaaggagtcaaggatactccaaggttttgacctgagcaattggaaagatggaaagccatctgctgagataggaaagaggagcaaagaagcagatgtggtgagagtgagagcaagagttgggttgtggacatgttgactttgagatcatctgagtgagcatggagagggtgcagttggagtgtgaatctggggctcaggggagaaacctgggctggaaatacaaacgtggagttgtctgcatactcatgggccagaggtcagaaccgaggcaggtggctgggggagctggcctggtttttgtgccctctgggaatggccagcctcagacctcctgactggtcatggccaggaggtcagaaatctgaaggtgaatcctaaccctaacttgagtccttggctgagatctcaggactacttcccagctggcctgggtcctcaaggagtaaaggagcagtcctggagcacccagctgtgccggtacctggggaaaaagtaactacagatggaaagtctccatggaagaaatgaccagatctctactctggaaaggtaaagggctcattggaagtatctgctagggcaagaggtacctggttcttgccttttgaggatggtcagatgcctttgaatgaccagcacctgatgaccttctgctgtcagaaaagactggaatggtcataatggtctatacagtccactacatagatgcctgccttttctagtgaatccaagggacagtagcattttgaagtgatctttaccaagtaaccaaaagctctctgtattcattaactattgctgtgtaacaaactaccctaaaacttaatgacttaacataacaacaagttatctcagttttctgagggtcagcaatttagaacagcctggctgggaagctctgccttaaggtctccaacaaagctgtagtcaagaaataaactagacctggaggagccacttccaagctcactcacatggctggcaagttgattctggctgttggcaggaggcctgaactcctccccatacaggtctctccctgggatgcctgagcatcttcataattggtgtgactggcttcccccagaacaagtgaaccaagacagcaaggtagaagctgcaatgctttttatgacctaaggtcagaacgcctccactgcacactcttggtcacatagaccagctctcattcagtgtgggagaaaagcacataggtgaataccagtagtctaggatcaatggaggccaccctggaagcccgcaatcaccttccttgaaaatagggggagggttagggccgggcacggtggctcacgcctgtaatcccagcactttgggaggccaaggcaggtggatcatgaggtcaggagttcaagaccagcctagccaacatggtgaaaccccatctctactaaaaatacaaaaattagccaggcgtggtggcgcatgcctgtaatcccagctacttgggaggctgaatcaggagaatcgcttgaacccaggaggcggaggttacagtgagccaagaccatgccactgtgctccagcctggtgacggagtgagactccatctcagaaaaaaaaaaaaaaaaaaaagaaaaagaaaatagggggagggtttatatcttttcaatcctttgtaccttttcaaaacactacttgcagctgtaagggctcataactccagactgggttccccatcacaactggtctaatccataccactagcagggctcccaccaaattatggggattcttctctggtcacctctagctcaagagggtaccttgggagacaaactcaagtgcaggtgccaacacaagaatcccaccatttgccatgttggtatttttgccctgatttttcaggtgccctgggctgaaaaatatctctacaaataaatacatggtgtgtgtggttatccacttttgagttgtgcagagttgcactatatttagaagcttttagtacatgatgtgtctaggattgactttgtaacattcttccaaggagtctttgaccatgtaaaacccaccaatattcctgccttttagcacatttatttcaccagtacttcttctgtgtgtgcatttaattcctagccatttcttgcatgagcaaattgcctaaatgcgcttgtgagaaacccttttatggcaaacgttattaaactgaaaacaagggtataataaaatagcaatttaagagtaatttactaacaactagagcccttaagcattgacataccattgtgtagcaataataccagacttggtatttaaacacactctttgtcactccaaaaatcattgggacagtttcctaatcctcatggtctttaattatagctcttctaattttttttactactcctatgtcactggtttacaaattataaatcattaacttttatccacattaaacatccatgtaatagaactgttacatctctgctccttatacagagaaataacaaagaaaatattcagaaaacatagtagaggtgagctgacatcatcaaaccttgaagttcttgcacttaagttttccactgtgtcctgaatcaggtgatattggggtgagtaatggtagagactggatctcagaagtgatcaattaattgaaaattctgaggattcctgcatcttccccagggaggagaatttgtcaaatgcaaatctcagcaaagattctttgctctctggaagatagtgtggatgccacagaggccagtgggcagttggacaggacctagccagtgtgaccaagtccctgcatgtagggtctggcttccgtttgaaggtagagatgttcacgcttgtcagcaccctggggatactctcctgaaagactgactcatgctaactagaaagcagggaggtagacactgcaatgctggctggttaatttgccacgaggagccatcatcagagagaccagacgtactccaagtccatataatcagcacacattgtccttgtcggcaggcctccacaggaagccaaatcataatcagaaattatgtattaagttgccctgacaaatcattatcacagattttggaaatacctcaagtctctatgatcagttcattctctccttgagggtagctggggagctaaatcatggtccaaaggttgttttgtgagtggataatcaggacgggggcgctgaggaagggaaatgtttagtggcaacgggaacttcatgggtccatgccagaatgggaatggctttgccagaaagactgatgtattcaaaaccaagtggctaaaacttccttttacctagagggacagttggatagtgtattaattaacttagcagcttaaaacaataaacatgttacacagtttctgtgggtcagaaatatgagagattctggcttaggattcctcaaaatggtatgtgggctgcagttgtccaaaggcttatctgggctaggagatctgcttccaagatggttccctcatatggctggcaacttggtgctaggtattggcacgaggcctcggttcctcactacaaggacctccccattgggttgcttgcatgatgtcacaacatggcagctggctttccccagagtgagtactcggagacagcaaggggaggccataatgccttttataacctaatccataaagtcacataccgccatttcccctacattctatttactgaaagtgactcactgaatccaacctgcactcagaaggaagggaattaggctccacctttcaaagaggtgtgtcaaataaatagttaacatattttaaaccacaataggtataacttacattgtctctgtaactcctttttattatacttctgttgctcaccaactgtgattatccatgtactctattaatacatttatataatgtttataactattacatatttgtatgcatttatatgtaattctgtatcatataactatagaacatctaattatgttataaatatcaatatatttggcttatggccacgctgttgtagcaggacagccattatgtatctaatatcaaatttgcctacctccattctgccacttcactagcagggggctgggggcaagtaacttggcccatttgtgcccctgtgccttcatctgtaaaagaaggctagtaataggacctacctcataagcttcttgggaggattaagtgagtaattaaatgcacagggcttagaagagtgcctggcacttcgaaaacattcaatactgttggctctcagcagtggcagctggagtagtagcagaaatagtttgatccagtaggtgtagttagccctcagagagcaatctgatttctgtgttcccagtggtagtaaacaaaagcaatacttgtcttcctggtcccaccatccaagccctgtcctgaggataaagggaccggggccagcggcctctcgttttccttcctctttgctatgcttgttcctcctctgaatcccaggttaatccacagcagagagcggttacatggagataacatgtttcgtttgtactatgactcctatttatgttttgtttttgttgctgattttttttttttttaggttgaccttttgtggaagggtagaatgtccaatcagggaaatgacctagcagaaagctagggagttcctcagcctcatgaattttttattagaagtcattcctaatttttatctttaaatgtacattttcaaggatgtacactagccacctctgattacagtaggcttacagcataaccccttttgcttcttggccccttttgcttcttttcagtgcctcttgggcttaatgaatagattttatcttcatgctaagcacattcatcatttaaaacatgcctggtatttgctgaagatgaattgaggagaaagttagaattggaattttctttgcctctcagcgctactttaaaagggaggctatacctagtggaatgtgtgagagttgtcttgtgtcaggtggcaattagctaaatatagagtcagggagctgggagggacttgctgaggtcatctgtgccctcctgccagccttccccatctgaatgtctccagccctgtgctcagcagctcagtagtcaccagccacataaggcttctaagctcttcagctgtggctgatccaagttgagatgtactgtccatgataaaaaatacattggcattttaagacttttaaaagatttttaagacttaattcaaaaaaaggaaaaatggctcattaatgataatggataatgaagtgataatttgattatttaaataaaatatatcattaaaatgtacattacctgtttattctgtctcttctttaatatggctactagaaagtttagaataccatatatggcttatattttattactgttggacagtgctcctcaagatcgtctcactctgttactgaataacattcagaccccagggcagagattctaaagccttccttggtgattctgagtctttcattattctggcaattctgttcttctccacgtcctatcttaatctctcctgcttcggtttggagacttctacaagtagttgactctttggcatctccttatgaaatcccacttgaagtgagtcaagcatctcttcatattgttgtaagcacagtaaacccattttcttttcaccttttgactttctacctccttgatcatttttagtgacttctcttgggtcatctctggtttctctatattttgttttttaaaacttggcatcccaaaccacccacattgctctaacatgattccagctatgcagagacaagctgaaggaattacctccatcatcaagtacttgaccagcccttttgctactttacgttatttaatcccacagcacatggaggggcagatgctatttggggctcagagaaggtatttggggctcagagaagttaagtaacttaccaaggttctaccacaaattaaatggcatgtctgggatttgtgtccagctttgcctgactccaaagctcatgctctttcattatataccatgcctctttttttgctggtatttttcttgaaatattctttcccatagtcttgagaagcattgcagcacaggctgatgcatttgtagcttatggtcaacagtgataactgggcttgttttgttatgtttgcacctagctggaattgctaagcccttctgctaaattccagaaaccccttccaaccttctagatatggcataaaaaccagcaggactgtccagccctagcccttgtagggtcatcagtgggccagtgttgagatctccaggtgtcaggaatgacttccctgaaaatgagctttctttcctctggcccagagcctgtgaataactgtcaatcccaagacaggctatttctcaaaggctaatcagtgagaggggatggaaaggatccttctgagtgtgttaaaaacagatcttcccagagcttgaaacttgaggacattatgctcagtgaagtaaggcagtcacaaaaggacaaacactgtatgattctacttctctgtggtacctagagtagttagagtttcagtttgagaagatgaaagggttctagagatggatggtagtgatagttgcacaccactgtgaaacggtgaattttttttttttttttttttttgagaccaggtctcctctgtcacccaagccccagggtacagtggtgcaatcacagctcactgcagcctcgacctctgaagctcaagcaatcctcccacctcagcgtctggagtagctggatctacaggcatataccatcacacatggctatttcttttttaattatctgtagagatgaggtctcattatgttgcctaagttggtctctaactcctgggctcaagccatcctcctggctcagcctcccaaagtgctgggattataggcataagccaccacccccagcctgtgaatgttcctaatgccactgaacatccacttaaatatgattaaaatgatcaatgttatgtgtattttaccacaataaaaacaagctgatctctacataaagcaaaacagcaattagaggtgtctcaggagccaagtcttcggtccattgcatattctagctttgagcccatagtcactctgagttagcttctcatgagaaaggtgcagtcttactgcacagagatgaggggagctctttttttccctgacaaatttctccatctaggaagtttttccaatttcacacaaatgcctttaccaggatttaaatcactttcaacagatgtctgggggaggtgaagcagcctcacccccaggactctggaatgggacctttgttcatactcacttttctatggagagcttcttagtcttagccccctgtctatcagggggtaggctagacctttctcagaaagaaaacagagctgcacattgtatttgattgtaccaaagtagttgtagcttttttggaaacacgaatgagaatttgattgagtactcaatatctaagaatgtttgatctgtgtttcattggagcctctggcccttgaaaacctggggtcagttaaccaatctgattcacaggctcttttgagaaaatatagccagactatgtagattgggaccctaatccataaaaattctctttagagtatctgtttagagtcactgtgggtgtatttgcttatttgccgtgtatatttcccttttcaggaatcattaaccaatggcaacaggaatccaaggataaagtgatttccctcctgttaactcatctgcctttgctgaagccaggaaacctcgacgcgaaagtagaatatatgaaactgctgcccaaaatcctggctcactctattgaacacaaccagcacattgaggagagcaggcagctgctgtcctatgctttgatacatccagccacttcgttagaagaccgtagtgctttagccatgtggctgaatcacttggaggaccgcacgtcgaccagctttggtggccagaaccgaggccgctcagactctgtggattatggacagacacactactatcaccaaagacagaactctgatgacaagctcaatgggtggcagaactctcgggattctgggatttgcatcaatgcctccaactggcaggacaaaagcatggggtgtgagaatggccatgtgcccctctactcctcctcatctgtccccaccacaatcaatacgattggaaccagcacaagtacaagtaagttccccggaatccctttaacgtagtctggtttggcgatttgctgtgtatgtggcatgtcctgctgacagtgtctgctccatgcaccctgtgaccctgggagagaaggactgattggaattggctgtgggaaaggtcctttggaccccatatttgttgctctttgactctgcaaagatgaaaatacttgggaaggtaaaagtgactgatggtccaaatttgggttataaacagaccaaaaataaatagacaataaatgaaagaaggaaacttgccgtttccacaatcagaaatgcatttcacccatgtctttcaccctggggttttggatttgctgagacactgagttactgtgtgattctctaaacctaattctaacccatggttaaccaggcagcctcatgggctttgtgctttctctttattttttttttcctctttctttctctttatttatttattttttcttaaatttcaccctggaatgtttcctccctttgcattttctggttttaatccccaattgttggggcacttttttcctgaccagtgggagcaggtttgctaactgagaatgctgctgtgtgctgtggcctggtgagaatgccatggacttctctcgctcagtccaacaccttaggagaggtgggtcaggaactgctttgtgcgtggggagagcggaggacagccctctgctcttttgaccactaaagcaaagtattgcaccctcagctgggcactggggctgggagtcctctctgtgtctccccactgaggctgagcaaagtgacaaacacaccattggtgtctgtataaagtagcggtgtggaagtgcaccctgtcttcaaacagcgttccttaatgctagtttgcacctgtccatgaatgcagtggcagtgccaagataactttcttgaaggaatgcttttgcaattagacctcgtgtgcctgtcttcatgcaggaacccccagttaaaagatatgagaggattaataattggggtgccggcacagagactcaggcctgtgatcccaccactttgggaggcctaggcgggcagatcacttgaggtcaggaattcaagaccagcctggccaacatggtgaaactctatctctaccaaaaaatacaaaaattagccggacatggtggtgtatgcctgtaatcccagctactcgggaggctgaggttaaggaatcacttgaacccaagaggcagaggttgcagtgagatgagattgtgccattgcacttcagcctgggcaatagcatgagtctcagaagagaaaaaaaaaagaaaaagaattggcagtgatgccttcttggcatctgttcctacttggatctttggttaccaggactctttaaatggctttctcaaataggtaggattgttgagttacagctacatgaactgaaacagtacctcagtggaataaccaagcaaacactgaagatactgcattgatattgctacaacatgggatttttttaaattcttttttctgcttttccatttagatatggttaacttgcacattatgggaattaggtgattactgcatcttaatttattatataagaggttctgatgacactgtctttcacagactataatccagcaggaacagtttactcgtctctgtatgataaggagtgatgacatgcaggcagatgacagtctcttggtctaagtttcctgcatcagcaacagaatctagtaattgttacaaaactcttgaatagctgggagagatgcaaactctaagctgcctgccctcttaaaacttggtcttttgtattttaaacagttgagttttatgtcatttgtctcaaaattagtcttgggtcattatatatttctatctactgatttatacattcaggatcaggtcttgacatttagtacatttaagatggttatcaggttgtagtcatcaagcacctatttctggctgtggccacccagccagacccatagagggtagaaaatttgtagatgactgtcatggccttactgacctctgaacccctatgtaatacttgagtgaaaaggacttggaggcttaaccagatgactagctgacatacctctggaagaaggcaggcatcggagccctcttccagagcatcagagaagatcaaagagctcagatctcccctccagaaagtttcattcaaacactcatgaccatatcaacacttatatgtcaataatatctctttaagaaaatgcgaatgtcattgctgtactcctctgtgttgcctatggtggttcaattgtgtgagtcaaaactccaagcctttgggtcacttgttcactcatgcctctatcaataaaccctgagcacctgggaggcagcctgacagagggaagaacaaggactttggcatcaacgcctcctaggtccaaatcccagacaggcaatttgctaactacagcttggccaagtaatttaacctctctgatcaaggtgcccacttgtaaaactggaacattcacaatatctacctttgagggctgtagtgaaggtaaataagattatgtaaatgcccagcctggttgcagcagcaacagtaagcactccaggggtacctgttagatgaataaatgaaagaaactgggaaagacggtgaggagctaagtgttaacactgatatgcagagtctttgccctcattttcagttctgatgggcgcctgacataagcaccttaccctgagcccagagccatgcgcagtattctaaggggccttgaatatgctgtgatttttggccattccactgcaatagaaattgggttggacttaaggcttcttctactgcactgaagagctacacttcttacctctttcaaagtggaaaaacaatctgcgtaagacaatatgatgttaaaaacaaatcaattagtactacacattttcaaattatcagccacgttaatgatgttgaataaaaggtaaccagaaggccagccacctccttagtttttgtttttgtttttgtttttgtttttaaccttggtttattccactgctattttattgctcagtcattgtgccttcaacagaatgccttagcattcgtggcttcctccctgtatggattcccaatcattcaactaccccgcaaatgcttcctgtccatcttctgtgtgcctagcactgcgtgtaagtccatgggaaataccaggaagctgaagaccctgttaacacttccagggagcctgtaattggagagatatgatatatgaatcagtatcacaattaaaaattaaatattcctttttgctggacttatcatccatagaaatttcatataacaattcatgagttatataaaagtgcagtaaaataatactctaagagctgccacaaggcatataggatgaagtgccagttgaatgtaggcctatcctgtaagtgctgtgaatgtacagaatggagagatccttgtgaactggagggtcaagaaagcctttgggccaggtacagtggctcatgcctgtaatcccaacactttgggaggccaacgtgggaggattgcttgaggccagaaattcaagaacagtctgaacaacatagctagaccccatctcttcaaaaaaagaaaaaaaattagtctgatgaggtggctgaagtgagctgtgatcgtgtcactgcactccagcctgggtgacagagcaagacttagtctcaaaaaaaaaaaaaaaagaagaagaagaagaaagaaaaaaaagaccgggcattggtggctcacacctgtaatcccagcactttgggaggccaaggtgggcagatcacttgaggtcaggagttcaagaccagcctggccaacatggtgaaaccctatctctactaaacatacaaaaactagctgggcatggtggtgcatgcctgtaatcccagctacgcagaaggttgaggcaggagaattgcttgaacctgggagacagaggttgtagtgagccgaggtggtgccactgtactccagcctgggtgacagagcaagactctgtctcaaaaaaaaaaaagaaagaaagaaagaaaaaaaccaggaaagaaaaagcaagcttttgcaggggaaatggaaagtgagctaagatggaaagaggaaggagagtctggaggggagggggcccctgggtaggaatacgcactgagagcaaagggacgggggtcacagtgtgcaggcaagatggaggacagtgaagaggaagaacaggctcatgaagggagaggtagtgaaggcaggtggtaaaagtaggctgagggaactgccccgaagaggccaagcattgacaccctaggcataggagtgacatgctgtattggggaaatggattatgagcaaaccagatgagtggcatctgacaagtgcagagtcagcaagtttcaaagttttgaagtaataaaagtatcattaggataggagcacgtatggagcagaaggaatggatactagaaatgttcctaggtggaattattaggattgggattcagtattgatatggacatactttttttttttttttttttgagacaggctcttgctatgttgcccaggctggagtacagtagtgtgatcatggctcacagcagcatcaacctcctggactcaagcaatcctcccacctcagcctcttgagtatctgggaccacaggcatgcaccaccacacccagataatttttgtattttttgtggagacagggtctccctgtgttgcccaggctggtctcaaactcctgggctcaaataatcctcctgcgtaagcctcccaaagtgctgggattatagatatgagccaccacacccagcctgacatacattattgatttactcattttttcattcacctagaaaatgtttattgagtgcctactgttgtgtcttccctgctcaaggcacttgagatgtatcagtggataagacaaagctgccttcccttggggcactggcagtctagtgtgtacaaattgtagtatataaataaagtatatgtgtggtagaagatgataggtgatgtggaaataagaacaagggtaggatcaggcctatgtaatgaggtgactagaccatgaaacagggtggtcagggtagacccctttgagaaagtggggtgtgagcagagagttgaaggagtggaagttagccaagtgggcatctggagcaaagagtattccaagcagagataaagctggagcaaagatcccaagacaaaacagtgcctgacttgctagggggaaaaacaggaaggcagacttgctaggggaaaaagcaagaaggctggtgtctgaaagggattgaacgaggtagacagtggtcggagaggctggagacagaatgggcattgtaggtcattgcaaggacttggacttttgctgtcaataaaccagaaagctattggaggatttccaacagaaaagtgacatgatccaactcacattttaaaaggttctctttggctgctgtcttaagaatagatagggcaaggacagaaacaggaaaaccagttaagagtctgttgcagtaatcaggcaagagaagatggctcaaaccaggatggctacagtagaagggtgagaagaagtcaggctctagatatattttgaaaatagaaccaacaggatttcctgacagaataaatgaagggtttgaaggagaggattgaaggaggactccagtgctttttgcctaggcaactgggtgttgctatcagttgagacagggaaagtctttatcaggtagagtaggatttggagtaagctcgggagttcagtgtcatatacgatgagtttggcatgtctgttggagatactgagtaggtagtgggatatatgagtgtgcagtttgggagagagaagtggtctaaaatagacatttgggagttagcagcacatgggtggtatttaatgctaggactaaatgaaattgccagagactggcagagagaaaaggcagagactgtagataaagaaggccaaggcccccaggcctgggcacctcaacctgaaagctggagaaaagcaggggaagtagtaaaagaaactaaggagaaacccttgaggttggagaaaactcaagtgtgtgtgccttacaaagcacatgaagaaaatgtttccaggagagaagagtgatcaactgagtaaaatgttacagataggttaatgagatgaagaccaaggattgaccactggatttatcaaagagggataacagaggtaaaactgagagcacttagcacatggtaggtaattaagggatgaaaaaagttaatgactccaaagagattggaggtaagagggagacaaactggccacatgctagattttggatgtatgtttatgttgagatgttggagcactgagatggagaaaagtgatgtttagaaggcattaaaaataggtgatagaggccggatgcagtggctcactgtaatcccagcactttgggagacccaggcaggcagatcgcataagctcaggagttccagaccagcctgggcaacgtggtgaaaccacatctctataaaaaatacaaaaattagccgggtgtggtggtgtgtgtctatagtcccatctactcaggaagctgaggagggaggatcacttgagcctgggaggtagaggttgcagtgacccgagatcacaccactgcacttcagtctgggtgacagaataagcctctgtctcaaaaacaaacaaacaaacaaacaaaaaacagaagaaaagaaaaaaataggtgctatagttacacagagttttgaaggacaggattagaataaggatgagtaggagccaaaacctaagtcctaatctaatgagaatctacgtattttcattcatcgagaggcaagagtatcttttattggttgcagaggttaagtcaagtgacatctcaaggaccttttctaccatgagataagggaagagtgggttgggataggttgaaaaatctgttatgcagccttttggatgacatcagagcacttcaaaagaaagagaagaatgtatttttttagcaccttgttctagtaaggccactcaagggtatgctgactaagaacaagaatgtgtgtgttcttcaccacgagcctgtaggaccagacaggatcaaggtattggctgtgacaaaccttacacaaggcttggtcaactttgtttcacccatcaagagcaattaattccaaatataggcagatagaacccggattagcatctctaggtttgcttcctgtctaaggtctgttatagaagaaaagtaaaccattcaggcaaagaataagtatttcctggctttcttaagagcctacagaattcccctgtgtggttgtcagtgctacctcagttgccccaaactgcctttctgacccttgtctgttcttccctggtggacctggacctggaagaaatctctgtgctacagctacaaatgaaacttgtttttattcaaataattgcaacacttgacttttctttgcattattgacatttggatttgaaagcatgctggcctttgttagcccaacatgaggtaagaactcagaaactttggatacctaaattatgccaaaatgctccatttaatctgtccacttctacagattcatggcacattgtggaatcttagtatttattttattaatcttgatttttttctgatgataaaaatgatgtgtttggtaccatagaagataaaaagtaaattaacaatgatagcacacacctacatagtgtttactatatattgggtactgtttaaaaccctttacataaatattaactcattgaatcctcataacctcatgatggtgggtattattgttatccccatttaacagctaagggaactggagcacagaaaggttaggtaatgtgaccaacatcacagacctactaagtagttcagctgggatgtgaacctaggcagtgaggcccctggaaatcgatgttattacttgcctctccctcctaatcctatcctcagaatttgaatgagtagctagtagactcttgcttttctctgaccctggatttggccccatacagaccctccagcttccgtggtctccacagcccacaggtatgagaccctgcctgaattgccccatctctgtgactctctgaagcagggagcagtctttgcaccgatccacacaactcggtgtcagctcttagcattttgtgtcagtttttggtcgccatgttcacctatccttcccgactgtgagctccttggggataggggttgtatcttctttatccgtatttcccagcacctgggataatgtgtggctcaaaaagtcacagaaattttggaaatgtcaaattcctggcacagattcagctgcagtggcagagcaccttgttggacgatggccgtctcttgctaagcccagatgtggcctctgaatcatcctcaatatgcccctctaggcaaccactataattcaataagagatggcatgtgagctgaagcttgtctgcccaccctgccataaatgtttgctgaacagtagggacttaataaattcctgagctcactaggcacatgttcatgaaaataatgaatttccaaaataaacaagaaaatgtccctaggaattcactaaatatttggtgataatattgatcatttagccttctgtcataatcaccttagtgacatttattgttactcttgctcctttttgacttatttgaccaaatcagtttcaatactaacagacttttaaaaacataccttgattatagagatagttacatgaatttatacatgtgatgaactgccatagttacaaatgtatacccaaaaaaactagtgatcgtaaaaacagctgagatctgaataaggcctgtagtctagttagttgtattgcattaatgtcaagcttctgattttgataatgcactattgatacgtaagatgtcaccttgggggaagctgggtgatgggtacatgagacgtctctgggtagtatttctgcaatttcttgtaaatctataattacgtcaaaattaaaagttaaaaaacaaaaattacttgggatattcagtgcctggattttggaggggttcgggggaggacattggtttggtccttgttcttggtcttcctgaggggtagaggaagtccttgcatttatggaaaggatggctgctaggcctcatagagccaacatctgaaactaaacaacttctgcaagcaaagtggaggacgagtaggagtgaatctcagggaaagtggctcccttaggagcccctgatctgctacgggaaaaaaacctccatttctctcagcccctaatgcggcaagagtcagcgatttcaaaggtacttgttttgctcatgaagtccttcctcttccttttgcccttcaccttttttcacaaggccacaaaccgcttcaagtgcatttcagtcagcctgtgagaaccatcagaacacagatattcaagagagggagagacaccaggcagctcagctctagatgggtctggcaaggaaagaggcctttgcaaatggcctcttggaacctaaaaaggaagggtgaagcctggggaccctgattctatcttgcaggctgcaggtcatccccacccaaagcctttggagccactgttgtagtctggagttcctttgaaatctttcatggaattattttgccttttaccagcagactttctttctcggtggaaaatttcttcctcccaaaaatctagccaacctggcatgtaactgaaaaattccattatttccttaacccctcatttgctcttcaaagaggtaactaatgaaagagttggtttgctttctttgagaagcatttataacagctggcatggtatatttttagctttagcttccttcccctttgggggaaactttttttagtatggcactggccttcctaatacatactacattgtaaacatgactcagtgatatctcagaggactcgatgttgccaccggctgatccttctcctgtttccaagagtccagggtttttaccggactgtgtttttcctcatcatgcctagtgtctgttttccaaggcttggggaggaatgatcagaaaaatgctgtagtgggcgagaagcctgctagttgatcatgtgttggagatccctctgcctggaaaaagccagagacctccatgggctgcatgcaccttgggtcatgaggctgtgctctccatcccccatccaggaagatttttttagacttcagtgacagtgagggttattaaacactagatgagctacagaggaagacagttgtgttctcattccccaccagactttaaaaataggatggattctggctggaataaatggcttaagttggactagcctggaagaggggaggaggaaaggggagatgaacaggatggcttctgtaagaccctttttgagccctgtagtcttatgatttctgttatttcacaagatttagagtcatagactaactatagctgttctacaaacagacaggaaaacttttaaatttgcatttactgatttttttttcttttaagatttcccgagtaaactcaggctacactaaagaaagatgtctcatgactgtagcttacacatatctttgatatctttaatttcaaaaaattaaacctttgaatttcacggtcttaggtaccgaggtgagggtaaatgttagtgccatcaactattgtcaatctagggtatattttctaactgttaaacactaaatctcattccggccatctcccatccccaccccagctctcaacattctattaggtaaaatacattctcaggaaatctcaggtatcagtcagttaagagcagggtgtggagatgaggaagccaggtgagcagggggctccaaaatctggaaaatgctataaaggatttttgtgggttggaggaaggctaaaactcccaacatactccagggtagtcattccttgctaaaactttggaccatttccacagacaaattccatggctagagctagacagtgaagccaatgggagcacagggtttgctttagagatttgtttcacagccagcctttctgagatgcatccttttggaaaagcccagcaaaacccatatggagctaaaagatttataatggattactttatgctttagtcttctgctttgcacagtaagacattgctatataaagggaattaattataaggctgtgaatagtgtttgagagattcaagttggtacataaacaatgaggcagtcttgattaagaacaactttgaagtcagacaagttggttttaaagtccagtttttccaataactagaggtatagttatggacaagttacttgacctctaagcctcctttcctcatctataaaatgagaataaatttcagtagaaggcttcttcattgacttgatccagataggtagttgatgcattcattgtactagctgtttaaagaagggaatcataacaaataagactttaaatgtataattttatcttaaaacataaatatctatatccattttcagcctttcgtatagcatgatagccttttctctaagaagagggtacctgacaggttgctctatgtctttcctgcataaatcatacccttaatacgttactgtctttgatttctttaaaatggagcaggaatttaaaggcatttgcaaaaacatcagagcatagactctctagattctagtttttctttttacaatttagcttatagttttctcactcacactgaattcaacagtagatttttaagcaaaaataatgaatatttctaaagcatttaagtttttttgcagttaactttataacttgtgtgtcattgtttctgtgatgtgttttaaaattacatatttacagtaagtacaactggcataaacaggcttgggaacaacctgtttgacccttggtacacctacaagtcagctggtgggagcagaagggcacaagtaaattacagtgctaggggagtcagtaagccatgagcatcagtaagtagtttaaagggaatggagagtagtggttggtccagaaagttggttaagtgaagatgagttaagagagcatttaagggtggttgtgaggattaaatgagaaatgtgtgtaaagcacttgccagtaggatagcccttattgttgtcgttattactgctggtaatagtaagggtgcttcttccacaagcccagcctctgcagtaaactatgatggaataggatctctggggaagccctatgacaaagctatcccattatgctaaattgaaatcaagatactttgaatcagttctacaaagagccagccttccacaaataccattattcccttaaggattgttctagtgatatatattactaaatactttaaagtggaccagattttaaaataataaagagtaaggtaaaattgtgttgatgttgcttctttgggatccattatgaataggaatagttttttaaattagtaataattataagaatattattcacacttttaaaaattatccttaagtaacagaataggatttaataggaacaaatgaggctctgtacacacattcaggccagggaagtgtgaccagtcccaagagggcagagtatttgaaagaaaaaaaaaattgccatagtgaattcacttccaactcagagtgtgatcttaaactcacggggattctcacttctttatgaaagtttggggttggatgacccctaaggctccttcttagcacttttattctttgcttccaaagtagaatcttcaactcagagagtgctgctgatgagtcgatagtactcattttgggctgggtgggggaggagagtgaaatgtctaggagaagtgggatgtgacaaagccaggaagagagcctcctgctgtattcagcattaactacatactacgtgaaaaatctaatacggttttggtccccctaattttaaaaaagaatgtgaaaaaatcagtaactgctacctggagtgtgaagggaagtctggtggacagggtgggggaattatttatcatcctgctctttgaagtaagcaccatattaatgtcatgtattacctattaaaaatatataaaatgagaaatacatgaggatattagtgaagaaagaggggaaaaagaagatagcctaaaataaaaagcaaaatgattcagcctggaataataatgctaaataaggggtgatctgataatttagaaacgtattagagtttattaataggaaacacagtatcatgagttccttagtctctgccatatagaaagaaaagaaaattggcaaaaataatactggtttaaggtcatggtgatgatgaaacttcaggagcatgctacagttataaatgtggattctaaagaaaaaaaaatcagaggatcaccaagttctgttgcttggcacctgaatcacaggccacttgaaagccattcttgcttgatgattgtggtttcatcaagacagattcttttggaagaaaagtggactattcgaaggctctttgttttaagagatctgataaatatttagcatgttactggtcttattcaagtaccaataagtcaaatattttcacagtggaagcagggacactcagcttttgccctgtctcaaaaactacccattttcggttaaaaaacaaacaacttttgctatacccaagtcaaaacaaagtcagacatgtattcctcagctccaggttcttgagaggcctcgatcgataggtagagcacccaacactgtcctacagagcctagaaattaaactttctcagaagacaagggctgacgagagggtacatagtattaagaaattgaatatactctctgtatctcttgttagtacccaggtgaaacataggagacaaaacacatattacagaggtgtctcattttacacagtgggtatatttccaaaaagttgttgaagcaacctttttttaaatcaaattattttcccattgagtaaaactatgattcaggatatgaattttcttagttgctcgttagtcttcatttgccggaactcttaaatgggggtaaggtcctcagttcctgagggtctctaacaaagtgaatataaagtattgaaaacaaatactgaaaagatttctgtagatgatttttttggcaatgtgtctaacagtcttctctgattgtatgttgggattatttaagtattaagtattcatgtttttttcttcttctctgattgtatgtttggattatttaagtggcttgtgttgtttttaacaagtcacatttatatgaagttgcggggcagggcaggtggcagctacaatgcccctctcagtggtgcttctaaatgcagaggatgtaggcttcccagatacatcaggagttagagaacttgctgaggagagacattgacatgatgatttggccagaatattgccctgggtctgcatccaatgcatgtgttgggagaatgctcaagactgcagcatgcttgcaaagttgggagaatttgggtgtagtcatgaggccttagggagctacattgtgagaaagggtgttgttcacatatgttcatcattattcaagaaattattttggcaatggcccacacctgtcatcccaacattttgggaggccgagcggggaggattgcctgagtgcaggagttcaagaccagcctgggcaacatagctagacccctatctctacaaaaaaataaaaaattagccaggtgtgatggcttacacctgtggtcccagctccttgggaggctgaggcagaaggatcgcttgagcccaggaatttgagctgcagtgagctatgattgcaccactgcactccagcctggactacagagcaagaccctgtctcaaaaaaaaaaaaaaaagaaagaaatttttttcatgcctatgatgttgttattcattctgctagatttagcagcataatgttaataccccaacacaatgttacatccaagtattaatctaaaagtccataatgacatctctgggtaaaaatgaccacatttatagatttgtttacttttggcaatgtagctctaaattcacctggaatctcaaaatattgtggctaaagttcaaagtctgagagtccttgatgcccaagagtgtctctactttgggtatgagactgacaacgtgattgaggctaggcagtccctgaaagtggatctgaactacagatcctaaattcaaggtaagcatctttgcagacctcgctgttgttcaggaatgagtattgtcaatactcagaaaaaggagatgtcttgcaagcaaatatgttgcttgaaggtttttttttttttttttgctcaatctatgagatttgtgaaagagaatttaaagctgtgtatggtcacagttctttcccaattttctgttggtgattctctctttttcttgctagagacagctgcataatttttatttgcttctagagctattctcttgctcctcttcccccagccactcaatctatatgcaattcagagaccaggctaattatggggtgctagagaagcagttgcccagagaaaagctctttaagcactcaactgggatagagctggggtcacactcgtgaccatctctccattcacgtctgcatgtctgcgtgtgagctgccttccactcttttgcagttgcataaacaaactttttagaaaggtcaacacaaggaatgaatgctttttcttaaagaacagagcaaggaaagatttcatgtttacttcttgaggcttcactactggaagaatagccacaaagtggccaagaaagaaaggatatgttcctctccttaaccagggctttgtgtttttggctgccccagcaatggcttaggagcaagaagctttatacactcaagagctgtactctcaaaatagtgtgactcttagtaaaaggcctgctgaaactctttgacccagattgcttttgcctgcaggctagtttttttgggttttttgttgttgttgttgttgttgttttttctaactccactacatcatattgggtaaatggtttacttccagagatgttaaccctgtgagaccattctgccaccctaaatgacacagactgagagaaacgaagcatgtcctggagagttcccttaagaatcctgactttgggccaggcacagtagcttacgcctgtaatcccagcactttgggaggccaaggcaggcagatcacctgagttcaggggtttgagaccagcctggccaacatggtgaaaccccatctgtactaaaactacaaaaatcagctgggcgtgtggcgggcacctgtaatcccagctacttggaaggctgaagcaggagaatcgcttgaacccaggaggcagaggttgcagtaagctgagatcataccattgcactctagcctgggtgacagagcgaaactccatctcaaaaaaaaaaaaagaaaaaaaagaatcctgactttgggaaagaagggttcaaaggaacgcctttccccattccccttccttcttgtagaacagccagcttagactcagccttttggaatcctccagactgacaaggatttgaatggggctttggctgggctatcagaactctagaggaaaggcaacctgcttgacacccagatttatcttcaacttaaagaaccccactgccaagtctacacaattgtgtagaccccactgccaagtctaaaatgggtccatgacggtcatgagggtcccattgggaatcacagccctaagcccgtgacagagtagacttgaaggcttcctttggtgctggagaagtttgcttttcttcaagtcctatcattcaaagttgagtctgactttcccaaattgttccagctctgatccacaactcccaaatctagcaatggaggcggcctggtttctaggattgaagggagaattaggacaaatgaccccttatttctcaacattcccttctttgtgacacactgtttcattccagaacatgtgttcatggcacagatctggcagggttgctagtatactgaatggcagaatcaaagtccagaacggtcttgggcaatatcaagctgtggttcagagcacacatggtggcgtgagactgacctgggtttgagtcccagttccactgattactacctgtgtgaccttggagaaatagcttaacctctcttggccttgatttcatcaacttaaaaaggagtactaagtgccacccataagcggttgtgaaagtcctctctgggtttacatacagtctttttcttgaagacatccttctattctcctactcccatctgtgttagttaccctcagtctagctttcctagtctaaaatatttgcttctgcagctctagaaaattttcttgaattttcaaaataatttcctctcattaattttcttcctcgctctttaaagaatttcagattagataatagctcctctctattgatcttctaatctccttaatgtttcttctcctattttgttttacttttaatctttctgttctactcaccaggtgattcatataacttgatctttcaaacatactatgtaattttagatctctgctatcatattttcaaattccgagagttcttttttgtctttttaaggttcctttttgtattgcattctgttcttgtttcatagctgccaaatcttttctaatgtctctgaagatatcacatttgatttttggagttctcttctgctcccaatattgcctgtgtttcttggagttttttctcttctgtttgtgttggactctgtctcaaataagaagcattcctcagttatctgttgattcttactttccttttatttaagaggaagggacctagaaccttatgtgtgtagatttcaccacagagagatcagataggaacctaacctggctgtttttgtgggactcacatatatcaccatctgcaattcttttctcatggactagcccattaccattaaagaaacccattaccagcctcctcctgagggatataagccttactgcgagggtcctagggcctgttaggagtaaggtgctaagatgacagttgccttgctgagcagggtagaagggagaatctgaggatctctctgtaccttaaacataaattctaacaaacctatttttttttctgcacgtgaaacccaatgcaaaaacaggttgtctatgaatggcttagcaccaggttccccaaaccaccaatttccagcccctccctgcacccctgccttcagaggtacctgctctccaagtcctgagcttcatggaagttctaccacataaattgccatgttttcccttgctatgggcacacacaccacctttctcaggtcttctgagccagttccctcatgtccttctgtcttccagcttacaacagtttgttgacttcaagtggtctgctgataaccttttcatttcctgtcatcttctctcctgcattctttgtcctcgtgagtttgtgcctttgctgtcatttttgtgagttttcagaaggaacagagataacattcgcataaattggcagtctattttaattgtctacttgtttattatctatctcccccactagaatataaattctaagaggtcaggaacctggtcttgttcaccatagcattccattgtctaaaactctggctggcatattgtagatgttcaataaatgcttgttgaatgaataaatgagtgaatgtgcacatcaatgaatggcatgtatttagatctctttgtgtagtccctacgccccaataaatagtaactatcttatccacaattatttcaattttgagggttagataatgaaaccaaactttatgctacttagagccattgattttaagtggggataaatctgtctctcttaaatagaaatctttaatggggagtgtctgaaatgcttttacctctcaagagcttcctcttcaagctcttacttttcttgatagtaatcttcccaccataactctcattatcaataggatgttgcctatttctaatagttaaaatgagggctgcatttggaaggtaaggggctgcctgaagatcacgttgccacatggaagaagactagaactagagctcagttcttctcattggcaatggtacctttagcctgtcactttccttctctcggtttccattgtcttatccagaaactaggctggagagaatggaaagattaattaaatgatccctgaagtttttttgaggctctaaaataagagattctgctgttctgcttagttctaaagtgccagcaaataataaataactatctctagggcctaggtcttagaaatagtgacatccttgtgaaaatgcccagtctttttaaatgacaaattggacactgtattatagcattttgtagataaatgatggcttctagcagtctacatataaatatcccatttgtaaacctctgcataaatatattttcataataaaaatcacagaaataaatacaacctaaactgattaaaaagattaagtattaatggtgaaataagtctttcatggcgacttcagctttggctgaagaagatgttgctttttccagtccataaacaatacttcacatcaatggtggcagtccctctgaccagttaggcaaaaatgagaaggtcccataatatgtctcaggtggtggacagctaatatgagaaggataggtattcagagtgcccagacctggaaaatcccagcccagagtgaagatgtgacagctttggttctggaacaaccccactggcatacagttgtttatttgatgtcctacttcctgctgtgtttatgctgttcaagctgttgtacaaatctataggcctcaacatttgggtcctgcaatgcatagctctggtgttaaatgaggaattatctactttagatcacagactttatttttttacccttctttgtcaaaaagatactgatacgaaaactaatgaccattgatatgctgtgacggatgaagaccaaaaacattagggttctaagtcttagcgtcaacatcaactttgttaagtgaccttgggcaattgccagatctctctaggtctttgattccttaactgataaaatagcaaggggagtggattagatgatattcatctaatcatgtatttaatgtttcttcctgttttaaagttctgggattttgagttaactcgggggtaaatacatgagggagacaaattgcagtgttacctataccttccagtcttctgaaagtaatgttcttggaggaagagatcaagaaatgtagcaccatcatttaaattccctcaggacgaactctattggacacataaacaatagcaacaacttctactttcaataaaatgtcggcattgctctctgccaattaccttgacagcctgactcaagaatgaaaagctctataccaaccccatctggtaccttgtgagtcagtgttcatttctgggagaaccattcttgaagcacagcttttcgttcagagagacattatggttatcttatatttttaaatagaaaaaaaaaaaacccatctaggtgtttctcttaggtctgctgctcctccagcatttaatttgaatttgaaagattctggtttgattttttgtgtagatgcttgcctaccctgccctcagaacacccacagaacagcagaaccgtaagctttgtgcaccatttggggaaagcccaaatgaaaaagagatgctttccatgtggttgggcaggtgatttctaatttagttatagggaatctttatgctactcagagccatgaattgtaaatgattgcatggaatagccaacttgcagacagggaaacaatatgtttaccacagaagcaagaatagtttttttgactttcatatagatcccctgatactgtccctctaaaatggaggattcagagaggcatcttggtcctggtgcattaccacctcctcaaaaactttcattagtcctagaaatactgtggcaaattaattgaaattgaaatgacctaaaatttttacatccttcagcaattcttcaccttcatggaaagtgttacttagaatattaacactgccttgcggcttctagcttctgcgtgtttctgaatgatagaaggtgatggcttaataaatgatagaaaatactgtttgcatctgtgcagccttgttttttatgaatgctctttttggcatcagtatccctagcgactaatacagtacctatgcagagagatgctcactgttcattacatgagtgaataaatgaggttagcttaactctctgggaagttaacaattagcattttttcatttcataaagcatcttcccatacatcattttagttggccttcattgtcatccttcctagtgcttagcatatgcccaacaccaggcagatgctcagcaaatattggatggatggatggatggaaggaaggaaggaaggaaggaaggaaggaaggaaggaaggaataatgcaggacgcatctattcataggacccccacagcaaccccggtaggtaggtggaataaggtattaccattattgtaactattttccagatgagcatactgaggccctgaaaagctagtggacttgttcaggattttgaatatcgattgttcagagtcagggtcagtagctaagcccagagttctttctgccatgagaagcaacacggtgtcaggctaagaacacaggcttgcaagtgagagaaccttggattttgaactctggctctttccactgctcagctgtctgagctttgacaagtcagctatcctctgcacctcagcttgctatctgtgaaatgggggtgggaagagggtaatggtagaatctgcttcagagagcattaaatgaggattaaatggaacaacatgtttacacatttagccaagaagccgacacatagtcggcactgtcaaatggtagctgatgatattgtgtgcactctcctgcggcctctttggaggccaaaggactgggaacagtgggcctcacaggtgggtctttgggttgcatttgggaaaacagcagtacaatatccccagctcagggcaggtaaggaggaaacagcaaaaacagagttcattcattcagttacccttccatgagatcctaaatatgcaggaaaaaccagacattaggagacctgggaacagggaagaacggtataatttggtgcattcctttctccagaatccagcccttgtgaacagctggcttctttaccctgacaccctaactggctgttctactggtatcataaggcagactttaaaatatggagaaataacgtggggacaataatatctcatccaaatgagctggggtgtgagagagaaccgcactgcataaataggctaacagcatcacaggcaattggctctaggaggggctgagagaccatccactgggctgtaatgtctttttcaacattgtgacctcaagcttttagggcatgtcacatggtgggcactccacaaatatccgatgaatgaatgaattcatctgctccaacctcttgctttgcatatgaggaacccaatgttacccagacacgtaataggttctcagcctgaatttcttaaaataatggaggtacttagaatctttaataaggatttcagtcaatctgtattgcttacaaatgtcaggacaaagacaagctctcatgaagagttctgggcactgaaatttagtggaaaaggaggtgattcacatctcctgaccctccataaaatacacatgaaatgtggacacttaaaatgtgtgagaggaaaggaaaaaccaagttgaatctgaatcaaagaaaaaagattcttaccaggaaaagcagaagtttgtcagtataggtgaagattttgaaagagcaaggtgaagtttctcttcagtatgacagaccatgatggaaaatttacctcttgtaaatctgtgaaacactatcaagtaatcaagatatatttttcatgccacatgtaataggctgaaaatgctgcatgaatgtcattagattagctagtacttttgagatgatttttccattagcagtgttggtttataccaagttattcttactctaacagctaacaactaatatttctagagcactttacaatatgcaaaacattttaatgtgcattaaatgattagattttttccaataatcacataacgtagcctttgttatctactaatggggaaaactttaggtacggaagtacagaagggccacatgacttccaactcaaatcccaaattcttctcccttcagcagtccgtttttgttttggttgatgcctaccccaacgtcaacagaacaagtatcagccagcaagagctgcgtatgtagttagagcatcttaaccttgaatgtacatacaaatctcctagggtcttgttaaaatgcagttcctggttcaggaggtctggggtgaagcccaagagtcaacccttctaacaagatcccagttgatgccaatgctacctgtccatggatctagaatgcaattttttaccatttgtgagttggttatgctctcaccagctgaatttccagactaaaagaaaatgtgcctggagctttctgcagctgattcacattcaaatggggcctgaggctgacccctgaccctctctttcctacttacaagggtgaaaatgaccacaacaagaggcaagcactattgcccaggagtcaaaatatttttctggggagtctttaggaattcctgcccaggtatcatttggattggaaccctggttcaaaatatcatttactttatctagagagcagtgcaagagtgatcaaccctgagctaaagaacctgaacagaattttgcatgggaatccaaagcaaataagataatcattgatgggaaaagtgagggtatgaattttgtcttttaaaagccccatgaaaacaaaacaagatgctcattcttttgaggcatcttattaagaccagcagaagcaacagccaatctagggaggtttggactgtccaagatgtgggacaaagtttgggggaaagtactgaggcaggaaggcagcccagtgcagtggttcttgaccctggctatcgattaaagccaccaaggtgcatctaaaagtacaaatgctctgaccctgctgcagggattctcagtgacttattctggaatgggacctgggcatcggggttttttttttaaaaggctcaaaggaagttaagtgtacagccaaggttgagaaccaccggtctaggagaaaactgtggtaggtcacaagatggaaggtggagtgaagagtttgtatttacgtgtacagatagtctattactcattcagggtaactgcattctataaagttgttgtgaacactgaattattgaatattgaatgattgcttctagagaaaatacagggctaggttcggtcacatttttgtcaacttatcaatacataatgttgttttatgtgtgtttctgtttaaagatagtttatttaatgtatattattgattaattaatgttgaactcacaacaaagaacactgtaattcatacctgaatgaagcttatcacaacagccttctttttttcctttttttttttttttttttttttttttttttttttttttttgaggtggagtctcactctgttgcacagcctggagtgcagtggcacgatctcggcttactgcaacctctgtctcctgggctcaagcaattctcctgcctcagccccccgagtagctaggattacaggcatgcaacaccatgcctggctaatttttgtatttttagtagagacagggtttcaccatgttagccagtctgtgtccaactcctgacctcaggtgatccacccgcctcggcctcccaaagtgctgggattacaggggtgagccaccacacccagccttgggggccattttaaatggtgaaattgtcaacagaaagcacaacaatgtgaaaaatatggcactaaatagaccacaaaaaggacacttgtttatagtagagagctgaaacaagaaagcagcgcttcactttgctccaccttagctgggagcaagtgcatggggagacttgaatttttggctactgtatttgtgtctgtgtatgaccatgaaaaggccacgagtattgactcaggttccaaatgaattttagcaatatgtgagtttacaaatatagaatccatgaataatgagggtcaatggtatatagacatgtagatgaacacgcacgcgcacacacacacagacacacacgcactacctagtttgtataacaggtgagggggaaccagcagtaaacaggagcaaagggagcccagcctctggatctgagctggcatctgggctcagcccagccctcctgatcaccctcacagcctgttctttttgctgctggggtctgtagctccagacagccctctccatttcatatccaataagaaatgaatgctgttcaattcctgtccttaagctggaacggtcctgggcgctgaattatgccaggaacctcgagcttgctgtgtctctggaagtcttttattgcacaactgatttataatacccaagtagatgagttgagagcaattacgtaaatgctgtttctctggggcagagaagaacggtacggtttaaatgaaaaatgcagtgccaagtcaaaaattcaaatcgttatgtataattacagaccacagtaaatcaattttacaaacacagtaccaatctcaccatgttccaacacccacagggtaaggttgtgatggtttagaatttggtaagaggctgaaggtgaagtgaaagtgggaattggggtgttgtggagcctccagagcttgtctgaatcacatggcgattcaatcaaatataattaaggagccaggagagcctaaaccatccaatttctcctaattaacaacaaaaaaatcatctaattagtagtgtaaactcaaattctggttttttttttgaatggtcatttatgtgtattgttgcatttgacatgtagattgaatgctttaatgaaaacaagaaccaattccctaatcagtaaattgccctcctcactgccatgctgagaatctgctgttctcctccttttatcaaggagctaagttaagaattagtcagggctacataatacatttctaattatttacagcccttctcctgaaactagaaagaaaagaaaaaaatactgtttgatcaaggcagagtttagggtttcatactcagagaaatcctagtcatgcatgtggctgcaaggctctgctggccgtaggatttaggcatcctctgatgatgcctgtccttacctgatcagtgagagccactgttccatgttatctgggagcctttaagcttcagtggcagtgaaggaagacctggcctgcggttcagctcaagacaggagttagtagacacagttttaaaatatcctttggtacctccattcaagcaattgactcactgctcttcttgacaagtgctggtagcaacaaggtgtaaaaggacaccctgatgatttgttcagcgactctggccatctccttgggactgatgctctgagagggtcttggtggctcagtcatgaaatcctggctatttgaagttccaaacttggatggtcttgctggttcccacactcagtagcagtctaggtggtgccgttaagcgcgggatggatgctgtattgcataaacctcagaagcactttctgcataggcatgtgagctgatgaaacagcacttacaatttgagagttatcttttaagaaaagggtaggaggcaagtttttgtcatctagcttcctgagtttctctactatctcgcttctctacacacagtgactggagcatttttacagatacgtgggaacattaaaaaagaaatatcggcttaaattcactcctggccacttgcttaactccattattttccctacttggtgaaataataaaattctacagttctgtctaaactcatttctagaaatatcttcattttatgtggatagaaattcatggacaaacttaagggtttagtataatggtagatacaaaaagaaacagtacaggaaagtagaagttaacccagtatgaaggagacttcaaaatagccaggttgatcccatcgtttcttgaattagcctacacatttgcttcaaaggtggaaaattgctttcatagttgatggaagttgtcattggttttgataggatggaatgagaggattgaggtagtgtccttttaggatttcttgatttgaagctaagtgtggatgaaatttactgatttctatttaaagtatatacatattggcttcttgtctaggtatttcataaataatgacaatgtaaagtcaaacagccgttatctaaaatagattttctactggatgacacccagttttgccattatagaggctgacaaaagaggacagatgaaatataccaaagattagtgcaataataaaagtctgccagaagcattctaatttatttcttaaaagctcaaatgtttaagtgataatgtgaaggcagaaacatacatctttgctctgcccaaaaactgagccatctgtagagtagtaagagctgacaccagtgacaaggactcacggtactaggaaagcctccccatgtgcttttccctgcatcagaatgctttcatttcagtgctgaataaaaacgagatgtcatgggggaaagaggaagttagctgtgtgtatttgtcatccctgttgtgatgttctttgcagctttttcttcttctagagtctccctttggtctgatttgcataggcaagtatacactttcttttcaccgaaagtgtgtggcttcctccttgggcttgtcaggaacatcccgtccaccaaccacatctttgctttgtagcatgttctctcttcttcccccggaatgaggtggagtccaaagtctgtttaggggaatcgtcttctggtgtccagatgttctaagcactggtttttcaagcctttggtcaagaagcagagagcaagcatgcagagttgaggcttttaacctttcagattggcttttaatctattccctgaagcagtgatgacagagcatgttatttttaaccttagtgattaatattcccctctcttcctctcccttctaccccacttacacaaatctggtgttattttttttgttgtttgtttgcatgatgtcactgatcaaatactctggttttgtatgtttcaaaatgtattcttgaagtactattaatcttttcttctccaaagattcccaccacagggcttcagattactggttgtgacaccacaaaaccaactaaagaagaggaatccagggtgtaatatcatttcaccactgagccttgcttaaaatgttgacttttttaaagcaaatgcctggaattatttatacaagtggtgttagcagaacattctttgaaaattgaaagcctttagtggttcttagatgctctgaaactggtgttatcgaaaaaatttgtgggatagaaactggaatatccctgagaagcaggccgaaacctaacaaaatgaacagaaacacccaacccttcccaattcctttgaaacaatcacctttttgtagctagcagtgggctgagctttttcttctttagacttgataagtatcaaactatctcctgcagcaaaacttaagaattatatgctgtgaagcctcaaatttttgttttcagcaaaggttctagtgatacttctgaatttctttggggaatgagcctagaaaatattgttaaagtaacagatgagtaaaattagcaacatagaagtaaaattctgccctgctttgtcctaagtatgtggacacacagcatacatcacctgagtcacagggaattggccaggacctcttaattcaagaagaatattgtaagatattttaaaataatgtgcaaacacttggcatcctcattctaccttttaaaacccctaaattgctatgacttatttttataaggtttagttgtgctagctatttggattgaattatatcatgtgagcatcttgaaatttgaaaatttaatgaagcgtatgtttttctatgagaaaggcagcttcttgaattaaaaatgaagagagactagcttagaaggaaaaaagattaaagttgcaaatcatctctatgtggctggactcatagggcatgatgagagcacagaacccaaccttgggttgagaacccagggaatttggtttggtatagagaatgatattaggagtgtaggaatatttaatgcccttattcaaaaggaagtcaaatttctgacagtttcagcagcttcagcttctagactctaaaacaaaatgctaagcctggaaatagttcaaaacacatagtgacagcaaaaagaaataatggttggcttgaatttgaggagatagttgaacaattgaaggtatacagcacacaggttcctgaggctacccagactgcccattgaaggctcactcaacaaagacggcataaagcaacaaatcatctctgtcaaatgagtgtgctagaccaagagtacacatgaacggtgtaagttaatagctaatatttaaaaatcggggtccccattaaaaccacaattgtatttcaaatctgctgatttttttaaaaaagacgaaaggtctatgtactcagcataggtttaatttacattatattaatttgttgtattaattccaataccctctctatatgtagaaaagtcatccatgacatagtatttcatccactaacaaggcttggtgtacgtagggattttggggtctttctactacccagagacccacagctcccagattaggcattactaaattatattctttcagaaggcttccagttctaaaatgttaggaatatatgttcataacatttttaaagcatgctttaaataatttttaaatcatttaatttattataaattattaaaaattatgctttaaataatttttaaagcataaactgcattcagcgtgtaaatttaaagatagcagagaaatacgcaatgtatctttgacaaatctttgttaaagtttgttgggataaagttttggtgtaagactcaagcttcagttatctggactatttgcttatgtggatcacttttctccttgacagtgaggtatgtatttaacctaacaatgaaccaaggagatagttgggccagtatcccagactttcttccatccataaacccccttatttctcatattagaaggcagaaaaaaggtagttatagttaattttccttaaagagtactaaatattctgaaacatcttttcctgactcttatttcaataaataaaatcgagatggagtcaaagttggtcaaaggaaatgggaaagaaatctgaatcccagggtttaaagaaaatacttaaatgaacagaatgcagagccaggtgtcatattttccccgtaaaaggtgctgaaagagttctcattaaagatgctaggagatgaaaaaatcattaggttagatgaggtcagaagagttgactggtcctgatagtatgaccaagtttaaaacaagattataagaacctctgaactcccatcacactgcccgactgctgtagcaagattacttttaactgctgtttccatatttcaactagacttacctaatacttattatttacttcggattcatttgaatttaaaaagttccaaaaattagtgtcctaatgatatatgcatgcgtgcatactggcatatatatgtgtatatacggatctaaaatttttatagaggtttttaaaaatacaagcaattttggattcatactgtatacaattattaaatgttggtttccatgttttaagaggaaaaaggcacaattttgttcccctgagtaattttcagtatgcttttcaatataatgaatccatcctgaaatatgctgtccctctacccacactattatgaaagtcacaaatgcagtataaattgaggacctcagttctgctggacttgccaatttctaatctaggttgagatttttttttaaaggtatacttaatttggcagcatttgaataggacttctgggtagctgaggtctgaatgaaccgttagccattgtctgctgcacatcagtctacaagcaagaacatctagaagcctctggctagagacatgctggggcagctagcaccacactgctaagcttctcagaagtctgtatttactactcttcctgcctactcataggaaaaaaaaaaaacttctgcccgaatgtccatatgaccctctgtttgtcatcacttcaaatgagatctcttagtttaaaaaggggaggggctggggatgaaacaaccactgctactctgccactggccccctcgtcaattccacaactgcatggcctattttcttgtagcctctttctgcccatgacagtatttcctctgtcactttatgccaaacaaagtgctccagcacaagaggtaacaccaaaatcagctttgtggtcaccattgcctaaacctgaagatctgtcttcaccccaaattggcactgtcgccaaggcacctgtcacctgttttaatctccttcccacaagaatacaagcctgtactgcctccaggccttggttcctttggagaacagaggcatttacctagcacgacttttgattgaggtgtggcattcagcctggctctaaacccacggccctgtctgcaaatcagaagcttggtgtgaggcactgtgcttggttgccacagcacgttggctcctacggagatattcctgaatttggtggcagcagtgggaaccaagaagtgttcattatgatatagagtgtatgagccctttatagaaagtcatcaggaaaagaccctggcacctcaggtataattgatgtttccttagaggcagaggccaagttcatgtcatatcccttatgacttcagttaagctcagaaaagtatgaagaaatgggtgtgggtttctatgtacaaatccctgtaagtccattaagttaggtaaacatttagctccaatctcaatagccagtgaagtccttggataactgacagcttccccaaggatgcctctcagtggaggagatagcatggattaaaaaatcagatggaaagaagcatattggctccatgaaataatggaattcaagtacagtgtacgtattgtattgttctcagcatccatgtgaagatgaggactatcctagcagtaacctcccgtggttagcgattagttacctattcagttatggcctctaaccagcccaggtactaagagtcccactgtctctgagctgtgtgtccctctttgacaagccctgtttctgtgatttcagactgactctaatcctggctatacagaggaacccccacttccacttggggtacacctggcaggcaccagtcaaagcatccaccagatagtctgaaacggttgcagaagtaccagaaagcaaagatgtctaagctggaatgtcccagcactcagggcagccgtaaacagtctgcccaattttatataaatacttagacaggcatgaaatggattttctggatgtctggcttttcttcctattggcttctcttttcatttttgctgccgcttcgtttttttttttttctttctctgctttccccccacttttcctcttgctaattctggtccaaccaggtagcaatgcattttccagggagcctttttaaatagtttcttcccgagtctatttagtagcaatgcaagccatttaagcctgttagtgtcgatattttttaaacaatgttccctttgcatatttttaatttagatgacatttccttgcctttgatagaatctacccaaattggaaatttctcaggttactaatactaaactcggtagctctcttttgtcctcccttttcattcataaagaagtttctagcccttccgattgtccccacttcacatacaaggctgcccttctggccacacaaggccaaatggaaacactgaccacagaggcctgagctccgtggctctcaggcttggtgactgccagctgcctggcagcagcttacccagcccactactgccccagacacactttctggaaacatccagccttttgactctgctctttatcttttgaagtagggaacacagtaatctgcccaggcctttatgttgggactgctctaccagaaatatggtttaaccaaaagcaggacctctcaccattgagatgcctggtctgcttactgaaaaacacagattaacacccacaaagaagtgctcatctaaatttgggagagcaaatgcctcatggatggggatacagcctgagatggaatttaatggcttccctgaaaaatgtttaaaaatgcatgtggctcaattccgtgttagtacagcagcagtcaaaataaactggacctgtcaggaactggtgctgagagaatgttatgaatagacttattttgtaaagttgtcactttacacaccagaaaaaccaaccaagggtaacatcggctccttcagtgttggtttttgttaaatccctccctcgaatgacttcaatttaatttggctagttatatgagttatgttgctttttcctagttttctggaaaagaaattaaagatgggggctgcgcagatgttgcccactgtgtagaagggctgaacatgctggtaaaaaccattcattcccagcttcctgaatgaaagccttgttacctggaagtgtttgcaatacaaagtttggcattaacctgtgaggctaagggaaagaatcggccctagaagaagcagccctttcaccgacaggtagctgcagtgccccataccctgaggtcatgttagtactggggcccttgctgagccataccaccctgcagaggccatagttccctgaatcctggttggaaagattagtccaccttcttctggttcagccctgcaaagatcccaaacaatggccagcccggctgcccttcaagatgtcctcctgaacaacatgggtaatgtcagaatttctgtttaaaaaacaacagcaacaaacttgtccagtacatgttctttttgcttttggcagatatggctgtcaagccttgcctgatttacggaccccgtcctatgaatcctgatttctagagttagaaccaaaaccagatccagacccacaaaggctaaggaccaatgtgtgggcactataggtttggcctccttggagaaacctaacccactgagagggacagactgcatccttttaaaccacctgaagaaaacgaccatgccaggcctgtattcaacctgctgtgaccatggatggagttgtaagacagttagtggtatctctcagggttaagaggtattgtgggttcttcggtgtcccaggataaaggggggggaataacctatttcattttatttttttttccagttctctcaggccaggcacaccacagccctttgaaacgatctgtgtcccttaccccacccatgaatgtgccaaaccagcctctaggacatggatggatgtctcatgaggacttacgagctagaggaccccagtgcctcccatccgatcatgcccccctgtctccacaaagcagtgtagcctcttcaggaagtggtgggagtgaacacttagaagatcagaccactgctcgtaacacattccaagaagaaggtagtgggatgaaaggtgagtgactaaatgagaaaccactggggaaagagcccctccctttattggagaccagagggtaaaaaaagagaggtagtcagcaagagagaaggagcccaccccttccccaggcttacgcatttgatctgtcccttccagaactccaggttgaccatggcagaaagggctcagattccccttccagtgcttcttgccaaaatctgggaaataggaaccagagtaagagaggtcaacccactctctctctctctctttttttttttttttttttgcattgcagtgacttgtagaccattaaatgagtcacagctaatggtgataggatcttctgtttgtaaagctactgagctgctccaaccttgtacctcattgctgtggccagggacctgtcagtaattcagaaaaacaaaccacgggatttttttttttcctttataagtctatgttaatgcagaattgcagtagtgcttcctttctctctcctcttctctttgatatccaaagaaacctttaaaccctttcctctgcatctatttaagggacatgaaaataccactgagaatctctaacagtgttttaatcctgataacagatttgcatacaggtgataaaggccttttgtgtagcataaataaattcctccattgccttgtgaatctaccctcttctaaaagatattcatcaggagatagatttccaaattacttatgataggtacaaagaggatacgtgcatgctatatttttagactccacttgtacaagggctgggaagcccttaggcaaagatgcacattcagagacacactagtaacaattttagatggtgaaacagtaaccactcatgctttggggactagcatgctgaagggaggctctgagaacatcctgtttgctggcattaatagtcctgaggtttgctgtttccgatcttccccttgtgaatgatcagtgttgacataggaagctctgtactgattcccctcccttcacggaagcctggcacagaaagcatgcccatgactgcccaaccactggttataagggagcaccggactgaaaaaatggagcttgtcaactctgggaatgaggctgacaagaagctgctcccctggcacattccttgaatcttcctcctgcttaggcctgtgtcctctccatcccacccccatttcattgatggttccagggctgagtgcccagagtgaggggatgtgtcttaatgctgatacaaatgggtctttaaaggtatataacaggcagcaaaagccatgtgtcacttgggtacgaaggggatgtatgtcctctttctacttcagagttttcaggggactgtatcacaattttggagcactagcaaaacccacttctgactttatgctacatggttatgtgtttaagcagctgagccccaggtgatgcgtagcaggtgaggctcaaccctgctgtaggtagactggcttggcatctgtcaatcggcatcaaaatagctgaaagaccaagggaggctgagacagccgttgcttttaactagcttctttccaggtgaagttcagtgtctgtttccaagaaagcctgtgttgcggttctagttggtaactgtggggaggaagcattggcctttgtgtttgaagggtaaggaggatcctatagaagggccattcaccaggagaaagatcttgtccaaagaagaatgctgattccactgtctggtttttggacacttattcttcttccttttactttgttttctttctttccttttctttttttttttttttttttgaggcccttatgcacactttcaacattctcccaaagtaggtcaaggtatgctcattgagtgctgccattttgaggtgagaaataaagataacaggttttttaagagaaatgagagaaaagttgaataaatgccctatccccattttgggacaaaagccaaaatattgcaaaggttaaggaatataccatatctaagcctctgtgattcctttcattagaattggtgagaactgtctcctcagagcctattcagtcagaaaaaaatggcacagacaagatctcatatccaggattttctttataggcccaaggggtgcagccagaaaacaggttatttgatggcctgctgtatttccaccttctctgacctattgaacttcccttcttccaagaacttccttggattgggattccaagtataaagtcaatagcaagttaaatggcaaaaaaaaaaaaaaaagtttgaaggaagaaacattatagatgatgaaggattctatttgtgggaaaagtatatttgcagtttagctgacaggtcagacagaaaaaatgtccacacccaaaaacactagcattccgaagtgtcacgggccagtatttgttcaatagaaatgtccctccccagccttgctgcaagatgccattgctgaggactcttccgccaccagatgttattcaaaacgacttcctatgagtgcacccaaggagcagccctgctcctaacccaagggtttgtcatttgatctccgtgtctaagagcaggtgctggtttaaattttcaaaataattcacacttttaaagaaatgagatatggctgggtgcggtggctcacgcctgtaatcccaacactttggaaggctgaggcaggcagattgcttgaggtcaggaattcgagaccagcctggccaacatggcagaaccctttctccactaaaaatacaaaaattagtcaggtgtggtggcacgcagctgtaatctcagctactctggaggctgaaactggagaatcacttgaacccaggagatagaggttgcagtgagccaagatcgcgccactgcactccagcctgggcaacagagtgagtgagactccatctcaaataaaaacataaaaaataaaaataaataaatgagatataaaaccaagtgaggtgctttgaaaaagagctgactcttcctcttggctctacaatctttcttttctatgacccaggccctttggcaggagtgtcagctgttttaaagtacttgctggtccactttggggtgccatcatctaatgctattattctaatcgttaaacgtccagtttagaagaacaataagaaagcttagtagaatttggaagagttctcaaatccatatggaatgtgtcttgctctcatcgtgcaccttgggaaaagaatgaaaagttactatagttgaactttatttagtgtgaattcctctttatggccaacagctgtgaatatctctctgaaacactgtggtaatcatccattccttcctttcatctagctagactggccaggtctggctacacatcctccgttaggagtgtgcctcttgggtcaagggtatggaataaatctcatggtccagcattcttgctctttgcgtttttcccatgcatggatcaagcccccttcttgtcttggtgttagcgttccctgccagggactgtcactaagttctctcccaagcagaccagctcctactctcaaaggattaatgacatctgcccacagtgctttggttttccttctttagtaaatgtccatccttatggtttaagtagacttcaaagtacagattaaatgtctcttgaggtaaagatctcacgctaatatctcaagctaaagaaaaaatgagatccacaatttagcttgaaactaacccaagagaagtgggaaacaactgaaataggaactttcttccctttacccttccctgtggaggctactggttatacatgtttggactaaggaggctggtttggtttctacatccagttgtgtttgttcatttcaaaaacttcactgtgacttatctcagaggaaagattctcaattgtgagttggtactcaacagtaataccattctttccctgggcaactcatgagtggaatgtgctctgttgcctcttgtctcatacaagactttcaggtggccaagaaaaagagagagagaaaagacgttctcttaatttcctggagagaaagtatagaagtcatttggcagaagatgcacatttcccacttacattagcaccatgttctcaaagatggtacataaacccaacacgctaagacttaacaaaatgccacagctatgatgaatgatgtggctgcattatatgggaggaaagagcaggggaaaagactcattcacaggttacttttgtcctcattcaagtcagttgacttttttgagcacctgctgagagaaactttggactaactagtttctgggcagacagggctgagagctactgttcctgcctgaagcgaatcactatcagatgagcaaaaaacaggcacttaatgcaagtgccctgctatgaaaatatgctgtcttaaagacttgccctgggtcagggcaggcaccatgaatgaccctcattcaaagtggagataagtcaaggaaagttcctagaggaggagaggcctagagctgagtctcagagcatgactacaggtcagccaaatagtaagtgaaggaagggcattctatgtagagggaacagcattcacgaaatcacaatgacaagggtgcttgaccaagtggatcccatggcttgagtgttaagggcacatgggaaaaagaggtctggagagggagaaaccagaccctgggccttgcaaaggacattctcttttatcccaaagctattgaaggaacttctgcagcagaatgacctgcttaggtctacatattagaaatatgaccttcaaagcagagtggaatatacatcaaagtgcggaagggacagaggattccagatttgaaggccagcagagaggtggaggacgtttcagtaattgagggggaaaaggaagtgggaccgatgcaagcagcagtgagaatagagacaaaggagtattcggggttcttcatgagatagagctgagagggcttggtaaccaattgaatagacagtgatggagcaggagaaatttaggatgatgcccaggtgtctgcctgggacatatggataagccatggtgtcatctaaggcaaaggacatagaggaggagaaatagaatggggggggcagcatggggcctggtgagtgtgggaactgtagaacatcccagtggaggtgtgcaaccccctcagtgggccccacagtgcaccatgctcttggctgacccagcctcactaacagccccgacttcctctcctcgcctgcagtttcagcataatattacacttacctgaagccaagttcatctgagggacttcattccagatagctgggtagaaaaagccatagatttgggctcctaggaagcaaggagctctatgactttcttgttgtacttgcctgtgtgaagaggggtagagattggcactctgtttctcttgctgcgagcttcagcctcactgttacgaatcaacaccaactgagtatgcttatgatgtttggcattatgttagcacacaaatgtagaagtcattgaaactgatgtattatttgtgtatagacatgataaaagtagaaaaagaaacaactggccccaggaaccttgatggaaatatagcaattaagagtggaggggccattgactgtgaaaatatgttgtttgccttttctaaggagactttcgttagatgaaacttagaaaaactttttctctctgtagtaaaggaaatatgtggtctactctgaaatagcgggtttggggttttcagttctttttgaaatgtagacctttgaacctctgcttctccagaatgagaatggaaaaattatggagaggtgagatcctctttaagaaaaaggaacctgtcagaaacctttgtaagaaaggttgcagatacagcagttctgagggtcacagaggtctgagtgatggagtgggagtggcaaagctccatgagtggctgggacatgtttcagcatggctgtcattgaaactggtcattattttcttgatgctgactttctagctgcctgctcgaattcacttaaaggaaggccagtattgaataaatgtgctttatttttgtttttaatttccaaatgccaagatatgacccacagggatgagtgcccctgggccaggagttgtgctaactcttctctgataggctgagagccctgaggtctttgaaaagcaagtcctcaggattcccccaaattcgaaaagtcctgagacttttaacctccactctttaccaagcatgtattttcctctgaagctttaaggactgtgcaggcacacaaggcgcagcctttgatgtggacacagccactgtttaatgacacaaagcaggctgctttaaaacagcactttcgcctgtcatctctaacggaaactgcggggagaaggttaggccctctttgtgtctaacatgtcaaagtgggtattttactccaaaataggccacctctcaccttccaggacccatatatgcttcctacaagcctggagcctccccagaggcctccatggacacttcccagtatcaaggagcacactgaggaggatccagctccaacgaggcccaagaccaatcctgctctcttttgcacaaaggctggaacagagttgggctgcttgttctgctctggccagaaataaagacaagcttctgtaaccttgacagtgctgctaaacttctcttcatttttgaaaggaacatcttccatcccacttcagtagtgaagagtgggtaccttcttacccctcagttggctttcctcttctccccctcagagatcaagggtgcagtcatatcttggagggagagagcttttgagagcagtctggcttgctgtggtgaatgggagttgatcttccatctgcagttaccaggaccacccctacgtgagcccttgtgtgggaacaaggctgttcatgtttctgtctgccagagatgcctttctccctgcccttcatgctgcattcgatattgggctcttcagcaatatcgatcccatctttctgtcttctggggtttccttgtttgtgggtcgggtgctgcatggtctgttgatctgactcaaatttgcagccatttctgcagcatgcattagagacaagcactcccagttctaactggagccctgcttctgtgtgaactgttgtacacaccgcacagcctccctgtggctggtttatctaaattctaaaaaggaaatagaaatcagcatgatttaaaactgaatcccactggtaaagaccagcaggcaaatatagaacatatacaagatgagtgtagcactattatcaagaatgaccatgagaagataaatcagtgtggacttgcagcaaggtctaggagctttctgaaggatgaagactgtgggatgagacccactgatgtgcacatgcatggtggtgctttgtcccagaaacctcctacctgttggcattctctccttgcacttccccctgaaagtctgctactcccagagctctagcatggctctcaccccatgctctttgccagagagattcacccacttctgtggctaaaacaaccaccatgaactactgacaaggaacctcgttctccagctcagacttttcttccaagaccttgactggttgacttctccccttgtatgacccaaaggcattgacagccagctgatctcaaatggagtttaccctctctctcttctcaccccaaacctgctgctcccctgttttctctgtctcaccaaacctgaatcaaaggagtcatctccagctactttgtctctgtcactccctgctcttccctgatcttcaagtactgtcaatttccatcctttctttctcccctgccacgcatcccaagccatcatcaggatcttccttaagttcaggtcctggccttcactgtcaccatccgccaggccagcctttacattgatagccattgcctttctagcacactcatctgattgtgttctgctactcaggtttcagcagtttctcaccacccacaagatgaagtcgactctctttgttcagcattgcatatctcagccatttgaccccctgcctatttgacccaccttgtctctagccattcccccatccacccatgtgtctgctctaccctgaatgccctcttgactctgtgtttccttcctgcttcctgaaatggcttcctcactgtggccatcctagtggagacaccaagttattgtactttgaagctgcccctcgctccccatggcaaaccaaaaggctcatcgttctgtgctcccctagaaccctatgtatactcagcgcttgtcctattgctgttataatttttgtataagtcagccattctctctagattaaaagttccttaatggaagggtcatgtcttcacagagcttggcccccataataggcatgcaataaatgttgaatgagcaaatatcaggattcccacacttggcaaagaagtcagcccagcatatagcaaaagcatctttatctttctcacactgcataagagagtgactttctagtttgagacccccagtctcaaactgaccccaaggaagccaaacaggtgtgtgccaaccagaggcatgcatgccttcaatcacatatcagcttctgcaggaaacagttctgcttctccctgtttgcctgcattttccaaccatagccacagcccacagcttcacagaatgtaaaaggtagatgggaagttacagtaggtggttcttagcattgcatccaacaatgtggcatttggaccatgggaaaggacctgagcttttagtttgagtctatccctggccaacagcttacagaatccagcatccaagtcattagaattcctgactttgggggaatgaaatggtcaaggctcttgcttctctggtttgtttctcttttaacagttttgttctaatccttggcaagggaaggtacctcaccacaatccagagggtgaaaggttagtaggctatgttcttaagaactgggatttcctcttctttgtttttccgttctccttacaggagggagtgctctttgagcacatggcactgagataggacaatgcttgctctaaaaacagtgtccgtgcgtacctgcctcaagaaacacagggccaaaaggagcttacattgcccaggaatgcatctagaagtaactcttcaggaaggcctaactcatcatgttttgaagttggataggagccttttttaggaaaactactcccagtgttttgactaaatgaatgaggccagctcttccactcctctaaccagggcaattctaacttgtcaaaatagttttatagaaaaggatctagcactgattgagctgggatttgcactccaacccacactttctgactcttaaaacaccacgttatcaccttggtttataaagcaccatgtttataacacgattcaatagctcaggattctgttcatcatcaatggattttgcatggttcagctgtagggcacccagtgaaaatttggtccaagagcctgctaccttctcttttgtgatgaattgtgcccaagagcagcactgggttacccaggcttctctgaatcatgatcattgagttttctgagcagtgacttgggactttcaagatgtaaatagcaaacgtgaaacctggtgacagagtggtaacatgccgttggcctgaaagccaaagctgtagttaaaatcagtgccgctcactctgcagaagcattagcattatttcagcagaaataaaagcatggtggaaaatgaagcctggtgaaatagctccaggatgttgcaggatagaaggttccagactcctgagctgccatgtcctggactcttgatccaactgcaatttgagtgaggatgatgtaaggggttagtatgatgtgttggggaagccttgtctgtttgtggttaataatggtcacagagggactcttgcttgtcatagtagagtgaagggctttcaagcacagaatggagtgatttctagcctgagataactgagtctgttcttaagatgccattgactgtccaatttcaattctccagaaattccccttcattggcctttgcattactgcaaatcaacaagtaatctcaccaggcccatcatccccacctaagtcttttgagttcaggagattatcccatacccgcattccctaaacctagagttggttcactcaggaagcagggcctgatttcagaatagtccaggcctctttcatcaatctcaacatttatctactctaaacattgaaaaattggaaggtgctcgcttgttttggaatgtgtgtggtcagtgcctcagaataaagcatttagcaattgatagaatcctgtaatcgacatgattggtaatagataatacttcataaaaaacaggaataacatttacccaatgctttagcatttcaaagtagtttacagccactgtttttcagccactgataggctgtttggtcctcattttataagaattggtacattgtaggaatgagctaggaatcaggagatctgggttctggttgccatttcaccacacacttgctctgtgatctaggattaatgacttcatttcgccatctttagaatgatctagggatgagggaagatgattctggaaactttccaaagatcctatcagctcacaaactctgactgaaagaatatgggcaaatactttgttttggttttatttaacaaggtaatagttctcctgtggattttcaatgcagttaccctttacttttcttaactttagaatctcagacttgggggttatttcagatgcactttagaacttccattatcctatggcctagccaatctttgggcctttcaagtcctgatatatttttggttgacaatcaagtaaaaagtcaaagatgcatccggatacattccatagcttggagaaatggtcagcggacacacccccacgacagaaagagttttggggatcaggatgccctttttcccattcaggtatatatagggaggcatttttcatggggaaagatcaggctaggaatgagtgactccaccattttcctatcactgtaggagtggctgaaacagtgtgtgaaaatctgcattgaatgtacaaaaattatcttgaggtcatagtctgctcatgtagctctaacattcgaagccagctctttccaactcgatgaagcggtccagctaatgcagttgttccctgccatctttttggtcatgaacccctttgggaatcttatagaagctatggatggccctctgcccagaaaactccccatctactcacaaattgggatataattttaggggatttctgaatgccctgaagctcatggaccccaacttagtactcctggtctaagtagaataaaggagcccaccagtaggaatgtcagggctagcctgagacttctgcatctcagctaaaattaaatacatagtaacataaaggtgttactttttctttttttttcctttgaccatcaccctcttttcctttctctgttcctacatctctcgtcatctcttctcattccctctcatttctctccccatctcttgcacatcttgcaccacagatgttccagcctggctgaaaagcctccgcctgcacaaatatgccgcgcttttctcccagatgacctatgaggagatgatggccctcaccgagtgccagctggaggcgcaggtatgtgcttgaggtgactgttccctgagagggtgccccaggcaggacctgaagttcaaggcctggacaaccttgtttggacccatacctatgcccacacagtagcttgccctgtgctggaaactgtggggtgctggccagcattccatggtgagcaaaactgggtggattcttgccttcagggtccaataggagatggaagacaagcagataactgcagggtcgtgagggtgagatcaagtggtgtgaaaaggcataatctcggcacacttgaaagttccaggtgccagggaggaatcggtggattttcctaggagaagtaacatttgaccatgccacaaagaatctacatccctgcctttgcttttcttgctctctccctccctctgctcgagcagggcttggcttgtttgggaagtgacagatccattgtctgttgtctagtccagttacaaatcagcctgcttctaactggactgctgagtagatgcaccaggtcatgcctcagacccgccccaacatttttaaaaagtcatgttcaggccagtctttgttgagattggagtaaattatacaaaatatttttttcttctaacatgagacaatcattgagaatgagatttccataggtctcagatttcatttcccttctgcatgccataaaaatacaaaggttccccttccttctaaggcatctttccccgatgtggatgccaaaggccagtcaacagaacccctgaaactaagcatgtttcctaccacgctgtgctcgggtaaatggatctgaccaatgtctttgtttcccttgtttaaaatgctatttgcatgtttcacattggcctcagtttcctttcagcaatgatttaaaagaatcgatggtctgaataggctaagaatatttcctttgcaggaaaaggagattgtaccatttgggcatggctggtctggacgcatacctccccgcagatcaccagttccccagtacttattcggtaccctcatttaaccctgcaggcctggcggactcccaatatggagacacaacacaaagcccaaagtcactgcacattctcagagaatgaaaggcactcatttcaacttcctaacatttctcccacctctttttggatcttgattgctccttgaaatcccaggggttgatgagagcttttctaagagcatttttgtgtttgggtcagagttgaggaaaaaaatctaagtcatcagttgttcgacttgaggaaaaaaaacaagaaataattgagggcaaagccagaggccagcacaaccttttcagagtaatttaattcactagaacccaaagttaagggtaaacagaaatatacccccagtgtttcatcttagagactgggttcacgtgtcatttgagtcttaatttttctagtaaagatgttgttgatattcctatcttttccttctttaagaagaattctatggaatagttgcaagatgtttgagttagagaccttatttgagagacggctgtctatcaggaaatttgcagtatctattatcaacaactatttaagtaaatccttaggctcaccattgctacccagttaagaagataaaatccacaactcttactgtgaatcctaatcatttacctgaagagatgactgaattatgaatttaagtaattttctattctagttttccttagagaaacaaaagacaagctgcaaactaacaaattccccatgttttatgacactccatgtggactctactgggctgctcatcttttcaagatgggtaaaaacacagggagggtttgagaaagccatgaatatctatatggggttgggacctttagggaaactgagaggggctgaaattataaagcctggagaaaaggaagagtgcatgacttaaaaattatcttctaaggctgtgaagaaatttcatgctgggtataataattggctgttccacatctctctctaagatacaggaagatacgaatacagataaaaagcacagtcaaaagacacgggcaaatatgtagccagacggagttagaattaagaagatggctgggtgcggtggctcacgcctagaattccagcactttgggaggctgaggtgggaagattgcttgagcccaggagtttgagaccagcctgggcaacatggcaaaaccccatctctactaaaaatacaaaaattagccaggtttggtggcctgtagtcccagctacttgggagactgaggtgagagaatcacgtgagcccaggaggtcaaggctgcagtgagctaagatggcgccactgtactctagcctgagcaactacagtgagaccctgtctcaaaaaataataataatatttagtaagaagaggtttatgatgatgggtactaatgcaagagataagtggatattgatcagcccgtgaacatataggagcaaagaagacagtaaaagcctccaagaatctgtaagctgattcttaaaaatatgtttttaaatatacatttaaatgtaacttgttatttaattacagaatgttaccaaaggtgcaagacacaaaattgtcatcagtattcagaagctcaaagaaagacaaaatctcctgaagtctttggaaagggtaagttatcggatgagggaacatttccactttcattatgggaaaatggaccaaggaaaattctccactggaagtgtcatcgacagaccttctagagcgtaccatgtggtttccttaccaaagtcagagaaaacggaatgattttgaagtgaaacttcctggttgcacgtgcttctttgaaagctgatgcctcagtgtgcttattccctgggcccaggctgccttgcctggccgtcctagagccctgatgaagtgctgtcaaatgcaccctttttgtatacgtttgtgtctctgcctcgtatacatttgtagagatcagtgaggtgtccagttcacaatcagaggctgaaatcttggcaaaacagggcagggaatatgcagtgtgctttggtctcactgtcctcccaggggagggtctgttttgagaaaagctgcccccagagtggtaaataccaacaggtacactgcagatagtggggttcaaaagcatttggcaggcagacatatttggctctcaagagaataattccaggctttaacttaacaacagaatgggtccctgtgactctgataggaaccatctcaaaaatgctaaatgctgaaaaaagtttattccaacgttaaaagcagtgatcagctgcctactgtcccattttatttgctgcctagacaggtcctcttcttacctttgtgtctggatgctgccctggtaacaatgtcatttttaggacttaatgatgacatgatttcatctaagatccaaaggagggcaggcctcatgcctcacacaagtgtgaaccagcattgcttctgcctcagggttgggattcttatgcatgggtactgggaggcaagagtggtgagtgggaagttctgtgggtatttgcagcctgcagagctttagaggtaacctcttctagtaatcccagggagcttttggattttggaagggaacagagtattgagggaggtagcgctaaagcaagttttgtgagcacatcaacatttaatggagtggtaatttttcagcaggtgcacaaagatgtgtgtgtgtataatttcgtatatgaaggggtggcctgcccctccacacctgtgggtatttctaatcgggcaggacgagagactgagaaaagaaataagacacagagacaaagtatagagaaacaacagtgggcccaggggaccggcactcagcatacgaaggacctgcaccggcaccggtctctgagttccctgtttttattggttactatcttcgttatttcagcaaaaaggaatgtagtaggagggcagggtgatgataaggagaaaaacatgtgagcaatagaatctacatcataattaagttcaagggaaggtactatgactggacgtacacgtaagccagatttatgtttctctccacccaaacatctcagtggagtaaagaataacaaggcagcattgctgcaaacctgtcttgcctcccatcacagggcggtttttctcctatatcagaattgaacaaatgtacaatcgggttttataacgagacattcagttcccaggggcaggcaggagacagtggccttcctctatctcaactgcaagaggctttcctcttttactaatgcacctcagcacagaccctttacgggtgttgggctgggggacggtcaggtctttctcatcccatgaggccatatttcagactatcacctgggaagaaaccttggacaataccccgctttcaaggacagaggtccctgcggctttccgcagtgcattgtgcccctggtttattgagactagagaatggcgatgacttttaccaagtatactgcttgtaaacattttgttaacaaggcacgtcctgcacagccctagatcccttaaaccttgatttcatacaacacatgtttttgtgagctccaggttgggtcaaagtggctggggaaaagtggctgcagcaaaactacaaattaacaacatctcagcaaagcaattgtttcaagtacaggtctttttcaaaatggagtctcttatgtctttcctttctacatagacacagtaacagtctgatctctctttcttttccctacacatatagactatataaagttatttttaatgcatatatgttatatatatatttatagaatatacatatataactttgtaagaaacgtttctttttaaacctctggccagatagacagaggcttctcacgtgcacatccgtgattaaagacctcttcttacttaaagtgaattacaaattacaagtgagctatccagttgaacctgaggtttatttgttgttgtttttaattttatactactttagaaagcagcttgtctaagtgactattgccatttttaaattgagaaaccattctctttgggggaacattcaaaaggccaatttactctttctttgttagaaagtacggaaaacattttgcataaggatttcattgctaagtgttatggtaaaagagtgatttcttcccttctttctggagcagccttgaggattcattcatatcctccatcactgaggaagcgcacccacctgggagacaaattaccgttagctttattccctgcagcctggcagaagtcagcatggggaacactctggcaaccaggtagcaagggtgaccctgacatgccatcgactttccatctagcctttgataagtcagtgatgttttccgtgtcccagattttgcacctagaataatagtgactcccctgttcactggaatgggaaagttaaaaagatgccacatgcagagcaaagtgtgatggcagccagtggtcaagtggaaagaaattgtgagtttatcgagtctgacttctttgagagagaagagagcttatgtgtgtcagatgactggttgagcttgcatcagaataccccaatgtttggacatcctgtatattgtccctgcgtgagctgatgagatggggtgggaggcagtctctctcaggcatccactgaggacgcatcccctggccctcctctgtcttctctggaacccctacctctcctgctttgcaagggagtgagttgtttgtaacctgttaccactgacggcaccggtggcagactcaaatcagccatttctcaggcattcacagacaccgctgggctgatgatgctgttggaaaaaaagtcatctgcccttgcctgcctcccatattcttacctcacatagatttctaaggagatagctggggccccgcccatagttagttcataatcagtggtggctgtctgagttctgtgtgcagagctcttttgttcagttactgaacccttatcaagcagctgcctgggactcaatttgccccatccattggagattaaccgtgagtcatacatggttcctgcaatggggagctggggacgtgcattgggacagttagatatggcaccatatgatctcacaacccagtctgatcgatgtcatcaccatagcaggtgggggaagcttcctgaggtgaaatagaccgctgtgcagtgatgaggtgggaagccttcagaagagctggatgttggccgggaaactcattaggaaactatagcaagtcttgatgggaccttgaaccaaaatagaggcagtgaggatggaggaggaggatagagatcatttagagggagtctggtgattgtgacgaggcttgggtttgagtgtcatagtatttggggacagaaaagataggagaagtgggggcgggaaatgtaggtccatgagaagggttgagtctgaggtgcctgtgagacacccaagtggaaatggcaagtcagtggccggaagagcaggtctagagtccaggagccccacaaggtttgaaaggaccagttgtgcatcatgtgagtgtaactgataataggtactccccagaagtgtgtgccaagggtcaagagcgtggacaggccctgaggagcaccgtaagatatggaggggctgaacaataacacaggctatgctcgcccagaaggtcgggagggtttgaaggaaggaatcccaccaggtgccatggaagtgtcacgtacaatggagacggaacactgtcctctgaaattggccctcagcaggtcactatgccatgatgataggagttttaggggaatgggaggaaacagaagcagaagcctgtaaaccagttggtgtgaatgggtgaggggccatggggtacagaattgaagacttctcaagatacgtggtggaaaaggaaaattagaatggtcactggagcagaattttcaacatttatcttgagtaatgaaaatgtttccatgtgcttttattcaccatcctgccttttcagttcactctcaaactgtgaaactaagccatgttctgagcctgggtccttggcatggaggaaggaaatatacacacacactcatgcattcacctcacttccatttattgctgcttacagaaggagaaaatgcttctctgtaagcctgcgccttttcttcaaacacatccagatcttgtcctcttgggttcagatctgagacccccaattccatcaagtgctgcagagaaaccgcagataaacttaatattaaatgctaaatatttctggagtaataatgccttataccagtaaggtgcattgtatactttttaaaaatgtttcacccctatcggtggatttggcccttacagcaaacttcctaaggtaatcaggagagctgctggtatcctgattttaagaaaaagaaactcgagtgagtccaaactccttagaaagttggttgctaaggacttggaaaagctcttcagcttcatctctggccaccctgagccctgctcggccacgtatagcgtcctgtcatcctttgttcctttcatgctgtttatcctttcctgaaacatgcagtggtggtcagggatccctcttatatgttcccacagctccctgccctgatgcccatcataccgtgtgggtcccagaaactgcaagcaccttagagcaaagattatgacttaatttgttttcatatccccagtgtgtaacagtgcctggttgatgacagggctcagcagctgatgggtgcatgagaggaggaaagaatggatgcgctagatacaggagtcctgtctattatgtgagaatcccaattcttacacaaagggaaggatggagctagagatatcacatgagtgctgaggacacttcggctgctcaagactctcttttccagatggtttgcagcttgttgtcatatgcccaggaaaggcactgaaccagccttcctccaagacccaagttagccacatcagggctggtataagtcaggaagtaatttccttcctgcttgtctcctgagtgatggctgtggtcagtggtggaccagacttcccactgtctgctctcaaaggagctcctcagctttgtaacagcacgttagttaatgaacagcttcactgtgcctctttgtgtttatcatgtgggattatatttttggtatgaaggatcagtaaagacttgggtggattcccaattttttgtcaacaaggagaattaattcttacagtcaagggtgctagattgatttccattctggccatttctccctgtttccttctcaatttgggcactctgttttgagttcaggaattcatttttaagtgtcaggaacatgacctgatgatcacagtgccatgctactgatgccagcttgagcacaggatgagctaactgattgtaagccaagtgttatctttgagacaatggcttgatgtctatgaggggaaaaaaattctacatgattcctgggaagttatattttatagaaagtgtccaacattattcgttatgtatttggtttctttatttgtgtgtgtgtgtgtgtgtgtgtgtgtgtgtgtgtgtgtgtgtgttttgttttgttttgtttggtgtggttgcctccaatagaagaatcagataagatttgaatggggcatgcatatgtttcctgtttgaatgctcttcacataaccaaaatctcctctcaccactagctggagaaaccttcttgccatgtgacaagagcaggcaggggtttggtgcagttgacagagtgtcccaagcatgcatttgctcatcccattgacagcagctgcatgggatggcatggcagggatacatgtgatcaccccagcgtggctttcctagcccctcttcatggggaagcttcatccctctcttttcccttcccctccttagtcaggggctggacaaggaggtcagtgtcccccacaacccaggggctggttgggccgttggcaggacctcaaggtaggatccaggggtcccctagttagcacgcagtctgatcagaaaaggtggtaggtgctctcctggcatgggtcagctagctcacctccctgtgcctgcactggtcacatcatcaggtcaagtcaaggaagccaatcacatgatggtgtctagatgctgggaaagggccgggtctaccgtgggcagcagggaaggagtgatcaggatcacgcctgactcctgcagagacatctgtcatgtgtagaaggaaggtggcagacgcgaaactctcctaagagaaaaagggactttctcccctaaaataggctgaacagtggccctggccaggtttgagagacaattctggtggctaattaaaatttcacttccttcataaacccttcgtgccaactaggctaaggcataatccaggctccacttcccacccctccccgccaaaaaaaagcaggttcctgccaatgacagggtgtggctgttggtgttcttcgctgcccacagttgaaacaggcacgtccaagcctgccgtcctcagctttcctttttctgatcgattgattggaaatgtttgggtgcagaaatgatcacatttcatatgtttgcattccctgacgccatcaagcaagtgtaagagatgaccccaggaatggattggatactcatgcatcaggctttttaaaatgtccttgctattctgagctctcaggaaattaaatactttgggctgggtgtggtggctcacgcctgtaatcccagcactttgggaggctgaggcggacggaccacctggggtcagaagttcaagaccggcctggccaacatggtgaaaccccatctctgctaaaaatacaaaaattagttgggtgtggtggcacatgcccataatcccagctattcgggaggctgaggcaggagaattgcttgaacctaggaggcggaggttgcagtgggctgagatcatgccactgcactctggcctgggcaacagagtaagactctgtctccaaaaaaaaaaaaattaaatacttcatcagtgattgggaccctgattatcaatgtcctttccaggtcctaggaagaccttgatgtgcagaaacacagggagagcagctttgttgcagagggcccaccccagccgccatgccaggcagggccccaggctcccaagccccagccacaagtgtttgggcctctgtgagcatctggcatagagaaaaatatctatcagaatcaacttttatttctttttttaataagtagtgcccagtatatcaaactatatgtgcagaatgatccaattttattatacaacacataaagacatatatattatattacagttctatacatattcctctccagaatgatccttgtaaaacttgtcactcccttgctcaaaaccttccctggtttcccatcttagactagatttcagcatccctgccctggcccaaggcctccaggctcaggcctaggtgtctgacgggacaccattgcccacctgctccatcgcaggcctccttgctgttcctcagactcccccctcagagcctttgcccttgctgtgccctccacctggagcgtttctccccaggatcctcatgcccacgctcatttgggtccctgccccatgtcaccctctccaggagcttcccctcatagcagccccgacccgtaccacagcccctggcatgatatagttatctcatggctggatgtcaactccttggggaaccctaaaggcaatgaggcagccacgatatgctcattttgtacacagagaaactgaggcacaaattggttaagccatttgcccaggttcacatgggagtgcaagaatccaaaccccagcctctgacccagagtctctgctcttaatcgctaccctgtgctgcgtgtgccatggactgagtgatggtgtgaacaagctatttcatccagaacatacacaggacacaaagccatcatgtcacccaactttgttgtacagctcctaaagcatgtgactgtaatatgtataactgcattttacagaaatgcacagaggaaggcagaaaaggaaatataccaaattgttttcgtggtcatctctagatagtgggattttccggtggtgtgtattttcctcgctatacctgtctgtattttccaagtgttcttcctgggccaatattagaatgatgaaacgaaagtggtcccttttcccaaaaacgtcctgatgagggtaccagcagccacgaatcctgtaagagctcagggcaggggagggcaggtacgggggtggatgacccttattcctgagcctaacagaggtcttcctgctctcaccgtccaggacatcatcgaggggggcagcctgcgcatcccgctccaggaactgcaccagatgatcctgactccgatcaaggcctacagctccccgagcaccacccccgaggctcgccgccgggagccccaggccccgcgtcagccctcactgatgggccccgagagccagagccccgactgcaaagatggggccgcagccactggcgccacggccaccccctcggccggggccagcggggggctccagccgcaccagctgagcagctgcgatggggagctggccgtcgcccccctgccagagggggacctccccgggcagttcacacgcgtcatggggaaaggtagagcctcattcgcccatttcttttttcttctggataccactaaccagagcgacaggctcctgggggcttcccctgggtgctggataaattccctgtccaagtagacatcattagcttcatcttacagatagggaaagtgcagttcagagaggttaagccttttgggtttgaactgcaatcactgtgaccccaggagacctactccttaatcctggctcctttctctcccaactccctcagactaggggatgccagcccttttattacagtgctcattgggccagtggacccttgcaggaggaaggtgggaaggacttcgaaaaagatgattttgggaacaaaccgttcactcagcatctcaccctctctccaaagcaaaagcggcagaaaatgagtgacaaactgaaggggcacagacgcctttagccagagcccaaagatctccctgtgcagaaaaatgccagccttggcagtggcctctctcctcaccactgaaagtgttctcagatgtggccatggtttggagaattcccagcatggaactgttttgttctcattctcccgtgtctgcgtttatattctctcttcacggctggcctgccatgtgaaatgctctagtacgaatagcttgtgcttatttagcttttcctctatagcagacacagttctccgtgctttacctatagagcttacttaattcccaagttatcccattttacagaggaggaaactgaggcacacaggctaattagcccacctgagcttacacagctgatggcagggctggaatttgaaccctgcagtctctccatcatgcacgtggttaccactgtgccttcttatcagctcaagatagaacaaggttaagtttcatgtgatggttctctccgctgtgaggtgacaaaatccaaacctaaagagtcacgtgtcatctggcgcctccttgttacctctacagcccttaccacctccattctacactccagactttgtatctttgagttctcaaaagtttgcatattttcctggcttctgagcctttgtgcacacctccccctctgcctagaacctaggcccctactagtttatacaaagccttcatgtgaattacaagatggtgccctgtctgggtggacacagcactgctagcactcaccttggcatgcacttgtgcagtgcacagcctgcacatccacatgggacagccttgcctataacactcttttcctcaccccattcccttcacctgggtcatgcctccttctccaggtcttagccaagtcctcacatgctccaggaagcctgctgatccactgggctgggtgaggtaccccctttcacctgccccacgtccccctttactttccttgtcttagcccagttcacactagattgtgattgcctgtttgcttgactgtatcttcattagtctgcagcacagaccacttttaatagctactcaataccctgcttttgtagcacagtgcttacagtagatgcctcataagtaggcggtgcaaaaattgagggatgacaccagtatctaaagttaggccttcccacagaccatccaagcatacatgctgggtgcacgcctgtcggggagggtagactccacagcgtggtcctttgggtaagagcgcccctttctacctgggctaccctctgccttttctggggcagacccttatttccatatccttgaaaatgtccaccagtagaataatttatgcttaattgggtgtcttacaagacatcttgattattttttaacatgtggcaatgccagcacttttcctttggaaggggaaaacaattttttctctgttattgtccaatatttcagaccattttaaaaaaccaagtttgcagtaagaacaacccccacccttccaccacccaccttaaggcatgtcctaaaaaaagacttaaattcatagtaatctggtggaggagatgactcacagcttcccttggagcttgatggccagggtgggccctcgctctcccccacccaccccttagctgtgttggattagaacagatttccccatgggtgaagacacagctctgccaagcccaagtggagcagctactgaacacgcggcacatcgccctacttcctgagagacccacagtgctatggccctgcttctttacattttacctacgttaaaggaagctgtaaccccagttaacactcagcatacacaattcaaattaacaacatggtggaaagtggaaaaccaccctcccccaaccccaaaccctgccatcctcattcccagggatagtcactattaagttttgggatatcctttcagaaacttcatcatcatacataagcacatgaatattcacttttttttttttttgagatggagtctcgctctgtcacgcaggctggagtgcagtggcgcgatctaggcttactgcaagctccacctcccaggttcatgccattctcctgcctcagcctcccgagtaattgggactacaggcgcccgccaccacgcctggctaattttttgtattttttagtagagacggggtttcaccgtgttagctaggatggtctcgatctcctgacctcgtgatctgcccgcctcagcctcccaaagtgctgagattacaggcatgagccaccgcgcccagccgaatattcacttttatacacacgcaggccttatttacattcttttctacaggctggtgggtttaaaaaaaaatactatagccggacacggtggctcatgcctgtaatcccggcactttgggaggccaaagtgaatcacttgagcccaggagttcaagaccagcctcggcaacatagtgagaccctgtctctcaaaaacaaaataataaaatttaaaaagtatatatacttacaatatttctatcagtacaaatagcgccatctcaaagttttttttaaagatggcatactattccactgtatgcataaaccgtaatgtatttaacaaagtcccaattaataggcagtgaggtagtttacaaggttttgttatgacaaacaatgttatactgaaagtgtatgtgcaaaggcaagaaataaatgggattgtgtgaccaatcagccatgcagggttagggacagggaggaatcaagtatgatgccaggtttcaagcttggtctccttgagtgtcagacatttttactctctggctgactccttttgtccacccatctccactgtggccctgtacacatgactaagaaagtcggggaatcgtcacctctacaatgagaccagaatgggccacagtaacatggccgtgagaaacctagtgcgtgtgtatactctacccgcagactaactctgttccatcctatttagcactgacttgagtgtgtaggtgagcctgcgcctgtgtgtgcataaatgtgcatatcactctgagaaagcaaccctctgaggagtgagtagcaggcctcctgcacatgtgcacacccacacacctccccgtctccaggaggtgccagctcgttcctccaaacacaaacgccgctgtctctgcacctggcgaggggtgtgcgctcattcataaaatcacggaggctgctctctgacagtgtcagggtcttggatacttctgaagcccctcacacagagccactttcaaagaccaagctcaggacgccactattcactgctgtgttcttcctcttattgcagtgtcttattgcagaaggcttcatatagaatggcatgactggaattaacccaaggggcttctcgagacaagggctcccacggtgacccagcctttgacttctgtggaatgaggagcctcttggccttttttgtgagccttacataaagccacagacacacatacctctcagagtgttggacctgaagggaaatgagagtcaggtcccagagattagaaaggggtgcatttttctaattcatcttttctttttaattacagtgtgcacacagctcttggtctccagacctgatgaggaaaatataagttcctatttacagctcatagacaagtgtctaattcatgaggtgagtagtgacaggttttacaaaaccattttttttttattgcttagaaatggttctcagagtttctgtgatgtgatcattttagcctccaacaacttgtttttgagtggtggacagttattaataataggttgggcagaactaggctatgacagcctcaaacccaaacacagcttgaacattactttggtgtccaaagatttgcccagactgagtgttctgatgtgcagtgaacgcctgcaacgacttctggctggggaagcagccccgggtggccaagcctcagagggtaacacatgagccctgctgcttagccctgggcattgtcaggtcttttaaaaatcttgtgttgaactcttgccttttagctcagggaactggagagaggaagggagaaagagagcccataaagaaataatgaatgtgtatatgtgtgtgtgtgtttgggcttgcgattgttgtaggaatcgtatttgccacatatccttttggaggaggcctgaggcaggctgcaggtgtgcctactggaccctcaggcacagtcttcatatacagagtgagatagaccctttggcatggcggggctaggcagccgtcagcactggtggctgtccctaagggacatgtagggagagggagttgcacctcagacctaaaactccagtggctccttgggcacccctccctccccacaaagagctacagcagcaaggcctagactagagaaaacttgggaccagataaacctaggatggtgaagtctttttgtaggatttcgatgtgagaataagatagtaagggggccggggtggtgggtcacacctgtaatccccacactttgggaggccgaggtgggaggatcactcgaggccaggagcttgagacctgcctgggaaacatatcaagaccctgtcactacgaaaaaaaaaaaaaaaagccaggtgtggtggcgcacacctgtaatcccagctactcgggaggccaaggtgggaggatggatggcttgagcccaggtggccaaggctacagtgagctatgatcctatcactgcactccagcaagagcaacacagtgagacttgtctcggggaaaaaaaaaaatagtaaaggccccaggcctcctcacctttgctgcatgggcagccagtactccaggagtccagtagggtccggtgaagggagacgcccagcacagcggccaggccccttctccacttccctctcatgttctcacccttccagctgtcacatgggccctgtgctatcgaagttctcacggccctcacccactacccacacttcacatacaagggtacagtccccctctgggattccatcccagctcccccttccccacttccccaaaccctcatttttgcagtttctcctcttggccgtatggattcttatgtgcccaagcggctctggccaaagttgtcagtgtgactacagtgaccagccgcctaggttgggggctcagacacgccatcctctgaaatgtttaactataccaaagtactagacttttcactgaaaaaaaaatggttttttccctctttaatggcttccctagagcacccaggcattgtcaaaagcccgtactgaaggcttatttgtgactttgtttcagggacaaggccttctccccacaagccttgactaatccttttctatttcgaatcctgacactggactcgttttggccaggaaaaagcgacaaaggaagagaaagcaagaacacagtgaagaatgttacaactcgtccattccctagatacttactgagcacctaggcaggttacagtagtgagagaattaggcaggttacagtagtgagagaaggggtgagacagaaagaaacaggccatcacagccatgatgagaaagcctctgataaggtcatccctgagtgccctggagcacagaggagcagcagcagcgggcaccaaacctggagccagaacagggcatttccgtggaggaaccctctccaccctgagacctgaaaggcaagcgagagtcctggtggtacagactcggttcgtaaggaggcagaagagagtgatgtctgcagggctccgtgttttgttgagaagtaggacatttgtgggtggcttggggcagacggaatggggaggatttcagcctctgataaaagcacaccggaactctgcttcctctcccacgcctgctctcagcattgatattggaggacaaggtactgtccaccttgcctcaagacagctgagcccatgagacagaaatcgtgagtcctccagctacctgtgccaaacaatccacaggcttcctaattgtccctcggcagccccgaaactctggcctgacgcttcctgcttgcctgccatcctgcatgtcctcccttggtaccctggctctggttttgttttttccccttgacctccgtgcagccccaggtgatctcctctggttgcccagaggggcctctcgtggctgggggccccggtcaggaaggagctggtgaggtgtctgcttgctaagttcatgtcaggatggaggggcctgcgtgctgctttggaagggaaaatgttgttcagggctttttatgattttactttgagagagaggaaaagctgtctgaataattttccacagcctccggttattctgtgtgggtagaacacgccctgcctgtgaggccccgtgaaggcgcacagcctccatcctggaagaagtttcacccgggcacagagagacaggacgccccttcatagcccggacacgctgttccttagctggctgggagcagggaaggtattgagtgggccaggacacctcccttccttcccgggatggagggaccgagtccccagagtcatgaatggaaggagaggaaagttctgaattttacttctgagaccagtcactttgactcctgaattataatcccaggcctctgggcacttccctgtgtcttgaggtggctctgagaagatgagctcttgccgctttatgaaccttttcatccagccacatatgctgggacaccatagccatcttcctccagacagatgcattggtctaggcctgagagggccagaactctggagtggtgactaggggtgcctgggcagttgctgggcatgaagccttcccttcccctccaggccccttgggaagctgctccccagcccaacctggggctgccagcggagggggctgcagtgagattttgggcatcatagccaatgcagatcccccataactgagcactcccctgtaggccaggaaccagtgttcagaaactcctgaagccagccacaaccgagcaccacatccccagctgagaaccggcccccactctcactcagcactgctaatgggctggctcccatctgcagccctgaaggaaaggagcccgctgcccattgaggtgctcagggaatgcgccgacctccccaggaaggcgccaacattcccaccttcttggatgctgtttgccaccagggaagatgtcatgtctgtaatgatgtcttaggaagcacatccatgaaatgagccctttactccgttgtcacttggaaactcaggccagttgtccttcaggctggcaccagaccagctcagtattatagtttagagaccttgaagtcatttgctgtgtgctattggagctcaaggtcatgttgaatacttaacgcgatgaacagccgtataccaccaccaaacggccggtctgtgcagtccaaaacaaaaccccagtgtgacacctgtgagtggcatctatttgaaccgttattaagagcgaggcacgttccaggtattctaagtgttgttcatgtgttatttcattctcacaacatccttttgagggagatattattatcctcagtttctaggaggcactgagtcttgggtagaggggcatgcgtaaaggcgtgcagggattcgagccctgcccatctgcatccagagccttcctctggcccacaactctcctccccaggtcaccctgaccagcatgcccacatgtgtcctcacacaacatgtggctgaataagccagtcaaaagcagaaatgatcccctctcgctgttagtccagcagaaacgcttgccttttgcccagtttcagaggtactcgtgtgtagctggacatgcagggagcatcaccaaccaatgagagggactgtggaggagagccacgccctcgcctcctagcccaccttgatgcatattcttaatggcatctggctaaggtcacccgggaagaaggggtttgtaagtcctcaatgacgtttctgccacatgattaacatccttctgcttttgtccacagagttctcctggtatttaggtccttaaagattcagcatcactgggagacaactaagctgtcattttttttctccatttaaggaatctgtttcctttatgggaactagtcatttagtctgttactgagtaatattttatgactacttaaaggaattcatgccctattgacaaaactgcttcggaaacttctctccctccttgttactgtgaatcaatcaaatcacatggatttcccacagcacgtgttctaagttacagttctagtcacttggcaggggattcatatgtgacgtggggtcctcaccatctagaacacctcatgttcatgctctacctgcagcagaattaccagggcacttggtacaaacacaaactctctagacatccccttcagatctactaaatcaggctctgggcatgtggaagggagcccaggtatctgaattttgactgtctccttgggtgattctaatatatcatgaatctgagagttcctgccttggagactcctaacccacataaagtcctttcctagtctgtggcaagtacaaaggctaaacgcaaaaggaaatataacataggtaagagtttgttacaaggcagcaggcaaaacacacacaccagttttgctagaaaagagttctgcaggcatcagacctacatacttccctaaactttagagaaggtttaagtcaggactggtacactggaatttttgtaaggcaagagacccattaactggagatgtctcagcaaagccctgaaacacagagaatatagtccattctctgacaccctgtagaccactctagggtgcccacacaccatcaagcagattgatttttggagtggttgagaattttcattgattatgaaaatgcagggggcctgcaaaagccagagtattcaacaatcaattttgcaattcattcttggttaataaatagagtctggagtggagtcaggagggagggggaatgtggatatggatctgccagaaatgtcaccaaaaatgagggttgtcaacagtttgatgcgtgtaccttatcacgcacctccaatgtcagataacttaaattttcaaaatagggcagctcccaaattaaactgactacgtttggaccaggttagaaacaggtgaagaaaaggcaactgcagagactccaatgttttccccttattaattgcatgtttctccctctaatgccaggctgcgtcacccatttaaaagtcctgtttgtttttgcaggcatttacagagacacagaaaaaaagattgttgtcatggaaacagcaggtgcagaagctctttcggtctttccctcggaaaacccttctagacatatcaggatatcgacagcaaagaaagtatgttgggatttcattctttgtaatgcgtagtggttcccctggcgccttgttgcctacctcggttcctggggcaggaatatggcagggcaccattccttgttcacgaagatgccctgtggcgagttccaaattgcattgcttaaacaggtggggctgggaaaaggctgtgagagtgagcattcccaggcgaagagctgaatgtgagcttttgtaacacagtttgcattgtcaaaatgatggtaatagtccggatgggtatcagaggggagagtgggtatgatttaacaaatgcaggcaaaacacaggatggcttacccacaaaagggggatctgaaaggataaaaatgggttgttctatcaatcagcaccttaagtggtagtgtgatttttttcccccttcgtgctgtagacaagctaattatagttggtggcagggtgaagagcccagtgctagtctattttggtctgcagtctcatagtggagcagtacaattcttgatttttccatagtacttcagcttcttgcacgcagttaaaaataagcctggttgtactttagaacccattaccttaatatagttttaaattgaggaatccaattacatattaaagatgaactgcagtgacaatttgtgggagaaattaagggtagaggaagggttaagccttaaacaatgatagggaattgttgggacataagggaatgagaatgtaaacatcctgaaaaattaacattctattttacacttttaaaacatgagcagataatttcttcacttgcacctgaaagggtctgaattcatttcatttctcggtgcatgtatagaagctctctgcccgtggtgttaaaattttgggcatttatttgcgtaagcgtgccttaaaacatcactattttggatttaagggagataaggccagttgaagtttgtgaaaagacttcatgaaagattaattttaacactgaagtgtgatcacattccagcatatataacggttatttattaaacaaacatttatttagcacttacatatgccaagtggtatccaagcactttaagaatattaatacatttaatcctcatgacaaccatgtgaggtagagctgctgttgttaaccccatttacagacaagttcataggcagcagcattggggatttgaaccaggcaggctggcaccagctccagctccatgcttttaaccctatggaagccaggcaactctcatggtctcaggatgatgagcagaaaagattgttcaggcaaagcgacactcttcaggaccagttccctggccccaagccctctggggttgccaacccttgtgggttggactagactacctctttgccctgaggattcccgatggcccagatgaaaggcaaggtctgcttccttggcctcctgccctggggcctacccccatcccaagtggcttttctctgagagcagcaatacttttcccaggtgaatagaaaaggttccagactcctcttgcaacaccaggcccttgggagacaagttccaagaggaagaaggcattcggaggttggagatgaagatggggcggctctttgctgctcctcccaaagtcccaccctggcctctgtcagccctgtgttgtcattggtccacatccgagagccttctggaggtggagcaggggacatgaaccttgacctctccagggtgtttgttagtaacacttggattgggctaacccaaggtttgccaggttggagtcctaatggaccccttttaattgattagataagaatgaatcgcttgtggatgttcaactggatgttactataaggctggaaaatgttttatactcataagtatttcctctgggatctttttgtgctattaatttgctttgaagacctgtttctccaataatacaaaggtaactgcaacccaacccctgcttgaattatcacaaatcccaaattaattggttcttattaatgttactttatcaaagacttttcatgcatttcaacatttcagtgtaatgaaatcagatttagaaaggtaaggcaagagaatgagaaaggaaaacttgcttttgtcactttgttctctccccagaaagcattgatgatttcattaagcctagcgatcttaagtaacccaagcattcactctggttgccagcagtggcaaccctctgcaaagctggctttgtaataaccctcgaagggtcccatcaggagagagaaagatggcctagccaaattctcccctcatcacgtcctactcccctcccctatacagctgagtcctaagagtccctggatccctcctttctccagtgactataagtatcccataacagagtcctcttcccacattatattgcttaagaattcagtcttgccttcctggaaacacaaatcattttagcatcactcattgactctgtattttgcatatgaaataactttttaaaaatccaaccaaaaaggaaagtgagaaaacgctatccacgctaaataaggaaaaatcatagcagaatactgaatcatctaccaggtggccaaaattccgacttcagaactcaaaggactagttttcgtcattaaaaacaaacaaacaaaaaaaaaaaacactcggcccttgtctctacctcacgtagtcagattgtccttcctccaaaggaggtctcatcatgtgaaacttattctacccctcctggccctgagttcttccttcaaaccaaaaaatctgaagccttcgtaaaaatgaaaacgaaatttttaaaagggaaaatgggagaaaaaaggaagaaaggccaagacaaagataccaagaacctgtgagtgtcctcctcaccacattcagatgagcttctgaccagaatctagaactccttccttggccaccaaagcctggaagtagaaaggcacaagcccagaattctccttcctgccacttctccccttaggaaatttaagaattctggggagaagagaaacattttctgagatctgcactgctggctcagatgcccctccccctacatacaggcacagctctctttctcaggaaatgactgttctgcaggcccctatcaccctcaactggttaaactacgtcagccctgcttcccggagtctccccacaggcttggtacaaacctcccctgtgtcgctggaaaagcagatctcttccatcttgtggccactggaggtaaaacattttgacttcaacatccgtgaatgactacagctgactcttcttggaaagaatgtgctggttcctgaaaccctgccggctgctgtataacctcccggacctgaggcgtgtcagagaggatgcgttcttcagtgctgaggtcacccaacccaacggcagcgccggcatctgcacgtgatgctaagggctctggcagcctccctgcccggacccaggagaagcatggacctgccctggcccttatgcagccgactttgcagggagggcctgtgaagtgaaggcagtctgtgtcctaggtccagaacacttgcaaacatcatctccgaccttatatccctcgccccacaggtggcatcagctctcccatttgaggatgcgtcatgatggcagagactcattggttcattcattcaactgcattcactgtgcagaaactgattcaggcaccggacatgcaggatggatgaggacagacatggagcttacatcctggtgggcctcacaggcttctccaagtccgccacacagacaggctgagcagaaacaatgataggattaaagaagggagccctgggacaggagtcagaccagttgtgaccctgactctgctgttttcttgctatgtggcctctcaaaagcatgtgagtgttcaagacctgtgtcctcatctgcagcagcatgggttggagaagatgcggtagggaggcgcaaggcggcaggcagagtgctggtgaacctgctgagcctgcgtgccagcgctgccccctgctggctgtgtgacctgtgcacaaggattacgcgctgttttacttctccagctacaaaggagagagcacctacttcatagggttgttgcaaggatcgaaaaataatgtcgaagtcccaggaagttccatgtgataccgcctctcagatgttagctgctgttttaattatagttatttgctggcacacagctccctgtaggcttcataactgtcaaaatgtgagcagaggcggggtgcagtggctcacgcctgtaatcccagcactttgagaggccgaggcaggaggatcacttgagctcaggagttccagaccagcctgggcaacatggtagaccctgtctccaccaaaaatataaaaatctgtagtcccaactactcaagaggctgagttgggaagatcgcttgagcctgaaaagttgagaccagcctgggcgacatagtgagactccatctctaccaaaaaaaaaaagttagctgggcatggtggcacatgcctgtagtcccagctactccagaggctgagataggaggatcacctgagcccaggaggtcaaggctgcagtgagcctagatctcactactgcactccaacctgggtaacagagtgagaccctgactcaaaaaaaaaaaaaaaaaaaaaatgaggagacctccaaggcgacatcccttgggaagcctgtggcttaaaaagggctgaataacgactgatattctcttccttctctcttggctctcacagtcgaggctttgggcaatccaactccctcccgacggctggctctgtgggcggtggcatgggcagacggaacccgcgccagtaccagatcccctctcggaacgtcccttccgcccgcctgggcctcttgggcaccagtggattcgtcagctccaaccagcgcaacaccacagctacccccaccatcatgaaacaaggaagacaggtttgttctgccccaaggaaggaggaggatggccaagctcaaggcccaaggctgcagatgtccccccaggtgaccccagggtggggagagaggccaaaggggactatgctgggggcagttgccaccattcctcagaggtaacagcattgttcgcgttgttctctagcagacagagcaaccccatagctgtgtttaggatgcccagaggaccactttaaccttggggaccctgcacaagaggacctttagaaagaaatgcaagacctatttcttctttgccccatgcttgaccttctgccacccaaatctgggttccaggagagcctggcatttagagaagtttcttgccctttttatccatggcaaaaagctcctttgtctcagtcccagctctggtggagcatccacaggacaaagtctgagagagtgtgccagggggagagttaacacattctcagcctgcccagaggttcttgctgtgcagtttagagctgacttctctggcccgtcgctcatacccctctagccccaggccccacccctgcccagtgccttccgcctgtgtgcccagagcttctcgaagctctgtgggtagggattaggatcagagggacacaagtaggtctgaggttctggggtctcaggagaaactaagggatgacagatcagcttaaaaacaggaaaagggcttcaggcaagacgggcaggattcactacccagggtaccagaaagccccatcttctgaccattgtccccagcccccagatcagttcaagaagacgtcactgctgggacacacaggctgagttgtgccagctcattgccagctgagagtttcttttctctccccctcgctttggagtacattgtaagaatcttaaaaaaaaaaaaaaaaaaaaaaaaaaatcagagccctgaaatagtttgtgctcttcgttgcatacatttatagaactcccccatttcctagaaaagtggcagggaaaaagcaaaagcaacaaatgcgataaaaagagttctgcagatagggaaagaggtgtccagatgaagctgaggcttacagcaaggccaccactgaggaggtgaagagaaattacagtgaatggaatctaaaccctctctctataaataagcagatgctagcactggcctgcaagccccttttctagaagttagagttctcctgggatctttgcctcccaaattcttgctggcggctctgctctccaccccagtggggctgaactaacaagttccccttttgcttttctcaccagaacctgtggtttgccaaccccgggggcagcaatagcatgccaagccgcacccacagctcagtccagaggacccgctcgctgcccgtgcacacttccccacagaacatgctgatgttccagcagccaggtagggcccggcgcttcatgtccccttgacacagaggggaggccaaaatagatgccctagcaaacccagccagaaagtgcttagcctcgactgtcaccgtgcattctttggagcttatagaagcctttccttttttaaactgtgccttgccagcatgaatagcggcggcttggctgagagccagcatgtggagccccagagttggttgcaatcggatggggatatttttgatactagtcatatttctagattgattaaaccagagatagcacaagagggctttggtggtggggaggtgggagggctccatgtgtagtgtgtgtgtgtgtgtgtgtgtgtgtggaaagagaaagtgagagtgagacagagaaagagaaaactgttgatgctgagaccttccccctggtttgggcttttcttgcaaagtgatgactgttgtaccagccatctttcctttacttggttaaagagcaacttagcacacttcagatcaatttcagctttcactatgcttcctaaaacagagtggttggaattatgcacagctaatgaatacttgaaccctttctctatgcaggcagtgatcttgtagactttgtagactccatgagtaataacaagccacacaggcaattacactgcacctatctggatggacccccccccacccccactgccccaaggcaggcaaactggagatgtgttgtacctgtaggaaaatgccctggacagtagaaacgctctgtccagtaagtcctatctgtaggagtttaaagaagagaagtgttactgtggcctggaataggcaaggaagcttcctggagttggagctgagcttcagggcacagcagagggtggagagagggaaggcagagttacaggcagaaggaacccaggagcaagactgcaaaggtccagaataccacagcatggcccggaagccgtggctgggccaaagggtctggctgaggtagcagaaagtggacccagggagctgtaaaggtcgtggccgatggtgggggactttgaatccaaagctgaggagcttggactctggccactctccctggggggattcctccacatgggggattccgagtagaagtcaggcaggagggtgcaggatgatggggtgggggggtaggctggaattgggaggtcagggaggaggaggacgctggaggacacactgctgggaacggcatgtcagggaggggagcgacagctacccagtgcagaggcctgctcacattgcttcttgacttccaaaactctgctcacttttgttttaaagctccttttctctatatttatgcaccaaaatataacaatataattacacatatttctatatgcttagctatttttcttcctgggaagaaacatgataaaatttgggggttctgaaggctttatcccagggtcctttcatcccatcctctgttttcacgcagaattatgtataatccattcccaataaaaaagaatctggacaagatttgaagaggtcctgcgcacaaggagatctgtcaccttgaatgggtctttcaccctggcctcagtctcaccagcagagtgaccactgtcttcaattctgtataccttctcaaggccttcttgattttttcccttcctgccactcttttgccagttctcagccttcctctttgttcatactgaatcttccctgagctttctccatcttaactgggaagactaggtccagacagtcccctttctaaaagctgggttgtcccggagcgcttcgggtttgttgatagaatcttccacctatacctttgtttcccctccactatctcacagcaatgccaagtggctggcttgtgctcagggcaactatgaacctaatatcattttcactcttcatgcaaaccctcttgttcctgtggttaaagaatcaaataatacagaagtgctgtgagcaaaaagtgactgtctctctcccctccccttcctagcccacaggcacaaccccttttagcagtctgtagttacctgcaagtctctaaataatatgcttcgcacactggacttaaaactctggaacgctttgagtgttttttttaaaatctctcaagtattacaaacccacttccagcaaggtcttaaagatcctcacatggcatttttaataacagccaaagcacaggaaaaagcccgctctaaatttcctgattgcaaataaaccattgaacgctggacaggagccactcctaagtcctgcccagcacgctcagcaccatgctgggtggctcttccaggacatgcataaagggcatgatagggcagggcctggccaggacccaggatccctcactgaaggggaaggaggctgcagaaggcccctgcttaagggcacagggttgaggttcctcagcccttgccaatcattgtcaaggccacaggtcactgtagtgacttttccttcctcccaaggaggcagcctcctacccagggacgacacctctgacctccaagcaggtccagacgaaggctcatcctagagtcatagagtcagggtcctcatcctggattcagagccgcttctgctcttcctggattcagagcctcttctgcagatgggcctttccacacaaagcagtgcaatctggttcgctatggagacttcccggggcttgtggccaggcgttaaaactagactacaaatatcatgtcaggacagcaaaaatcaggaagtcagaaagtggctttcatctgtacatgaacaggagtaatagtgaacacaaaatgaaattgagatgtgtaactaacccaaaagtagatactcggaaaactgttatcatacaatgcagtgttttcctcctggctgttagatgtcttcagagaatccattgtaaactgggcaaatcttgaagactacaatgcatttgaaggatgctttcattctgtaaacctaaaataactctactgatgggagactttaaacgtctcatacagagaagacagagggctagaacccaccaagttgcggatcaattcatcagtcaccttgctcgggtttacaggactcatccctcgttcctggttctacacaattcacgggcacttggaggcccctcaggagtggtgtttcatgttattcccacatggacaagctttttttttttttttttttcgagacggagtctcactctgtcacccaggctggagtacagtggcgcaatctcagctcactgcaacctccaccttcacatggacaagttttagctgtttcctgggaccagccaggagacccttcaggtggctattgccagtgatgagtaagaaacactacgaggtgtaatacgctcaccagaaaacaagtgtggcgcctgtgcgaatggtcacgttcctcatggaggcagggcgttttctcaactagataactggtttggaaattgcttggagagggatcctttattttggaagcaactaatttctactgacccaggcttagttgtccttgggatccagtcagagaggatcttggagtggccctggctcaacagtaggagatcatggaggttctttaccccctggagggcctaacagaaaagggcagggaaccccatagcaggcttcaaaggaaaaccttcagaagggtaggctgcacagccttctgaaaatctcattcttcccttgcccaaagccacatgcaaactacccttggttgtgaaccagctggatgtgagctgggtccagtggcacctcacatggcagcatttcatggtgtgacttacctgatcaccacagcaaacctcctctaagtaccagctcacaattgggattcttctgccataagcacgctgcatatatctgggagcacagggctccaggctgttatttttcatttccttccggagaactgcctttagaaagaatagagagttattggtgcactgggtccagtggggtgtggaaggggctgccatgcagaggcagaaaccagaacagggacccaagtacagtactggataaatatttcctccatgtcttctaataaatcaaggcagacatccctgttcaggactggcagacaatgggtagggagattgataaataaatcaattctgtcatagccaagaacccagctgggcccacagcctcctgcctctgagcatcaacttggggcaagatggtacaatatcatcttataccatgttgtacccatcactttttgtgaaagcgttggtcccagaggacctccacaggcactgaccttctgcaggcttaggaatgttaggaggccaccagagaaaaggtgcgttcccatggtcaactcagggatgctattcattactcctgccaccctccatggccatctctgccatcctcagcttgcctgctgccccacccctctgtttccctgcctgtgccgtttctttcccttttgttaccatcctccccctttcttcttagttctcttgtcttcctttcttctttactcatctcatcacagcagaccaggtcccactgctctgtccctttttgtcttccctgctttctctcctcctagcaaccctgctgctcagtgaaccagactccacacctttctagttatccaacagagttgcctccgctgtcattggcaaaacgggattctatagatttttcctggaatgccccagcctgtttcttattctaaagtcctaaagaaattggctccttaccctcagtgccttggagaaaaagcactgcagaattgcaccgtgggtgccacacatgtgagacccagcagggatggacggttactgccaaggacaagccctttgggctcctcaggtggatgctgcagcagcacctcattagggatgggtagcattctcttccggaatcttcttgaccctgggcctgagcacaggactactccatacgtgtgggacttctgaaaagatacaattaatgtctcaagtcagcctagaccttggggattccaaaactagcgatccttactgaatactggaatactggtcctcagagatgccatctgagctgaagaaacatgcctcctttgggaaagagcagaggaggctcagttaaagaggggtctttccttttgccttcctgaagactcacatctccatctgcctggtctgtggccacgaggggcaggggcctgggataaatgagatgggccctcagggttaacaggagccacagcaagggttggcctggtggtttatgttggtctgtggggcaagagctgcccgaatgcccctctggggcacctagccccatacagctgagggttcctagcctgagatggaagctgttttccacccaactggtctttctgtcttatacgtgcggcgagatggcatggatctgtttttatcaaatacacaattaaaaagtcacactattaggaaactctgcagtgtgaacatatgggcttctcccaagacttagaatttttcagagccactcggagtgttgggggtcacggctccccagtgcatggaagcaaagagctggggagaagaagcgaacacccccacttcccacctaaaagagcagccacgaaggtttggggattctggagcggagagccctgcgtttctcagccccctttttggaacacgcaatcccaggcttggaaaatggcattttgctgcgtgttggcaagaaatcctgcagctgaaacacttctctccaaatgtcgagcatctttatttatccaaatctctccacagtgtttgtttaaaggggagcgctggagagtaaactaaatcttacaatgagcatatggatggctataattgctgaggtttgtttttttttttcatatttgctaactcgctatatataaaattgtgtttctattttatagatttcacaccctgaagactgctaatttttgcatgcatatgattttcacatgaatggatgaaaatactaaaatctcttccccctggaattgtctaattgccccgaccctactctaacagcaactagtgggtgggggcggtggagactcctgccattctctgtggcaccccacttccctggaagctcagtcggcctccgtctgctcacgtattggcacggttgtcttccaaacccatcgatgccggaacatgggtcaggaagaacacagtcagctctctggtgctttccatagcgttcctttttgccaggcttctgagatttttaaataacggaagcaacatctgcctctgaattagctgacaatgggaaacacacattgcagagattatcttaatgtatagcaaatcaaggaaaacaaaactttgacttaaccattggtttcagcttcctatcccaccaagccaccaacttcgtttcacttctctttcttctctctctggccccatgtgctcccttggtggagacatgaaggagcaggcaagtggcctgcagggggaccccgggatgctttgcccacttgacaggtagaggagctaaggccctcagcatggaacaggttcccaggctcacagaggaaggtggtggcaacacggagacttctcggtcacctggaacacaccccgctgtggacaccccctctgggactttttttctgcctctccccttaggattttgcaattcttttcaaaccagtgtcacaaaactttaaaaaaaaaaaaaaaaacaaaaaggatttcacaactcttagctgtcagagtttccttctacttcttctactttctctttttcttcgctcagtagacatgtatgaggcagaaggccagggctgggcgctgtgggagattcagagagatagggaagcatcatcactgtctacaaggcacttccaggtagttgaggacatttaaagtcgccactggatgaggcctgcggaggtgctgacagtgagggctccagcaggtgagaggaggtggctcccagacactgcctcctgctcacaagaggcgacattggaacctggggagatagaggggttccaggtggtagaggggagattgtggtgagaatgtgcacagcactgtcggtcagtgggagccgagcccctactgcctgcagagtgggtgtctcagcccttgattctagaggccctcgaggctgagtgtgttgacagttacctgcagttgctgtggcaggtggctgagccccggctctggagtcagagagggtcttgtcccagctttgtgttagttggctaactttgatgagtgacttcacctctctgaaccccacttgggcttgttgggcagattaaggagcccgcacacctaaagccccccacgtggtctcacactaagaggtgcgtgctgggccctggctttcctctcccactctagatgcatgccaggccctgctctaggcacagggggcagagccatgttctgctccaatgaggtgagcactcagcggggtcaggggagggggacagtagaaagtgaatacaaatatcaaatatgacagctgtgggcgaaggctatgaagaaaaataaagcaggggaaagggatagtgtgggggcatggctcatacaaggaacaaagtcctttccaaggagatgatagagccagaaatgtgaaggcagggagagccatggaaaccaccccagggaacagcggtgcaaaggccgtgaggtaggagggggcctggggcagagcagaggaaggagagagctgtatgagggtacagagataacaagggcctggatcatgcggggccttatgggccagggcaggaggttggctgttactttgatgggaggccgctggagggttctgagcagaggaggcacagactgtgacatgaccagctatttttagtctccgttttgttccaggttcccaagttcacagtggactgtgtttaacagaccttagaggttggttgagcctgagtggagccccttccatgccagcgctgacagtccccaagtcctcccagggaggtacaccagacctttctcctgaaggtggaaccaggtggcaccctgcttatctcctccttgtcaccaacataaccctttatcgcctgcagaattccagcttcccgtgaccgaacctgacatcaacaacaggctggagtcgttgtgcctcagtatgaccgaacacgccctgggaggtgagtgtgttcttcctgcatgtccccatgtccctgttaccgtgtgcctgggagaactggccatctgctgtctataccgtggcaggagctcaggagaattgggggaggacaaggaggggtaggcaggggacagggagaaagagtggccttagggtactgttggaccattttccagcggcaccatgccaagtggccagtgccctgtttctcctccttttctgggaggtgagtcagggacctggcaatcaaagctgtccctctgtccccagaagctccacctcccagtgcacatgggaatcacaccacagcagttgtcccagccaagtgccaggcctggaggagtcagggacatgagacatggcttttagtaggaatatcccgcacaacactggatgcttcccttctctgcactagatcccccagcctggtccaagcatagcccagcttgccttagaaatataatttttgaaaaacagaaaacccagcttgtttgtgtatctcccagttgcaaacaactttcttgacacctggagcccaaagcaggctgaggtgtcctttcctgtgtgacagggacaggttgagttagaggcgcctgcacgtccactgcccaagcccagaatgggggctgtgctgtgcagggctgtggccccacaagcagctcacagaagcatctgtgctcccccgtgtgtttggctggaagccatgcttggtcacagcagccctgggaggccttcagctccctcctggtactaagcgggcacctttctctgggcctggatatttatgatgcttggcaggcagaggagagaagagatgtctgccatttcctgccagcttcctgggaggctctgtgccacagagacacagagaggcctcctgtgagcctttccaatagccctatccagtctacacttgctcttagccaaaaggccgagaagcgatagccctatccagtctagacacacttacccacccagagaagggctgtctgcacacctagagccaagacgtgcgccacctggcagtggtggggaaaagactgccatcctctgctgcttcagagagccttgtcctccagacctaaggttgttagatttttagtctctgcaaacacaatcttatcctgaaaccaaatatgaaatagatcagtgctctgcatggagcagagtggtgggcccgggaccacacccacctgaccttagcatcagggggagctgaaagccttccaagggcatcacagagcttcaccaaacagatggtgggaagacacagccccttctgtgacttcccccagagctctataaagagcctcatttgcgagccactgctctctgccttggccattcagatctcaggaacatcactgggccatccctggtacctctggcaggaggtgctgccagctcatctttacctcatagaggagactgggtcagcagccccctaatgagaaatgggagacaactcaaatgtccaccaaaggatgaacatggctcaaaaaaatgtggtgtatccaaacagtgaaagagcattcagcctttaaaaagcaaagaagtaccaacctatgcgatgcagtggatgaatcttaacattatgctgagtgaaacaagccaggcataaaggaccacagagcgtatgattccatttatgtgaaatgtccaggatagactaatctactgggacagaaagtagatgagtggttgccagtggctgaagggaggaggatgcaaatattctggaattagatagtggtgagggttgcacagctttgcaaatatactaaaaaccactgaattgtatactttcaaagggtgcaatttatgatatgcaaatatttcaattaaaagtagtaatgacagtctccctggggccagagttaggatagcagctggtgagtgagtcccctgagctggcacctgccagagctctgacatggggagggaagcccctgtgctcccctgctcgacagtggccagctgggtgggggactgactcagtctttcactgcttttgaccaaagaaaaaggagaactgaccttttcccccagggcttgatacatctcagacaattggcattttggaggctcatatcaaactgctaagtaccaacattatcatcattagcagcaagaataccaaatgctctttattaaaggaaggttttcattgaaaagacttcgtttttttcagtctgttctgtttttacagaaaacctctctgaaccgatgggttttttgctaatgttttcatcttgttaatctcctaagcttttttagtgctgtgttttttcccaatgatctcctctggtgggaagcctcgtaagcagtttcctgagcagagaatgcaaattaagttcagggtggcctagttgggcacagtggcagtgtgccctcccaatatgacagagcttctctgctggccaaccccttccaggtgccaggaaagatggccttgctggagacagtatgctaatgagtcaagtccttttatgggaagaggaacgggcagggagaggaaagcacagtgaaagaggttccaatgcttgcaactcaggaatggagaaagagaggctcacatctgttggcctctaggattggtgatctgacaccactgacacactcagggaccattgcttcctttctttaaaatctcccctaaaatcatacagaacttatatacaagtgcactgggtctgtttggactattacttacaacagcatgtgaacctacagttatctcaaaagtttcaactgaggaagtgcttctcctccaaggccccactggcaagagttgccagcctggctccacccacaaggaagccaggaaccaaccccctgtggtggcctcagcacgcctgtcacttgggtcctccagctttccctggaacacactgccactcccttctcacacccaagttctgccaagcaaatagagatgctgcatctggtggaccagttctgtaatattggggcttggactgggacatcagcaaagccagggaggcaccccacagccctgtctcacccacatttagtggtcactgaacgcagttattcctaccgcctgtgatggctaatccatgcctctctctgctcactggaaaaaatccttgtcagttctggcacagactgttataggggcctcttaactggtccacctgccaccagccttatccttcctcaggttatctgatgcagctgccagagaaaccattctaaaattaaatctcattactctactgcttataattccccaactacctacctctaagctcttgttcatggtatgcaagaccctatggtctgctcctggggaccgttctagaacccacgtgtaagcagacagccaaaaaggggccgggcaggcctcacacctctgatggtcatatcccctgccttctctgtagcctgggtcatccacttctccaaaacgtagatgtggcagattctgggcggcctcagcactctcccacctccccaagactgttcagttctaagtgcccacaacacctacctcagacatctctgcctttgatcagattctcgagacagagaatctggatttgtttgggtcagatgtgtccatccctctggtctgctcagctgtggacagggtcacagccaccttgtccccagtgtctcatcagggacgtgggttgagaaggagaggctgccaaagaaagggatgtgagctagacaggtccacctgcgtgtccgttgcagcccctgcctggctcttccaccccatctcctctactgcattccccatccttcatcctaaacctccaacgcaccctcagctccaccaccggatgacctatcatcccacctatgcatgcaccgcacaccatccccaccctcctcctcctgccagcaccagctacaaaagtcactttgtatctctctgaaactgtccttgacttcccaggccaaccgggcagccatcattccttcctccacgatcctgctctcttggtacctactccattacagcagtgatcacatatagcattattgtctgtctacatgtctgtgtctaccctcaaatataagtacttgggaggtgaggattagatattttcatcttggttctcaggttcaatatggctcctggcaaaaatagctgttccccagatatcatgtgggtgggtatgtaaatgcgtgaacacatgaacgtaggtgcccttctctgccctcagaggctgggaggcccaccgtgcatggcgttggcataggtgggcacgaactggattgttttgctcacctgtgcccatcgtttgctgctttctctcccagacggggttgaccggacctccaccatctagaagctgaagacgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctggg

SEQ ID NO: 37808 - DNA, 360447 bp, Homo sapiens
gtctgcggaagtggtgacccgtgggacgcggctgagacaggtaacctgttcgctccctgttgggtccctgccttcctctcctccggcgtcgggatggcggcggggacagcatcattccgttctgaaggcgacggggaaccctcccttaccctcacttttgctcgaccagcgaggacccgcatcccctcctcagttctcccagactcctggggctgaaacccatcctggggactgggcggagcggtcacatcttaccacctcagctgtagaggtggccacgggctctggctgtcttctccccggcggcacagacctttctcagcctctgggtgcctcctccttcgtctcttgcctccaggccctcggtcacctgccggtctcggcttctagccccacagggctcatctccagtcttaagtaggcagaacagtttcgattcgattcatttccacttgcagtgaaacccatccgcctcttcttcccccggaggatctttactgagagcaccacattttgagttttggggtccctatagaacattcatactgttagtctggagttttgttcatgaacgcatgcatgggcggggagggggtggcacagtaatgtgattatgattatctattgtgataataaaatatccacttaggatccaatccactgttgagatgcatggaacagttaatagcattgcataaaatgccccttgtacctgatttctttttggttttcgtgcaatgatgacaattacccttgcaaaggtagccctcaaaataagtaacataacccgctagggatgtttagatcgcaaaaaaacaacaataaggttcatatggttgataaagaaataatatgggttattacaaaaccagacagaatagatgctgagtatatgggacgagaagcagaattctgaaatccttgatctcattgattgtttggttttgtatttttaaaatacttttagtctgttccatttttgaatagtgtatattgtgcttcgtataagtctgggaagccttccaatgacttgctaattgggaagattagattcttccaatatttgggggacaaagtagaataaggttagggtataataatagttgcttactgttggcccatctgctttatcccaggtactgtgttcaacactttgcatatgttttctccttacttcatacaaccacctcgtgagttaggaattattacccccaatttatagagaaggaaattgagtttcggttatatgaaattgacttgctaaaaattcacagttaactaaatggcaaaatcaagatttaaattcaggtctgaatataacttcaaagcctgcacttttcttaaaggactctactaatgctcaaattttaggctttttacaatagttgcacacaattttatgagtttgttcacctacacaaatgatttaacactttttaatatctttaatactgtgttaagttcccatattcctggagttaaaacacctggaaagcttaatttgtgatccttcctgcgtgcgcgcatgcacacacacacacacacacacacacacacacaccatccttatttttaagaatgagataaatggcaaacaagattgtgcagtaaaaccctgctgtttggagtcctcagggaatgggtaattttacagttgagagcttaatacttctttagaaatgaaaattttattgactctttgagatggaaattttaaaaatgtactacacaatttcttgccttcttaaacactcaggatgccgagtagatttttgacctcactgtgcccggtcgaggacagttcttctaaggaatttggctgtgaggagataaagaagagttagagggagatgtggacttaagggagggttttgttcatttgtgggtttttcctgtaagaagagactggaacattcacatttgtgaggtggaaagggcttggaaacaggaagatgctgaggtcaaggatttagagggctggatgattgatgaagcaaggtcccagaggccaccaaaagacgatctccagagcagaggccaccttcaggctatgcggggcacgagggacacttcttccactctcctgggagggatggggagaagggtgggcacagacgtgagtgagtgtgtgggatgaggaagaaatgtgtggaagttcttgtgtgatggagcaaaagttcttaagtgcagcaggtgaatttgctgacattgcgttgatttgttgggatagggattgaggaaagttggtagaagtttagaataatcactgagggaaaaggacagggtttgatggggagactagagagaaacatgaagggttgcctgtccaggaaagttggtgtcccaccaaagttggagtctatgaatatctagagtcagatattcttgtgatcgtgatatttattcagcttttgttgagcttagtagtttagaagtacagaaggtggatgattccattgcttaaaggtttggttttataaaagttctgtcagaaggatgaaagagcaagagacttgaggttaaaatgttccaagagtgtttgaagaaatgaactatgttattctaaagatgtccatagaggctgggggcactgtggctcactcatcccagcaccttgggagcccaaggcaggaggatcccttgagcccaggagttcaagaccagcctgggcaacatgatgaaatcctgccactacgaaaaatacaaaaattagccaggcatgatggcatatgcctgtagtctcaggtacttgggggaggctgagatggaaggattagcttgagcccagcaggtcgaggctgcagtgagctgtggtggcgccactgcactccagcctgggagacacagtgatgagacactgtctttaaaaaaaaaaaaaaaagaaagaaaagaagaccatagagcagggagtctctacttctgaaacatttataattctctgctgtggggggctgtcctgtgcattgtaggatgttagcagtatctctggtctctgcctattagatgcctgtagcagacctctccagtgtgataatcaaaaatgtctcaagacgttgccaaatgtcttctgaggggcaaaatcagccccaattgagaaccactgccatagagtcagaggaagcagatggattggagaaaatgttaaagctaagggactggagtctcgatgaaaaaagaaagagctggcaagtaagcaagagaaagagtaggaagactgggaggctgtgcttggaggttagactattgaaattatgtcacaggtggaactcttccacataatgaaaatgtctgggccgggcacagtggctcacgcctgtaatcccagcactttggaaggccgaggtgggtagatcacgaggtcaggagatcgagaccatcctggctaacgcagtgaaaccctatctctactaaaaatacaaaaaattagctgggcgtggtggcgggcgcctatagtcccagctactcgtgaggctgaggcaggagaatggcgtgaactggtgaggcggagcttgtagtgagccgagtttgcgccactgcactccagcctgggcgacagagcgagactccatctcaaaaaaaaaaaaaaaaaaagtcaagaatggaccattggtcttcttctgtctagtataaattttataaacagattaatatcagagatcattaatgcatttccttgagagtgaagaaaaaacgacatccaggcctgtttcctaacagcagtgattatttccacttccaggcgtagtgaccattgttcagcctgacctccattaattctgttgagtaattcttttgaaaagtgatgttttttatttcttgactcataaagcgtgtaacttacatgctatttgagaataaacctctattttacattgagatttataccaaatggcaaaatataggatctctctatcttcggacagaatgagaagaaacactttttctacaagtaaaaattgtttttaaaaaacagcaaaaaggatgaaatagttgcctaaataagaggcgtaactcagacgtattcagaaactagttttcaaccttagtttctgctgcaggttttctcaggattgtgtagtcatcatcacagtggttatgaagaattaggacatagttgggtcggtggttgtaattctgactggttgtttaatataattatactattttatgtacactgagaaatttatatactaagtaaagcatgtcttgtaatgttaaagaaaaaaaagacgattaatttgctacgtgcagtgaaggcgaaggttgttggcgctgagtaggtcattttgagagtggggaaatggagataatattacctgtggttagggagcaggttggaaaagcagcagcaggacagcctcagagtttctgaaatgacaccaggactaaggctttctggatgcttgttttctcactccgcccggtaagtgcttctcagctcttttctagcataatcatttcccccaacttttacttctctcttgtagtgttttaacaagtcaagagacttatccaacttgttttttttttttttgagacggagtctcgctctgtcgcccaggctggagtgcagtggcgcgatctcggctcactgcgagctctgcctcccgggttcacgccattcacctgcctcagcctcccgagtagctgggactacaggcgtccgccaccatgcccggctagtttttgtatttttagtagagatggggtttcactgcgttagccaggatggtctcgatctcctgaccccgtgatccgcctgcctcagcctcccaaagtgctgggattacaggcgtgagccaccgtgcccggcccaacttgtttttttaaatagtactttttaggtgaatagttcttcagtattctcttgatttgattttgtcatctttttgctaggcctccaaaaagccctggtttctgtgctatgtgatatacttttagagcagttcttttgcatttgggcatctgattataaagtctctcgttggtaaaagaaatgtcaacatatctttaaattttacaactcttagaaggttttttttccccctgccttttttccctagtctgttctcttttgcctttttttttttttttttttttttgagacggagtttcgctcttgttgcccaggctggagtgcaatggcatgatctttgctcacctcattggttctagcaattctcctgcctcagcctcccaagtagctgggattacaggcacctggcaccacacctggctaatttttgtatttttagtagaggtggcgtttcaccatgttggccaggctggtttcgaactcctgacctcaagtgatctgcccaccttggcctcccaaagtgctaggattacaggtgtgggtcaccccgcccagcctgttcccttttactttttattgttccatattcgtttttaacatatacatatgtacaatgttaattgggaactaattacagtatactctagaggatgtaagcaacttctagaatatgccttttaatattctccccatgtttgataatccatgctttcagtcaactttttttttttttaccttatctttatgagcataacctacattattcatcaagtaagaatgggtactaattcccatctcttttacaaagcattaaaaacacaactgtcttatccacagatacaagctgatgtaggttttgttgttacatcattagtcttgtcactgaaaaacagtaagtaggtggcattaaaagccttggagttttaacttgattctcatacaaatttttcaggaatctagtctatttgatagggtataagaagtgtcttctatcaaggaatttcctatgataggcagtaaattccctattggtgtttaataatgatattttattaccttattcacatacttaaatatgaggatttctaagaaaaagatattacctcaagaaagagtgatgactaggatttcatacggacctgatttgttttggtgtttaggatctggcacatcaaaggagaaatgggttgttctctccagaccatgaaaatggacatttatactaaatacagaatataaactcaagagcatgacagaagactatgttttatcaaataacttaacactttaaaaagcagcagcattacattctggcagttgctctctagtggcagatagcacagatctgtctgtgtcctatctgcagcagtctctgtgctgtctgcaatcttggccaagtcaagatccttcagtggtcatgtttgagcaagtggatgcccaaggactttgacagttagtttataacaaatttttttttgttttggaacatggcataacatcttttctaataagagagtatttcaggttctggaaatatcatggttactgtatatgctgtgtttaatcattttctttctctttttttttttttttttttgagacagtgtctcactctgttgcccaggctggagtgcagtggcatgatcacaactcattgcaagcttaatctcccaggctcaagcgatcctcctgcctcagcctcctgggtgtctgggactacaggtgcgcaccaccatgctcagctaattttttgtattttctttagagatgacattttgccgtgttgctcaggctgatcttgaacccttgggctccagtgatccacctgccttgaccttcaaagtgcggggattacaagtgtgagccactgcatctggcctagtcattttcttatgatggttttagaaattcctatttttacaccacatggcaaattgtaatgttatgtagtatttgcaccgtgtaaccagctcatggcaagcactttaaacatacccttaggttccttctgtattggtgtagttctgtatttgttctctaggtttacacttttttcttcagcatatataccttagcctttataagaaatggaatcttaaaggaaaataaactgttgaaacttacctttaaaacttcctaattcatttcaatatgacctacaaattaagtgtcagttgcctgtttaaatttaaaagatgattgagctcctgaagatctaaagatatttaagctataccaaatgcattttcttaccttaatcccaggtgcttttcaatttccaggaatttgttgaaatattttgtcttggcaaggatgaactgaatacatgttcagtttaccacatagaatctggtgctgggagtatattttaaaccttgatgaggtggattcaaaaccatttagagagaaaggggcacccatttgcagtgtgtaaagtctggatcttcctctgaatggagaaatgtgcgttctatatttattcccacaaagaactagaatataaatattgagatctgaatgccttttatttatttatttttattgattgatttatttactggccttggcaatcctctgagtttatacttgagcttattttgcctctagatacagtgctccccgccgagtttatctgcacagctgcagcgccgggaacatgatcaccaaataaatcctagggtgggggagcttgtcttgctttctggctgaaggaagtgtagttgcctaagacaggaacagagggacctcttgcccttcctacagtttttcctgttataggaagtataatgtcctacagagaaggacagaaagatggttggtgcagtgtaggaagtgggagttgtaaggtcagacagaggccagcaattgggggagggataaggaagcctgcttatacttggagttgccaagaaaaggcctgctaatcacccatatacaagttttcaataatgagaatttcctcaatatacttaacagcaagagtcctacacaggaagccctgcagtaagtggccagagaatttgccagatgcagccatttttagcatcactgaactctacagtggattttaaatagtactggttgggaggagaccagagttagattaagccttttctcaaagtttggtctctggaccagcatattaatattggaacttgttagaaatgcagattcttagagcccagtagtctgtgtttgaaccactggcccagccaattcaacctaattgtagtggcaaagtcaaaatattgggaaagaatgagtgaaaacttcattatatgttagaacatcttctgatgtttatatagggatggcagggaatgctgtttcaagttgaaggacggaaaaaacagcttcagttatagataccagtaacatgcaacattgttcctgtaggtggagaatacccccatttgtggctacaattcaccctggtctggaatctaaattctgccagattataatacaagagagcttttcactttgcctcttttttcgttttaaatatttattccttgattgtattaatatttatatatgcattgaccagtgaaattttgttttcatggctttgtgatggcaagagttggtttaagtagctcattggttcagaaacactagatacataaaaattatcttgatatcctgtgtaaaatgtagattattggctgctatccttgcatgtccaagaatctgcattttttcttttttgagacggagtctcgctctgtcacccaggctggagtgcagtggtgcgatctcggctcactgcaagctctgcctcctgggttcacgccattctcctgcctcagcctcgcaagtagctgggactacaggcactcaccaccacgcccggctaattttttgtatttttagtagagacagggtttcaccgtgttagccaggatggtctcgatctcccgacctcgtgatccacctgccttggcctcccaaagtgctgggattacaggtgtgagccaccgcgcccggccaagaatctgcatttttaacaggcaccactcacaccagcccacccccaacctgcaacgttgtttattgggcttgtggttctcagactacattttgagaaacactgtgctaaatttccaaggagagtgattttaaagtaacagctttattgagatataattcacatgccacaaaattcactctttaaaagaatataatttattgatttttagtatatttacagaattgtgcaaccatcaccactgtataattttaggatatttccatcattcctcaaggaatccctgtactgattggcagtgactcctcattctctctttatcccagtccttggcaactactttctgtccctgtggatttgcctattctggacatttcatgtaaatgtaatcatagaatatgtggcccttcgtatcttccttctttcacgtctcacggtgttctcaaggttcgtccaggttgtggcatgtcggtacttcagtacttcattcctttttacagctgaataatattccactgtgtggatggacattttgttgatccattcatcagttgatggtcatttggttgttttgctgtgcgtatgttttttaaaacaatattaactatatctgggccttttcaaatcatcactggataattctgtagagtgtcttagaggggattcctataggaagtggggactggatttagagtcccttctgttcatggatttgaggagtctgtatctgtaatttctttgggctagtgaaatacattcttctaagagctagagcagctactttttcttcatagcagaacatttgatattgaaaaaaatctttttacatgacttgtttaaggactatatttcaaaatagtttctattaaaaatagtattctttagcatttctggggaggaggaactcttactgaaaaagctggtatttttgtctgtattttcttttcttttccaatctcttcatttttactctaccgaaccctataacccaactctattaatctagatcctctttccagcacataaatatttatggacagtaataaattatattagttctaatagagtttaaaatgttttgtgaatttttatcccagcatgacaaaaatcactgggtggtctgataccaccttcatctttaaatatttaaccaattctttttatttttaaaggctacattaattgaatgatatccataaaagtgtttaatagtacttaccttgggcccacagtgcgcaaagcacttcatggaattaaggtcctttttgcatctgctctcctcataccttatttcaactgtggtactcaaaatctgggcccaccactctgcagtggggacagtgactgaacttgcatgtgactaggattatgaagggtttagaaactgtgtcatgtgagagttggctgaaagaatggaggttgttcagttgttaaagagactactcaggcaatgacagccctcccagccattcagagcttgtctagagaaatcttattcttcctttgggtagtagtggggagaaactggagtgaaaggatatgtcaacaggctgttaattttgttgggttataagtaggccaaaaacatggagattttttttaatgtttctttcttctttttttttctgttagacagagtcttgctttgctatcccagctggagtgcaggctcaaactcctgggctcaagcgatcctttgcctcagcctcctgagtagccgagagtacaagcacatgccaccatgcctggttaattttaaaatttttcttttgtagagatgggggtcttgctatattgaccaggctggtttcaaactcctggcctcaagcaattctctggccttggcctcccaaagtgctgggattacaggtgtgagccactgtgcccagcccagtttttcattcttatgtacctttccactatctttcagttcctagaatatctagtccagtgtctgatggtaagaatggtttctggattgtattttacctgttcaggatatatggaatgttaaattattgcatcagcattaatgcattattttagccttaacaacagtgtataaatttgtaaagtgctgtttgatattatacaattttatatagctaagttttattagatcaggattaaaatataccttccatttggtataatgtgtaaagtttagtcacttcttaaaatataagactgcaatatgtataacttgccatgccaataagcaacaagatgtggtgtgcttaagagtgagggagaagtctctggttgtggtgaatatccgtatttggttggggatatagggagttcctggcctgtttcacttttgactgtctggttcagcttatggttcagcttaggatggaatgtactgctctgtgctttaaactgccatttttgatctaggcttggactggggttcgggcagtagagtgtagtgctgagagttcagggtctggggccaaaccaggggaatctcacttctgccatctcatctttgtgaacccaggaaagtatcttaacttctctgggcctcagtttacttatctgtaagatggagatgacagtacatacctcaatgggtagtgaggatttaatgcaatagtgtacttcatgtacctagcctgtctcatagcaagcagccaatagttttttggtgcagttgctacttgttaatatgagtgtctgaaggtcaagggccttctctaaggtttctgaatagaggagttctgaattcactgaattcccaaaggagaaagactctggttcacctggtttctctaagtcattctaggttcctgttgcctgctcaggacaacacctggggaagttttgggtgaatgggattctcctggccttccactctctgaatatgtccctgccttgttcctggcctctgacatgaagtgtttgtgtagtgggagttctctggcggttttcagaggagcatggctaaatgtgtagataatccataggaacactagaacatcagagcactgtgaacagttttgtaccacctgtgctacaggagatacagaaaaggacacgagaaaaaaaattattattattatttttttttgagatggagtctcgctctgtcacccaggctggcatgcagtggcgcaatctccgctcactgcaagttccgctccccgggttcacaccattctcccgcctcagcctcccgagtagctgggactacaggcgcccgccaccacgcttggctaatttttttgtatttttagtagagacggggtttcaccgtgttagccaggatggtctcgatctcctgacttcgtgatccgcccgcctcagcctcccaaagtgctgggattacaggcgtgagccgctgtgccccaagagaaaaatattttaaattaatgataaggacaaagtgaactgtaactaaatccccatgaataataaaactacattcagttttgtatgattgaaatatctattcagaaagtgtctattaagcatgaattcatactggtcagtctaggagcaagaatgccaggaaagctcctgggccactcatgaccaaaactacgtctcaagtccatgtcaggttctaactgctctcctcctgaaggcagcttgcagggctcatctggcttcctctgctctcagagctgcctccacccacccatctcctggaattctgtatttcccaaggttggctgcagcgtggccgtactttccttagctcccaactttccttgttgtcctggtggttgtcttcagacccttttggggttaaggattttcttactaatccttatggaaaaataaagggcaatttaaagatttggttaaagataagggcagtttaaagatttggagtgttggctgggcccagtggctcacgcctgtaatcccagcactttgggaggccaaggtgggcagatcacctgatatcaggagttcgacaccagcctgaccaacatggtgaaaccctgtctctactaaaaatacaaaaattagccaggcgtggtggcaggcgcctgtaatcccagctacttgggaggctgaggcaggcgaattgcttgaaccgggaggtggaagttgcagtgagccgagatcgtgccattgcactccagcctgggggacaagagcgaaacttcgtctcaaaaaaaaaaaaaaaaagatttggagtgtttacaattgtagttatcagtccactgctaaatagtaaccgctaagatgtaactggaagccagaccaggcgtctctccttgttacgctaggcatgaagttcaccagacctattctattggttggactgttcttctacccactgaaacccctcctttctaccactagtggagactgaggaaatcaggaaagaaccacgagagccctccccatcttgagggtggagtttgcattgccaaggacctctagataagttgatgccctattttaaaagatacctcagatttgttctaatcaggtatggcatgatgacagacacagaaacaagctgcttttgaaagaagagtttattattatagttcccagaaggagggggtgcatcacgccctcatatgacacagggccatatgaggaagcaccgggattggtcaggaggcagaaagagttgggggaagcatgggcaggagcttttattggggtttctgtgggaaaggcaaggctagcaggctgagcagatgaaggattggctagtttgaataattttggagggctctaggggtggtccctgcttgtgtagtacctggctgtggggtgatgtaggacagtggcaatattgcttgggctatgagagttagataaggacgtggttgtggactgtggattggttggtttgcctatgaaaggcatgctcacaggcaagttctttgctatctcttggaattagccctgggaggagcaatttctccaggattagcaaggctccaagatgtcaaaacatcataaaatatagaaaataaaaaacatgattaatgcataacccttccagcagaactgtgcttatcacacaagtgattcttttgggagcattttcttattgagtgatagaaagaatggtaaagtggctccttgcacccctcgagtttactgtctagcttagtaaataaggcctgcacacatgaaagtgaccagccatgcaggacacaagatcacatgccagaaagttcagcatagtataatgggagctcagagaaaggagagatgagaatgttgtagaagcagtagagggcagtggttcagaggctgctgggtccatatccggcttcatcagttacaaactgtgtaaccttaagcaagctggaaaattcctgtgttttagtttccttatttgtaatataagtttaataatagtagtacccatatcagagttacagtgaagactaaatgagttaatacattgaaagggcctagcacaaaggctggcgcttaataagaactcagtaagcatcagctgttatagggctggtgaggaaagtttcacagagtggatacaattgattgttaccttaaagatggggaggtggcaggaggagagagagagtgagtgagaaagtgtttctctgttgggttggggtggatgtggggtggtggctggaaatgagcctggcaaattcaggtaatagaaggttggtctgataggataaggttgaaaaaataggttggtgagagttgtgaatggtaaggattttgcattttttctttaaaccatggaaattcattcagggcctttttcccccttttgtttttattttattttttatttttttatttttttatttttttgagatggagtcttgctctgtcgcccaggctggagtgcagtggtgcgatctcggctcactgcaagctccgcctcccaggttcacgccattcttctgcttcagccccccgagtagctgggactacaggcgcccgccaccatgcctggctaatttttgtatttttagtagagactgggtttcaccgtgttagccaggatggtctccatctcctgacctcgtcatctgcccgtctcggcctcccaaagtgttgagattacgggtgtgagccactgcacccggccttcccccttcttttttttaaaagcagggacgtgacattaaattagcgcttcaggaatcttactcttagtggtatggttctatagagaggagagacttggacaggttatataagtcagaatagattaagttagtagtaattaaaaacaactccaaaatctttgcggccccccaaaaaagaaggtacgtttcttggtcatgctattccatcacagctgaactggggactctgctcatcacagtcattctgagacccaggctgatagaacaaccaacatgtcacattttgtttacctttagagagcagagaagagcactctagagggttatgcactaatgattaaatgctaggcctggaagggacacgcatacttccatttacaactcagcactagagtgcagtcacatgtcagtaaccagttacaggggttcaagaaaccttctatgtttgtggggaggggctgggtagaaagaactggaagtattcaaaaatagcactgacgaccacacagggagtcttatttagaaggtggttgtgtaatagttgaagtgggtggtcttagctgctgggtcacagttgttgcagtcaatacagagaagagttgtatacaagaatttaaagcagtagaatttaaaagttgatcattgattgggtcgagttacaaagaagagaggagtcaatgtgaagcaaaacttttggtgtgtgttgaggggatggtagcagaccagtggggtgccctcaaggcctctagagctgtgctccttgatgagtagcccaccaaccagtgcctacccacaggcagtaattggtttgcaaggaaataagtgcagaaatagagggtactcatttagaaatgtttatattaattctttttttttttttggacttagtctcactctgtcgccaggctgatgagtgcagtggcgcgatccttggctcactgcaacctctacctcccaggttcaagtgattcccctgcctcagcctcccgagtagctgggactacaggcacgcgccaccacgcctggctaattttttgtattttagtagagacagggtttcaccatgttggccaggatggtcttgatctcctgaccacgtgatccgcctgcctcggcctcccaaaatgctgggattacagacgtgagccactgcacctggccacttttctttatttctatgctatagtttgccctgattatatttatgttgaatctaatacaaatttggggcatgtaattttgtgtttttttctttttctttttagtgatctatttttattatattttatgaaagtataaggggaaaaataaccgcagattgttggagaagcattgctttggagataggaggcagggatgtagagatcagagctggatagcaagttgaatcctttttgtagaataatgagttgagtacctgagatgtgagcaagagaaagacttcagaaagagaagagggcccacggctaagccttgggaggcacccagtgttctggagacaggcatgtaagaagagatgcaggctgctctctgtggagtagccattcctttattcctttacttttttaataaacttgctttcactttgcaatataaaagaagaagaagaagaagaagaagaagaagaagaggaagaagaggaagaagaggaagaagaagaggaagaagaagaggaagaagaggaagaagaagaagaagaagagatgtggatgatactgtgtcccaggaatcatcggaggtggtggaaagttagtggtatgagatgccacagagagtcaaggaaaataaggcctgaggttaaactagacttggcaagaagtaagtcattgtgaatgtttgaaagtaaacttgtagtgaagtggtgtgatcagatgccagatttcaacagtttaagaaatatgcagtcacaaaatagaaaaggttataaccttctggtcagaaaagtttgatagataaacaaaagcaacaactagagtgttagctattgagcccagcaagggaaagcacattttgttattgttttttccaataggaaatcatgagcaactcaaaaggcttctaccacctggaagatgggaaaatcaatgagggaggagggagatggcagtgttccatggctgggaatggagtggaggacagaggccatgggagtggacccgggggtgaggacaggggttggattgaacccaggtaactacccacacagcagataaggtcattaggaggggaaacgtggatgggaatctgcaaatctcagttgactcaaacagggaaaaatgcaagctggcatacctgggagttagtcttgatgctgcggtagatgtggtcagagttaagcgagcagggacttgggagtcccagtgagagcattaatgaagtgctttgacattgtgaccatggggtccagcgtgggctactcagcttcttcctctagtccacactcggtaaaaatgaaggttactgaataacaaggcaatggtggggagggaggaatggagtggggttacttaatccttaatcatgattaagaataagatatggggctgtgcgcggtggcttatgcctgtaatccagactttgggaggctgaggcgggcggatcacgaggtcaggagattgagaccatcctggctcacacaatgaaactccatctctactaaaaatacaaaaaattagctgggtgtggtggcaggcgcctgtagtcccagctactcgggagcctgaggcaggagaatggcctgaacccgggaggcggagcttggcagtgagccgagatcgtgccactgcactccagcctgggtgacagagtgagactctgtctcaacaacaacaacaacaaaatatggtgggctggttgcggtggctcatgcctgtaatcctagcactttgagaggccaaggtgggcggatcacctgaggttgggagttcgagaccagcctgaccaacatggagaaaccccgtctctagtaaaaatacaaaaattagctgggcatggtagtgcatgcctgtaatcctagctgcttgggaggctgaggcaggagaatcacttcaacccaggagacggaggttgcagtgagacaagattgtgccattgcactccagcctgggcaacaagagtgagactctgtctcaaaaaaaaaaaaaaaaaaaaagaataaaatatggtacaaattggatttacgataaaattatttagtttaaattatatctaattttggaaaacactcagcaaagttatgaaaaatacagatacagtgctttaagtgctctaaacattgtaaaatttgaaaaatgcttcaaaacttccacctgttgaaataatctgttgacttctcattttcattgagctctttttttatttttaatttttctggatacatattaggtatatatgtacctataagggtacatgagatattgtgatacaggtatacgatatgtagtaatcacatcagggaaatggggtatccatcacctcaagcattgattatttccttgtgttacgaatattccaatcatactctcagttattctaaaatgcaaaacaaattattgctgactgtagtcaccctgttgtgctatcaaatactgtatctcaacattgtctgtaactgtatctttgtacccattaaccatccccgttctccctcctacctagcctctggaaactaccagtgtactctatctgcatgagttcaattgttttaattttttttttttttttgagacagagtctggctctgtcgcctaggctggagtgcaatgggtgatctcggctcactgcaagctccgcctcctgggtccacgccattctcctgcctcagcctctggagcagctgggactacaggcgcctgccaccatgcccggctaattttttgtatttttagtagagacggggtttcaccgtgttagccaggttggtctcgatctcctgacctcgtgatctgcctgcctcagcctcccaaagtgctgggattacaggcgtgagccaccgtgcccggcaattgttttaatttttagctcccacagatgagtgagaacatggaagtctgtctttctgtgcctgtcttttttcacttaacataatgttctccgtttccatccatattgttgcaaatgacaggatcttattctttttaactgctgagtagtactctactgtgtatatgtaccacattttctttatctgttagtctgttaatggacacttaggttgatgccaaatcttggctattgtgaatagtgctgcagtaagtatgggagtgcaggtatgtctttgatatactaatttcctttcttttgagtatatacctagcagtgggattgatggaacatacggtatttctatttgtgattttttgaggaacctccatactgtacttcatagtggttgtgctaatttacattcccaccaacaatgtacgacaggggttcccctttcttcacatcgttgcttgcgttcgttattgcctctttcattgaactctttcgagtgttagaatgagacaagagctgggcagagatgtagtgtgtctattgttgtgcccgcctctcccttccctgacctaattactctcccttcaccaccctgaatccagccagtgggtttcctctagcctttgctatggtaggtagtggacctctgtttggttttccatgtgacattgatataaggtatcatgtcatggttacttggattgctgtgcaatagaggccatggatatctcggttaagaacactctggagttcaactgcttgggttgacatcttggaaatctcagacacttaggctctctgagcatcatttcattatctgtaatctttccagtaccttgattgtcagtcccctaggcaggtataacctcttaaaaaatggagtagaaaagtgaaatctccatttctttataactgtaatgagttttcccaggaatccttttctgaccactctgctataatttagtttaagtggtacgcttcagaaaactgaaacatgctatactttgcaagcaagtagcaatcaaagggatacattctttcaccttttaaagtagagtgaaatcacttccaatcttatctttgcaacccaaatgcctgctgataatgtgagcataaacacattaggcaccaaagaggaatggcatctgggtgcgaagatgtgatcaacaaagccagagtcaacacaagctgccatcagggaagccagagttcatcacatcacatcatgtttcagcatagttcagggtagacatatactgatggaataaaatcagtttttgttttcaatgttcacattttagaccccctcccccccacttgactggttataatatataaatcaagccacaactgacagtgatttgctttttttgttcaggaaaaggtctttgactgagactgacttggccttactgcattgatcttcaacacaggcactttttataattcccacaacagcattaactccagtgggttttttttttttttttgaatatacatatcacaatagagtctttcattacatgatcacaaattatatgcagtcactcttacgtgcttcctgaaagcagtaaatttagagcaaagagagactgtttaaaacttgagaccagagagcacagtttatcttatttacagtttggcttaaagattggtctttaagttaatatcataccacatgtggtaatcctgcaaagtgctacatatttttatttatagttaagggaataaagcaaaatccccttttcattatgttatcttgcattatttactcagtgataaatgacattgccccacgggtatgagttttgtagtgaaagaccctattgtagcatatatttatgctagttagagttacggttccagagagaatttaaactctgaatatgctggtacttgtacagttagaacatatagctcaatgttgttttaacactatatttttacttcgagtaaaagaaaaataaataggcatgaacaaaggggaaaagcttaaggttgaaatgcaagaaaccaaataaaatgactaaaagcatatcctaaactcaaagattaaaattttaccagagataatggtggtcattagattggccagtttctgctgtttaaaatgacatcagctttcaaagtttattaactgtttaagggtaccaggaacaatttttagcaagtcggggagatatgaaagtgagctgaaagaagagtgctgaagggctggaaagtttaacacctgccccaacatttgaggaaaaaactggttccatgctatgtcagtttgtccaaaccaatattcttgagaatttctcctgaaggaggaagccagtagatattttggagggatggttagtgttttagaatatatttattttgaaatagaataataaataaaaaaataggaaattccaatcttgaataaagtaaaaattagttcagcctctagtcattcaaaactttggataaattaaccaagaatgggctgccattttgctaagtacaaaaataaagactttctaataaattaataatataagtaagatttcaggactaatatatttgaagcaaatatgtcccctgcccattctttctgcacctgaaaggtatcatttcactgttttctgtggccttcattgtttctctgagaattcagatcattctgataaaaagccccctgtcatctgtgtcgttgttcctctgtgtgtaatatgtcattttgtaatggctactttcaagattatttttagtttttcagtagtttgataatgatgtgcctaggtatgttttcctttgtatttttcctgtgtaaataaacttttgaagctttatatctctcaccaaatttggaaaattttaactatttttaaataaatgatttcttttgaaatacttttagatttaccaaaaagttgcaaacatagtatagggagttcccaattcatcatccagcttctcttcatgttcttataatcatggtatatttattaaactaaaaatgtagccctggcataatgcttttatctacagtttttccactaatgtcctttttgtttgtttgtttgttttaggatccagtctaggataccacattgcattttatcatatcccctggacacctccattctgtaacactttgtcagattttacttgttttttatagccttcacacttttgaagagtactggttaggtatattttagaatgtccctcagtatgggtttgtctgatgtttcctcatgcttacactgaagtttcaggaatactacagaggtaaggtacccttctcattgcatcatcctagaggataatgataacaatatgacttatcactggtgatattaaacttgattaaactgcctgatatctctactgtaaacataatattttttcttttccattctgtattgcttggaagcaaataattaagtttggcctatattcaaggggaaaggaattaagttctacatctttgaagaggtaatatctacatcgattttttggaattcttacataaggaagatgtagtctctcccttcatgattatttgttcaaccaatttaaacaaatttatttattcaatttaaacaaatgattacttattcaattatttgtttatatcagaatattctttgggtttaatccaatactatcattatttattttcttactcaaagtgttccagctttgggcattgaaagctctttcaggttggttcctgtgtcccaattcttctgtttgtctgtctgttttcttctttactttagaggtccatgtgatgcttcagatccatcttgtattttccctgcccagcctgagaatcagccatgtctccaaggagggctgtttccttttgttggaaaatggtatttagaaaccaagatctaggtgccagttgtgctcactgcttactgttttttaaagtattttttttgtgaccacattctcttttgcctgtccatcttggactccaattatttgtcccaaaagtacctgttcattctttttcacgtttttctgttctttacactggataatttctatgtaactattttctggttcactgtcttctataatcatgaatcttctgttaaaaccatccagtgaagtttttatctcaaatatagtatttttcagttctagaattttcttttccttttcaaaaaagtaattcctatttctttgctgagttttccttttagttcatgtattacagcatttatgcctaattataatatgaatagctgctttaaaatctttatctgttaattctaatatttgggtccattcaagttggtctctactaattgctttttctttgagtttgggtcatgttttcttatttcttttatgtctagtattatgttttattttagacattgtatttgatactttgtagaaactctggattctgttatgttcttctgaagaatattgatgctttgtattaacagacagttaacttggctgaactcagacttctaactttgcctttgctgctgtggagagcaatcaaaatctcagtttagttgagttcattttgcctgaaggaggctgtttgatctcctccatacttgcatggttcaggggacaattagggaattgggcagagtttatatacagaatatgggactcttgctttgtagacatcacctttcctaaagttttccttcttttctctccagctactgtgttggtcttgaactctagtctctcattcttcagccagtaagactccaggtttcggccaggtgcagtggctcacgcctgtaatcccagcactttaggaggctgaggtgggtggatcacgaggtcaggagattgagaccatcctggccaacatggtgaaaccctgtctctactaaaaatacaaaaaattagccgggcgtggtggcgggcacctgtagtcccagctactcgggaggctgaggcaggagaatcacttgaacctgagaggcagaggttgcagtgagccgagattgggccactgcactccagcctggcgacagagcgagactccgtctcaaaaaaacaaaacaaaacaaaacaaaaaaaagttcaggtttcaatctgagttttaacccatttatgcttagcgttccattactggaatgctaaacttatggcagttatttatatcctgctgctcgagctcatctccaaggtctgatgatttttcttttcttttcttttctttcttttttttttttttttgtgagacggagtctcactctgtcgccaggcagtggctcaatctcggctcactgcaagctctgcctcctgggttcacgccattctcctgcctcagcctcctgagtagctgggactacaggcgcctgccaccacgcccggctaattttttgtatttttagtagagatgaggtttcaccgtgttagccaggatggtcttgatctcctgacctcgtgatccgcccaccttggcctctcaaagtgctgggattacaggtgtgagccaccgcacctggccaaaggtctgatttttcacaaaaaagaaaaattgcaacctctggcataaatgggttaactgccttgcctggcaccaactagggctttctctccggtggaaaactataacgcaggaagctcaatgccattcccttcttccacgtgttggcgccttacagttcttgtcagctttttgctcactctcatgggccttcagaaattttgtctttttgtctagagtttataagtactatcagtgggaggattagtctgccagaaggtactccactattaccagaagtggtactccctttcatttaaggagagggcagaattatattaattaaataatcaagcagacacatgtaaaactaaatgtaaaactaaaactgtgtttgttgtgctactaagaagcacacatctatgaaatctaataataggggaatttgacttaattggtgaggtcaggaatgttttccttgaggacatgatggggtccagagagttactagacaaagacagaatggaagaggattccacgtatttgttgattgagtgatataatccagctttctatgtatctgggcttcttttctttgcacatattgttaacctctcaatctttaatcatctctctgggcttctgtgataataaaaggtaatctatagctctggtgcctctaatgttatacaatgaagaataccctacatgaaaatttcttttttttttttttaactgaaattttaattttagatccagggggtccatgtgcaggtttgttgcaagggtatattgcatgatgctgaggtttgggcttctattgatcccatcattcagactgtgaacagagtacccatgaaaacttttttttttttttttttttttgagaaagggtctcgctgtgttgctcaggctggagtacagtgacacaatcacgactcactgtagtcttggcctctcaggctcaagcaatcctcccacctcagtctccttagtaactggactataggcgtgtacaccaccatgtctggctaactgttatttgtggagagaggtcttcctatgttacccgggcttgtcttgaactcctgggctcaagtgatcctcccgccttggccttccaaagtgctggaattacgagcatgagctactgcacccagcctcatgaaaacttcttcaccaaaaggaattgtgggtctggaccattaagtggtatatcatagtctgtgggcttctggccaatgtgatcaactgaagtgtaaggaaatctcccttccacttcaggtatttagaaacaacaacacacatacagacacacaagtctctctctctctcacacacacacacacacacacacacaccccacatgcatgtaccagggagaaagaacacatacgtatcagtaaatgcatgctaataacaaaattctttcttatcagcaaaaagatatgccaggttacagtggaatcttgtattcaaagtgttaattaaaaataactatcaacaaaagttctacacttagttaagtggtcattcagtagagaggatgtaatacagacattttcaaacatacaactgttaaaagagtttgttacccatggactcctcctaaaataattactaaagataaacttaagtaaaaaggaaattgtggcagattgtattttccaaaaatggccataacaatatctaccatcttccatgcttttctacagtataccttgctactcccccatcaaaagatggagtctaatcccctctccttgaatctggattggccttatgagtttgcacctgaaagcaatagactatggtagcaataataaccatgttgactttgaggctcggtcagaaaaggccatgcagttttcaactggtactttgagatgctcgtgctgggggctgccagctaccatagaagatgtacagccattccaaaagctcagtgttaaataagctttatttaaataaacttatttaagtaagtttaaataagcggcctttctgggcatcagaccctccagacaagtccatcctccaactgagtaccattgagtaacatagacagattcataagatgtagaagagtggcccagctgactgttacccacattcatgacctatagaatataataaaatggttgctgtttgaagctacaaagttaatttgtcatgcaacaagtagaataaaattggacccagaaggaaggagtggaatgtataaattatcaggagtaaggaagctggtgaatatatttgtaaatacaaataaatattgactttaaaaaagttggatggagttttaacaaacaatgtgatactaaaataatagcaacaataatatggaagctgttatggagtaaggaagaggaagactggttataaaactttctaaggtccttatattgtttggaaggttattcgagattgactttaggcatattaaaggcattgattgtgtaagttatgaaacagtggaggggaaaacaggaatgtagaaaaattcaataaaaagcagaaaaataaagctaagaagcaaagaaaatcatgggcgatagaaaacataaaatatgttgattgagatggtgctgttacaactgtaattgtgataaatgtaaagaaattcatttcagtcattaaaaatgataattatattttttaaatagccagccaaatgttgttttaaaaagacagccaaggcaaaaagagtccagagcagttaaaaatgaagggattgaaaagatgtgccgggaaaaagcaaaccaaaagaaagtaggtatgacagtattaacatcaggcaaaacggaatttctagacatctcgtgttttcttctcaggatacacctgtgcctctttttatgccacatctttttacttgcatgtgtgcagctaggagatgtgcgtaaggaggctcatttcagcattgtttgcaatcaagaaaattttcaaataactatcagtaggggaacgtatggatacattatagaatattcctgtgggggcattaaacagcagttaaaagagacagatttatatacatcaacatgtctatatttcaaaaccattgagtgaaagaagttgcagagtaatatgtcagtgtgacatttataaacacaaaacagtatatttgaacttctaagtttccttctaattctgaaattattgaatttcacagtagtaagctatgttcctgtgactatatgcatttgagtgtgtgaagaattgtgcccagaaacagtgtatttcagcaaatacactgactgttattaagagcaattggcatatcctaaataatggacacacctggaatagcagaaagctgtcattctctgatcaagtaatcggtggaattaaatagtaactactcaacagtgtgctctatgctatagaatgagcatatgtgcaaaaataatttctcctttcccccagttgcttacaagtaaaaagatgaggcataaaaagaggcacaggtgtatcctgagaagaaaaaatgagatgtctggagggagatgttagttaagcaataacttagcactagactatagagtacaggcaagctagaatccctgttgtataagtaactagacattgaaatcacaaatacctttggatggcaattccacaaatatttattgagaacctgctgtgttgaggatactccacttaacctggtcatgaacacaaaaatgattcaggagttacagggaatttttagagcattggaggatggaagtaactataaaatgagccaggataagttagaatcgtgaggatacacgttgctttgtagcttgaaaggagaatgaaattgttttcgttggggtgattggggatggcgttacagaggttatatcccacatttgtaaatgggtgcattccactttggatggctgagaatggcagagcagtttcttctttgtgccatagctctgtttagtatgtgatcctcttcccccttaagaaaaatattactgtacgctaatcctttcaaagcctttaatggtgctgctgagacaatcatttaagcatttaaaatacataccacatagcacacttattttttcttttttttttagcacacttattttagacacagcaatggttagccactggaaaactaaccactggtttttataaggggggacctttgtatgttatggcttatgacagagaatggaaaaatgcttcagtgagacaggctggcattttgaattggagcacagtaatagccaaaagtgctgaagtcaacggactgcttagaaatatggtttccatttgctgagagaggccttgcaaggtggccacatacatgcatttgcaaccacaggcagttcagtttttccctaaatgtggggctgtgaccctgattgatgtcagtgagcgttacgtacttgcagagagaaagatgatttaggtcatccatgaatctaagacaagtaagacatagacaaataagcaacaacttaatagacttatatataatttaggttggaaatcatgcagaagtgacagtgctcttcagaatcttctggggctggcttaaaagttctcctttgccccccaaagctattacaataagaattggttactagtctgcataacttgaagaagataaagaaggtcaaaggaagatgtggaaaagagacttagaggtgacatttgatttatgacttagacaatatgaaggagatggccatgagacctgggagatgagaattccaaggaaaagcatcagcaagtgggaaatgttctgttagtggcaaacaaaaagaaatgggtgaccttgagcaaattactttgcctctctgggacccactgtcttcatttgtaaaattagagagttggattcagtgagccctaaggaatttttcagctccaaagttcaataaaataaagatgacttaaagtaggccaaatgaagttgttgattgtttttaaagatggcaaccctaggccaggcagggtggctcacgcctgtgatcccagcactttgggaggccgaggcaggcagatcacgaggtcaggagatcaagaccatcctggctaacatggtgaaaccctgtctctaccaaaaatacaaaaaaattagccgggtgtggtggcgggcacctgtagtcccagctacttgggaggctgaggcaggagaatggcgtgaaccagggaggcggagcttacagtgagctgagattgtgccactgggtgacagagcaagactctgtctcaaaaaaaaaaaaaaagatggcaaccctaaggttggcttaggtgtgatggctcacacctgtaatcccagcactttgggaggctgaggtgggcagatcgcctgagctgaagagttcaagaccagcctgggcaacatggcaagacctcgtctctacaaaaatttaaaaagttagatgagtgtggtggcatgcacctatggtcccagctacttgggaggctgaggaaggaggatcgcttgagcccgcaaccctagggatgtttgaatgttcagaatagggtgtaatcattgaaggggagaaaatgttggcaagagaaaaatgtcaaatgaaacagggttcaagtaagtggaaggggatggtgttgagagaacacttcttccccacttctcatgtttccttccttgttggagttcagtcagtgtaacactcctggtgcctttatcctaagggaggtggggtgacatagtctgataaatttgggaagaagaaactggatgtgctctgctcatctcctcccttttgcttttgggcagcactcctgaccacagagaaccatttttctctcttcctccaggccttaagtcttacctgagggaggctaccccccgttctggaagctttaacttgatccagcattgcctgtgaccatgtggataaacctaattttgtgattcagtttccaggtacctttggctctcacagtaagccatgttctccagcttagccttcatcagtagcgatattttggtctgcctttgccatatcttcatcttatttcttgctacattcagaatctggataggagaggaatgtgctgtttacttggctctctcaaaaccccagaagttgggattcagtggggcagaataagcttaataagctttggtgaaaagggatattgttccctctgaatcaagagaaggtaatacttatgaagaactaatgatactttgaggtatggttgagttgcagagattcagaattatctcagcaaagcagggggccagatcatcaactgagaatgagtcagcaagcttggaattggaaagttaaaagttttagaattgcctctgtggagagtatgcgaaagaatccactaaagagaaccaatggattgtcagtcagggtgacaaacgtttcatcacttaaaacacataccacgtagtacactgattttagaggcggcagtggttagccactggaaagccagccatggcttttcataacagtggttctgctaacaggcttgagtggatagggctctagggcagcctcattctctgccaccagaaacaaaagtggtgacaactgctctgtagaatatattttatgcctaaattatacagatttttagaagtgaatttaggaatctgttagagttagacaataaataattatatctataatgttaaaaatactaaactttttctctgaatataatagtttagccagccactaaattgacccttgtctcagctgatgctggttttccttctgtgtgtgtgtgagcatgtgtgtgttcagggcttttttttaatcaaacaagttttttcaaagatgcccagtcaacaaaatactgtatgttagcagccacagccaccatcagaatgaagttttaagatcactgtttctgattacatagaaatagccaatggatttatcgaaggttattattcaaaatgacaggacagaaaatactctggcttatcccctgtgctcattcacttttctagaaccaagggaaataccagcttctccataaagtaaattcaaactgttctttgcaaccttgtttctctctacttctattgcactgaaagtgtgctacatatagttcagtgggggagggagcaaggaccagggaagggttttaggaggtggttgcacttaaactgggacatggaggaagaataggatttggcaggtggaggtggaaggcaggagccaggagcgctccaggtctagcacatgggttagtccaaaaggcactgaggcctagagtcaagtcctcttcaggaagcagtgttttgagtaggccctttggctagaggacaaggatgcaagggaatgttgtctccatgactggaaaagtagctagaaactggattgtacaaggctgcaggaggcaggattttttaaggttaggtgagattttgaagaggaaatagtctgtggagagaggtagaaactgaaatcaatgggatattaacctagaatgagattctagaaggaaaggaaataaaagggtctagtagagatgcagataaagctggcagggaagtgaggaggagttaggatacaaagggagggcttgatttacttgaaaattcaagcaagtaatgatgttttgcagttgttgaaagaatgcctcctgatatttagaaatacgaaaattattttaaacatatctgctctgtcagagtttttctttctgttctcctgccatttcttttttgattttggtaaaagaataaaaaaagaacagcatatgctgaaagaaactaggtacacaacggggactgaaataatttcaaataatttttcttttagccagattgctagtatacaataagaatatattttgattcagaacttttatgaagaacttgtgcattttattgtaacatctgtttctacattttaatttctctccttccttttataggtatttgcctgccttttttttttcaagtgagaagaccttttgtttgccacaagaaggctattatccagaatgttaatgggttttcagctattaagatgtaatgatataccttgagtatttaactataaatttgaaaaatctccgtgaacaatctcaaaggaatacttagaatgcactcctggtaaattggctcattttcctgtaatttactggaagtgctgatatgagagcagtcctaatgtgaaaagtacattaatccctggagttacattgtatgtattaaattattactctcaaggaataaaatgtgtggggccatttagccttcattcacacttgttacttggaatcacagtggaaaaacaatcacttatcttttgatgcacaaaattagaagggatacatttaatatcttttaagactagaggcacagtgatgctgggttacacttttgcataacacttgctgttttctaaaagaaggacagttctcattggagcgtgcttcttctggctttgtggaggcccatgccatccagttggtaattgaaatatttttagaaacccataatgcagctttctttcatgtcagtagaaaagataagtcagccttctagccatgagcatctaccgcttgggggattatttaaggatggtggtcaacttgcaggagcagcagttgcaggagcacttaggtcttatttggaattttatctaattgtgctttccttttttgccaggagactgaaaggaaccataatttgtgacatcagttgttttctttgataagcagctatttatgattctggaagattaaggcagataggaaaccccatctgagattttaataaatccctcaaacaataaaccacatcatggacatacagctggaccctgccagagatgacctgcctctcatggccaacaccagccacatacttgtgaagcactatgtactggatttggatgtggattttgaaagtcaagtcattgaggggaccatagtgcttttcctcgaggatggaaacagattcaagaaacagaatagctctattgaggaagcctgccaatcagaatcaaacaaagcctgcaaatttgggatgcctgaaccctgccatattcccgtgacaaatgcaaggaccttctcatctgaaatggaatataatgattttgcaatctgtagtaaaggtgaaaaagatacttctgataaagatggtaaccatgacaaccaggaacatgcttctgggatttctagctcaaagtactgctgtgacacagggaatcatgggagtgaggattttttgctagtgttggactgctgtgatttatctgtgttaaaagtcgaggaggtggatgttgctgctgtgccaggtctggaaaaatttacaaggtctcctgagctcacggttgtttctgaggagttcaggaatcagattgtacgtgaacttgtgactttgcctgcaaatcgttggagggagcagttagactattacgctcgctgcagccaggctcctggctgtggggaactcctctttgacactgacacttggagcttgcagataaggaagacaggggctcagacagctactgactttcctcatgctatcaggatatggtacaaaactaaacctgaagggcgatcggttacatggacctcagaccagagtggcaggtaggttatccaagcacttcaaagccctgtgcctgttaatcttgtacgctgcggggatgctttcaaacatgagaccggctctgcagagatgctcctgtgtcttctgtgacattacccaagtagcctcaaatccttagacctacagtgaagcaggtaaattcccaggcatgctaaacccttaataggattagctcccttaagtcaggatgaaaagattattaagccctccctatttctgagttaagagattgaaagccatgcttaatgatgaaatcctgagcctcgctctccattgagatctctgctggtgacttggagtgctgtagatgggagtgatacgtctccgagtgaatacttgcttaacgttccttcatagtcccttgagagaccagactgccatgaagctgggttggtgtgaagcctggcaaagtgctttcaaataaagccagctctgctttgtgccttccttaccgtacttgtctattggcagctatgcctccctgacttttgtcagttttcatgtaacgtgaccccccccaaagcatacaaaagacctgtttctgagcagcataacagtcctctgagactgcacactggcttctttggctgtgattcttggtatttggtaccagaaagaccgctgggttttcgttcgaggagaaggaattgatggaggtgtcgttttctagaggatacatttaggcagaccttgctctaacaattgttcagatttttaaaaatctttttcttattgtctttcctccaacagttgttcagatttttttaaatttgagaattttaaaatcaaactttattgattcctccgtattttacctatttgtgctaaagtactgcaaatcaatatggtaattattgcagagcttggatggaggaacgttgacctctgttagctgggtttgggagccttcttttatagcgttgtatttccttaattgaagcagtggtcttcggcaattgcttacatgtctccctcaattcatcccccaaaacaccttgcagctatagttttttaaagcctcactttgactttgagctctaattattcattccttgcctctaatcttaccttctgttctggtctctcaccctgctcagaatgagttcacttcctgtcttatttctgttagagtctgaggcagccattgtgaaattgcagggttggtgcaaacttacctcagtacaaaagcgtagtgatttatttatagaataccttattagatagtttttggagactgtgaaagaatgaaacgggtgttcttattgtatcttcacacttttttgagattattaaagatgggaatttcaatacaatataacaatatactatctgaatatttaactaggaaattatagtttttatactcctagatatttcagttttgaactagaataatgaggaagaaggaactattggcagaatttggaagaaatatttatggcctcaaacatgactttctcctgagtgcttactgcaaacaaagagattagactggtgaattaaatgacatgtaaaagtgatgagtacttacagataaatgatggtttctatgaagaaattaaagagggccaggcgcggtggctcacgcctgtaatcccagcactttgggaggctgaggcgggtggatcacaaggtcaggagatcgagaccatcctggctaacacggtgaaaccctgtctctactaaaaatacaaaaaattagctgggcatggtggtgggcgcctgtagtcccagccattcgggaggctgaggcaggagaatggcgtgaacccgggaggcagagcttgcagtgagccaagatcgtgccactgcactccagcctgggcgacagagtgagactccgtctcaaaaagaaaaaaaaaaaaaagaaattaaagaggtccttgggcacattttgctccttcaaatgataaatttagtcttgatatctcattttctgataattcagtaaatatatatgatcacagaagatgtttaaactgtatccttggaagtttgggaatatgtgttagtatattaatgccatttgtgcagtcttctgaggataagaaaaattattttaaaaaacaaattctagaaaggtgttttctctttttttccctttttctggggtggggagttttatttacagtcaattgtgaatgagcaccaggtctctctcaactctcccttgcgctgcagaataaatcttaggatgtactggtaactgtttggatatgttaaggactttaaaatgagtaaagaatgccagttgctagacagaaataacttcttagtgatataaatgaatagtaattatcaggatcacaatactttatgaatataattgtgtgaaaatataaaattttacagttgcgtgaaaaacataactagctagagcttattcctccacgggacagagtctgtctacatttattaaaactaaaatagtttctacatatttgttcctgaattgcagaatattatcagttatacccgctctaagttctcaggctgggatgagaagctctttattctcattttacaggtaagaaaataaaatgactggaagcttctagataaatctgtatctcaagtgagaaagagaatgactttttttgaatttgatcttcacgtcacttactgtatgcaaagctttcaagtatatttaaaacataaatttattatgttagctttcaataaatttctttttttaaattagacaaatataagaaaatctgtaaattggtaccttttcttttaagttccattagtggcttccccatttcccacctgtactgtatcccagctgagaataaaacttgtatcaaaatgaaatagcttaatattgatatggatggttgcatatggaaataattacagatatgtgtgtttccaagggttagtgtgtgtgtgtgtgtttgtgtatacacacactgtatcttggcttgtcagctgagagggtcttagaagtaagcacacctagcacccagatcttagtttctgataccattttccaatgaagagaactaggacttcttggagaaatgtccagaacaggggcaggaaatatacaagatgagtctggagcatcttgtaatgtcagaaagtaaggaagccctcaaacagcaggaacaacaacccacagcgatgggggtatgccagagggacaaggggccgtccgaaagagctcctcatgccccaagccaagcaacaaaacatatcaagtagtttcgaatgacatccaaaagtatgaaatagccattagtccagctgatgtgaataaacgattgaataaataaacaaatgaggaagaatagacaaatccatggtgcaaaacaattccaagttagttgtggacatgttctgtcctcaaggaggtggggcataactcctcactccttaagtgtggactatacagtcagtgactccctgccgaagagaacagaatggaaagggagaaagaagtaactttacactagagaaatctgacaatactacctcagcaagatgatcaaggtcaatatcaatagtgataatttatggggatagtttattctctggtatgatatgatgaaaatggcatctttgtggtcttcctcgcaaaagctcttaactccaatctaatcatgagaaaagcatcagatacatcccagtcaagggacattaaacacaatacctgatcagcacttctgaaaacgaataaggtcagcgtaaagtctaagaaactgccacagtcaagaggagcctgaggagacatgatgattaaaagcaatgtggtgtcctggccgggtgcagtggctcacacctgtaatcctagcactttgggaggccgaggtgggcagatcacttgaggccaggagttcgagaccagcctggccaacatggcgaaaccccatctttactaaaaatacaaaaagttagctgggcatggtggcaggcacctgtagtcccagccacttgggaggctgaggtgggaggatcacttgagcccagaaggtcaaggctgcagtcagttgtctttgtgctactgcactccagcctgggtgatagagcgtgactgtgtctcaaaaataaaataaaataaataaaataaaagtaatgtagtatcctgaaacagaaaaaagacattgaggaaaaactaaagaaagctgaatgaagtgtgtaaatgtatcagtattggttcactccttgtgacaagcatactaatataagatgccagtaatagggaaagctgagtatggagtatatggaaactctgtatattatctttgtgatttttatttttagtttttattttattattattttataagacagggtctcactctgtcacccagggtggagagcagtggcatgaacttggctcaccaagttctttctaccctgaaatctcttttgtaagagctgttttctcactttaccatgtggcagggttctctggagaagaaaatatatttgtagtctcaatctccttggctgaaacgatccttccacctcagccttccaagtagctgggactacaggtgtgcagcaccacgcccagctaatttttgtatttttttgtagagacagggttttgctatgttgcccaggctggtctcgaactcctgggcccaagcattcctcccacctcagcctcccaaagtgctgggattataggcatgagccactgactgcgcccagccttatcttttcaatttttaaaatctaaaactgttttaatataaaaaaatatatgccagatgtggtggctcatgcctataattctagcactttggaagacagaggcaggaggatagcttgagttgaggagttcaagaccagcctgggcaacatggtgaaaccccttctctacaaaaataataataataataataataataataataataataataagtcacagctacttgggaggctgaggtgggagtattacttgagcccagggaggtcgaggctgcagtgggtcatgtttgtgccactgcactccagcctgggcgacagagtgagaccccgtcttgaaaaaaaattattaaaaagataacttcaaatttggagatttctaccctgaaatctcttttgtaagagctgttttcccactttaccatgtggcagggttctctggagaagaaaacatatttgaagctgtaaaggagtatttattatgaatgattaccaataattttatcattattattctacttctaatatgaaatatctggaaatagaaaactcaattttcctaccttagtttagccatttgggagttgtgccagttgttgaacctaaatgcttcttgcctgtatcattcagatactggattgtaggtgacatttaaaatgactgatggaaggaatacatatataacaatcagatacaatgtgcttcttggaaaagatgtttgcttttctgtggtacgcgggtctgtgtgccctttaaaaatattttgatgagaacaaagacagggtcaagagttgtgtaaaggtgttcttgccaagcttcaagaaaggaatgggacttaatatgtttttaattctagatctttggtatacgtaagaaataaacttttaaaatggaaacctttattcaaagttgatgtgttttcttcattttccttgtatttttaacattttttctattcccctgaagaaaacgttatttaaaactgaagcattggcccggtgcagcggctcacgcgtgtaatcccagcactttgggaggccgaggcgggtgaatcacaaggtcaggagatcgagaccatcctggctgatgaggtgaaaccccgtctctactaaaatacaaaaaattagccgggcgtggtggcgggcgcccgttgtcccagctacttgggaggctgaggcaggggaatggcgtgaacccaggaggcggagcttgcagtgagctgagatcgcgccactgcactccagcctgggcgacagagcgagactccatctcaaaacaaaacaaaacaaactgaagcattctctttgataacccattctctttttcgttagaatcattataatagttgtggaagcagtcaagtggtttaggaggtctgagcttaagctgatgacatcactgaatttgaattgaatggaggaaaattcggttatgtataggaaatttattagaaaaactatagctatttggatttttgttaaagataagagagctaactgggaaaatacattataagataaagtaatattaacatttaaacttttgtaaaacattgtgatttttttgtttgtttgttttagacaagactgggatgaagttagcaaaatcctaaggagaactacttttttctgtaatatttcttgctcagctattgggccagggaagatgtagactttgggagtatttttagtttggagtatcaaaaccagatgttaaaacatgttcttcctcccccctccccccactgaattaatttcattattttatatctcactctaaaggaaagttttaaaattaaaagaatgagcagaagatgttttgggagagatttcaggtctaagaggaacatttccacaattagcacctttttttccccttactttcttcaagaaaccaatgcaaaatttatgagaactaaagtggaatacacattaattctatgatattgtatgactgcagagtcggaatcatgagtgaaaatgcttggaagggtcgtgttttagcttctttctctctttgctgcccaggctgtgcatatgtctatttcccagaatcccagttgagtcaccatggaagaaaatacaaggatggactgtatcagtctcaacaagtaaccaacataaccaaccgaatgagaaataagtaacaaagcatctacagaaaataacaaatcgcagtgccccgtatcaccaagagcatagtgtgttcaaaagaacctggatggtggaagccaagagacctagtactagtgagagctgtgtggtaactagctgtgtgacttcagatagtcatcttaggtctcttcatttcctcatctgtaaaacgagaagattccatgagagcatctccagattttttccatgtacacaatcctatacccacaagcacttccagatgagaaataactgtctttgcctttacaagcagcttgcctgttttgcacccaaaacatctctggtgaagaagtgatgaatttctgactcaaagccatttgcagccttgtccgttttgactttacgtaaaatctatctttctgagtcaaagcagcattctccctggacctgccatgtattcagtatgattgatgaattctggttttggtaattgtgcccggaagtagaaaagtagaataataataaggaagaggtgcatgtgtgtgtataggagagagagtgagtcattgctaaacacttcttttagtagttctggttctttgtggcacaagaaagcaagagggttgctcacgtataatggagactgtaatctaggtttaatgagaacgtggagttataaaaaagattagtgcagaaagaagaacagatggaaaggaattggaggaggcctgaagaccttgtaacccttggaaacttataaaagattctgaccccctaaactgtcgcatctgtggcccaccctccccagagatcaggtcagggcctcatcaagccacacatggggccactgtgggctcattacctccaacctacttctggcagccttctccccagtcacctaacagtagtaaccaggtctcagaaaaagggtgacttgatggactgtagtggaacttaaaacatttttaaacaaaaaaaaacccctttttctcctggctgcgaaaagacaaatgcgtatagcagtcaacggaagaaaaagaaaatatatggttttaagcaatcccttacacgtttggttgcgtagctcctccttaggaagactagcaaacacgttagtcctagctgacctcttaccttgaaaggcagagttagtatgtctcatcctcatttgaccactctgcaaatgcacaaacatttagccagaagctgaagtgattgttattctgacaagttcttcctcaatttagaagttctttaatggcagcaagccgtggacctgtgtctcaccctgtcctaccctgtttttctcttctttctgattttcattgtcctctcattcccacaactcctgtgcagttaatctgggctccccaaggagtcttccatacaattgggtattccagggcatgtgagatgaaccctggtgagagagttttcctttgcatgttggaaggaattactcgatctagaaataatgaagttacaagcattggagaatttcaggctgctgcctgcacgtctatcctatgagcattttagcaacatggccgaggtgcaaggctgtgcatgtcagataaacacagctgcatttatttctatgtttacacattcattataaacacacatagattttcctgccttctgtggaggggaaggcatggatgggtaagcagggaattggccctccatatagttctcatttgaatgtgtgcatgatgggggccatctttagtctggagtcactatgtagtgggtatgatttcatgactctgggaaggccccatgttcacccatcctaaatttgctggtagatgaccaagattccaccagtagagctttattcagaggataaaaccttcacactgctaaaatgtagctacccaactgtagactgatttcaggtttgcactgtgatgtcagacatgcataggatatcagcttgtgaaacagcaaaaagccattggttataaagactcttaactccctagcgcttggtttgggcatgttgggaagggaagagtgagcctgcagctgatgaagagaaaaaggccaagaaaagaataggctgggagcacaaagataatttacattttcaaggtgtgcctaccctaagacctccctcttatgtgattgttttcctgcttttgaaaggatttcagtaagaatgtgattgagtctcctatcagacatgggtatattaatggggtgtggcttttagattgctaacttgatctacatgttcagagttatagctctggataccaagtggaagctaaaaaaatgttagactttagcagaaaagataacccagccatggaaagaggagggtgggaatagagaattgtaagcacactggggagggtggaggtgagagcttgctgggggcctggccaggtaactgacccccttgatggaagaggtcaggtgcccagatgcacaatggcagaaagagctttcaagagcgtgacagaagggatcaggacaaaattctagaacaaaatgtctagaactagatagctaaagaggacataatactgaactgggaaggaaaggatggtgacaacatggtggattttaatccagttggtggaaggaccagccccccatcgactgactcaaatatgcctacaatatctatgcgtcctacttcatcaaatcatcattttcacattttctgaggcaggtctgatttcagacatttgaacccattcatggacaccacactgggattaggaaaacatcctttctgtgtccataaaagtgtcgtctgtcatgtgcttatgtaaagccctttataagcaaattaaacaggtgcatgccctccacctttctccctggacccatcctgttcttcctttcttgttcagtagctttgccatccatcttatcacttgagccagaaacctcagaaaagtctgtgttaactatggctgcacaacaaattacccccacacttagcagtttaaaagaacaaacatttattacctctcacagtttctgaggctcgggaatctaggagcagcttagccggtgtctcttgctcaaaatatcttgcaaggttacagtccagctgttggccggggctgcaggtgtctcaaggtgtgccaggagctggaaaatcctctttcagactcactcgcgtggctgttgcaggctttggttcctcactgactgttggccaaaggtctctgtttcttaccatgtgggtgcctccctaggctgcctgagtgacttcatgacactcatggcccagagtaaatgatgggagagagagtgagaaaagatagtctaagataaaaaccacagattttaaaatagtctcagaagtgacatgccgtcacctctgctgtatcctgttgcatccctgtcccaggtcaaacctttgcattatcacggcctgtatacttgtagaataagtgtactgcaactgcctgtttgctctacacaggtctgtttgggcacacagatctggtacagtatggaaggggactacacaacgatgtaaatattaggagtaaggggttgtaaatattggaggccagctcagcagctggctacttcacagaagtcttcctttccttctccctcttcttcagcacatcacttactaagtcctgattcttcctgcacagtatttctcagatttgacctcatctcaaatccgattgtttctttggggaagtggtatggaagctgatggaggcagccttgggggccacatacctaagggcacaagtggaatgtgtaataatatgctagcatggcctccaacccagccttatagagaggagaccaacatcttggtaagccagtcttttggggaggatttcttccctgtgcaggcaagggaagacccataacacagagttaccctatgcaaattaggtgcttattgaacagaacagacaatagaagtcactacctgctccccgcttcaccagcccaatacccatttcacccgtgactcagaagttgaggagcttccccacagtcatttggtaagttggcaacccaggtggtacaaaggtgtttagactttctgatctttccctgccccatgtcaaaccttcacattatcatggcatgtatacttgtaggataagcgtacagcaactgcctgtttgcgctgagatccattttctgctcttattgtgatcttctccaagtgacaaggaacttcatttcctaggctctcttgtcttctggcttcctgctaggtttggccagtgggggccactggtggaagatttgaaagcaggagctggctagaaatacgttacttctgtaacgtatttctcctcctcctgttttcctttggccccttcagtgtggttgagtctcctgtggtcccagctccccctggacagtccccactgtgactctggcttctgccagatgactcctgcctcataacccagtaatcacccagctcctccaatatgaggagtcacagctgattactgctgtggctaatccctgggttgtcttactgtcctctgattggtctctccgctcttctatcatttaaactcattcccgagtttaaattacctgtttgttaagacctagactggtttctcttttccatactagaccctgactgatggagttgaaccatctttctgtgttttctcgcacactgtgtgaacacaataaatgctcaattataatgatgttaatgaaaaaagaaaatgagtttatccaaaagaagtagtgctttgctctattcatttactttataagtcaagctgactaaaactacatatttgtcatttgtcataactgaaaaacagaaagtagaaacattctcctgagttttttatgaggagtcagtcttgttccttctactctggtgtcaagagtggaccctttgatcttgagaatctttatctttgtcaaccatgactttatcatgggacagatctttcttggtttgggtagggctgtactttctaatcgcagcagaatgagtcctaatgctgtgtcattggttttgcacatggtgacttggtaacgactctgcgcccttggctttcccatcacaagcctggttgttgtgacccacagtcctgttcatatgccagcccctgttcttggcctccacacaaggattcccacaagggttctatttgagatggtggcttccaagattgggggtatctgcctgccagccctggatttgagaccaccagcttgtttttccaagcattaatatctcagtgatctccaaacatattttcttttccagaatactttccaaaagatttgtaagaatgtctctaaaaattttcttttgaaggcaccagggcctgaggggagggggcaagggtaatataacttggccgattagtatttaaaactttatccaaaaaatatttttctccttaaataaaccaactctttttacatatttaagtaattcatctgagagaagtaaccactcagctattcacatagccagcccttggcagcttcagttcaaaatgctaggaaaccagtcaactacaaagtttcaaatgttttctttgaaagctcaacttaacctgcactaccatactggtgagaaaagtgacaactcattttaaagattcaccccctttctttctttgtctctcttctgcaggccatgtgtttatactgtgggatctcccataaacaacagggccctttttccatgccaggagccacccgttgccatgtcaacatggcaggctacagttcgagcagctgcatcttttgttgttttaatgagtggggaaaattctgccaaaccaacgcagctttgggaaggtactgtacatgtgttctttgcttatttatgtattgcacacatgtggacccaggaacccaataaacagtatttttctaaactttaaagagctcctttattagttgggttggaaatgatcatagtataaaacatcctgccagggaaaacaagcaggggatggggagggacacttaggagcctgggcatgggatttggggctcttcatactagagttgtcggttcatagactatttcagcagttgctttcacctggtggtttgtaggccataagtaggtggtcttgactgaagacgttctgaacaggcaggtgtaccatggaaacaccattagagttgagttgtctgtgatttgttatggtgtctgtacatggttattcattatgttaagagatagtgctcttgttggctggcccactggagttgtcttaatgaagcatcttttctacacatggtttgcctgtgtaaagttctgaaccaaaggtgtataagaaagatggaaggcagtgctaatgcatcatcaaggttttatctatgaattacttcttattgcagcatttaactttttcagtggagatcctgagcatgttgatgccaggaaaaaatttgtttatttgagagacagggtctcgctctgttgcccgggctggagtgcaatggcttgataacggctcaccgtggccttgacctgccagcctcaattgatcctcccacctcatcctgccaagtaggtggaactacaagtgcatgctaccacgcccagctaatttttgcactttttttgtagacatgagattttgccatgttgcccaggctggtcttgaatgcccaggttcaagtgatctgtctacctcagcctcccaaaggtgtgagccactgtgcctggccaggaaacatttttatagttatattatttctttatttaaaatatggcatctcctttgagaccatcctggctaacacggtgaaatctcgtctctactaaaaatacaaaaaattagccgggcgtgggggcggttgcctgtcgtcccagctactcgggaggctgaggcaggagaatggcgtgaacctgggagatggagcttgcagtgagctgagatggcgccactgcactccagcctgggcgacagagtgagactccatctcaaaaaaaaaaaaaaaaaaaaaagggcatctccttccacatatttattatagaaactttaaaatatacagaaaactaaaaataaattaaaaaaattatagagaaaattatcgctaagattttgttacatttcctttcagtatttaaaatctatatgttttgtgcagttatcatcctcaaattgtgatagcatatgatggtgtttattctgcctttttcacttatagtgtatcttgaacaatttacaggtcgttaaatatttttaatatgattttaacattggcacaatattttttatctgaatatatcagaatttaacatttctatattaaatattttgattatttcagtttttttcctgttataaataaagttgcattaaattccaggggagacattttatataaaattagaattactgagtcaaaagttggaacatgtttaaggttgttggtacatatcccataatgttttccagaaaggctgtgccaatttatacattcatctgtagttatgagggtccttgtcacctggaactttgctcatctgataggcagcagcaggtctctctttaattggattactttgatgattagtgagtttcacatgtccttatatgtttcttaaccattttcattttctgtttatttcctttgcccattttttatactgaagacctagatttttgccatttgtcttatttttcaattttattggctctttaaaaaaagatattaatttcttatatttatgaaaagcattgctcccagcttttggtatatcttttaattttatatgatgtgtctttttatgaagttaaatttattagatttctctaagattcattttgttctgatatttttatagtttaatttttataactctttaatcagtctgtaatttattctcatcaggttgtgaaatgaggactaaacattgtctttttttttcaaatagaaaaccagttgcttcaggatcatttattgaatttttaaattttgtgatgtctttatcataagctagattaacgtatgtactgaagtcaccgatgagtatttacttgatttttttttttttttgagacagagtcttgctctgtcgccaggctggagtgcaatggcgcgatctctgctcactgcaacctctgcctcccgggttcaggcgattctgtctcggcctccccagtagctgggactacaggcatacaccaccatgcccaactaatttttgtatttttagtagagacagggtttcaccatgttggccaggatggtcttgatctcttgacctcgtgatctgcccgcctaagcctcccaaagtgctgcaattacaggtgtgagccactgcgcccagccttacttgattcttaaaaacaacacatttaggctgggacagtggctcacgcctgtaatcccagcacttttggaggcccaggtgggcggatcatgatatcaggagatcgagaccattctggctaacacggtgaaaccccatctctactaaaaatataaacaaacaaacaaaaaattagtcaggcgtggtggcgggcgcctgtaatcccagctactcgggaggctgaggcgggagaatggtgtgaatccggggcttgcagtgagccgagatcacgccactgcactccagcctgggtgacagagtgagactccatctcaaaaataaataaataaataaataaaataaaatttttatatttaaaaataagtaacatttacgtggttcatttatagaagaacaaaggacaaagcattatgtgcaataacgtgtttttcttacctctatttcccagacatccagtaacacttccccaggcaaccaaggttaccaatttctcttgaataatatgttttttctcttttgttgtacaaattgtagcatgctagacacatttttgtattgtgctttcccttttagaataaatttattttatagatattttgtaacagagcgtaaagagtatcctcattatttatttattattattatttgttttttggagacggagtcttgctctgtcaccaggctggagtgcagtggcgtgatctcggctcactgcaacctctgctttccgggttcaagcatttctcctgcctcagcctcccgagtagctgggactacaggcgcacgccgccatgcctggctaatgttttgtattttagtagagatggggtttcactgtgttgcccaggctgggctcgaactcctgagctaaggcagtccactcgcctcggcctcccaaagtgctaagattacaggcatgagccactgcgcccgacctttcctcattatgttatggctatgagtatcctataaatggatgttttacaatttagttaaccaatatctctggaattcatatcaaataaggaattggatgggtatttactccattatccttccgcacccatattctccagttttacttaataaaacttgggatttgggactcacattttctctataactttttgtattatgtattttctaggaattactattattgtattttcattcagtttcaaatgatttcataataagtatttagactttcttcattcttgagctcttaagttggctgggaaatagcttcattttttttttttttttagaagactggatgaatggtacattttctgagccctcccatatttagattggctttttgttgtattcacttatgaacaatccttggctaggtataacattcttttttttaatatttttatttgtagcagccctattaactgaagtataacattcttgaaggaaaattttttaaaatgaatgattgacattcatttgaatgattgacagaaaactaatgttaaggctgggcggggtggctcacgcctgtaatcccagcacttcgggaggccgagggacggatcatgaggtcaggagattgagaccatcctggctaacacggtgaaacccagtctctactaaaaatacaaaaaattagccgggcgtggtggtgggtgcccgtagtcccagctactccggaggctgaggcaggagaatggcgtgaacccgggaggcggagcttgcagtgagctgagatcgtgccactgcactccagtctgggcgacagagcgagactccatctcaaaaaaaaaaaaaagaaaactaatgttaaaataacataatgtaaatctctactgctgaaattaggaacaaaaatgtcactatggaaaatcagtaggacgaagtgtaaataaaaatgaaaaggcaagccacatataccggatgtatttgtaatacatatatctggcaaaaggcttgtacctagaattatataatcttttttttttttttttttttttttttgagacagtgtctcattctattgtccaggctggagtacagtggcgcgatctcagctcactgcaacctctgcttcccgggctcaagcgattctctcaccgagcagctgggattacaggcatgcaccaccatgcccagctaatttttgtattcttagtagagacagggtttcaccatgtttaccaggctggtcttgaactcctgaccttcagtgatccacctgcctcggcctcccaaagtgctgggattacaggtgtgagccaccgtgcctggcctataaagtattcttataacctaataataaaacaataaaaaaccccacatgaaagaaaatgagcaaatgacatgaacagatgcttttcaaaagaagatataagaatgtgcaaagtaaatgaaaaggtgctcaacatcgtcatcagggaaatgcaaattaaaaccataatgagatagtattttacacctagttagagggctaaaattaaaaggacagaaaataccaagtgtttccaaggataagccacaactagaactctcatacattgctggtgagagtatgaaagaatgcaaccactttggaaatagtttggcagatactcacaaacttaaacatatatttacacgatctagcaattttactcttgagtatttacccaagagaaatgaaaacctacgtccacaaaacgattaatacctgattgttcacagcacattttccataatgaccaaaaacagtctaactgtagatggataaacaaattatggtttattcacacaatggaccactactgataaatcaaaaaaaaaaaaaatagctagtgacacctgcaacaatatggatgaatctcacaaacattatgctgagtaaaatagagtcacactgaatgaccctttttatatgaattttgagaagaagtcaaaccagtctgtactgatggaaaccagatcagtggttggctggaatggggttaggaagaaatgagtgcaagggtacagcggaatttctggggtaatggaaatgttcatgggggtaatgattatgtaagtgtgtttatctgtgaaatctcattgaacaacacatttaagatgtacacatttatggccaggcgtggtggctcacacctgtaatcccaacactttgagaggccaagatgggcggatcacttgaggccaggagttcaagaccagcctgggcaacatagtgaaaccccgtctctacaaaaatacaaaaaaattagctgggcgtggtggtacacggctgtaatcccatttactcaggaggctgaggcaagagaattgcttgaaccagggaggcagaggttgcagtgagctgagatcacaccactgcacttcagcgtgggtgacagaatgatactgtctaaaaaaaaaaaaaagtacacatttattgtatatgtgcggtggttaattttaggtgtcaacttgactggattaaaggggttggcagatacacgcagcttctttatctgggctctagtgtcttgctggcaattgtccagtcaggttctgctagactcacataggctttttctctgttgtctctgtttggttccctgacttgctgaattgattgagtatatgaaacactgcaatttcagataggcactgataggtggcctactcacatttctgcctatagcagtgtgcttgtgataactccacctcccaagatgccatgtggctctccccaccctcacctcaccaagcctacatattttctcattcatggtttggccctgcagtaaagccttgtgtttgacaatgtttcccaaacttgagcattattcttctttttagagggaaaggtctcatgatttaccacagttgacctaaattatttatattagaatgacatttcaaaaactatagatctaagactagatatgaactctgtgttcttacaactcttacacatccgtaaagccaaaataaaattataaatgaaatgcagatcaaactagcaaatcaataaaattcaaatttataatttataatttgaattttatattgatataaatatataaatataaattgaatataaatattaatattttgctgagatgaaattgccccttacaatatgaatatggtgctgacggctccatgcagtttcttttgagactgaacacctgttctaccctgagccacaaaataatccagttctccaccacttgtctttcatctccctgtaaacttttgtttacacagcatgctgtgatatcgtttggcctttactcagccaaaagcatcatccttatgttcttttctcattatctcttgataattatcgcagtcctacacgtccccatgcaatcatatacactaatacagatgggaactctgaaatcatttggcagtactcacatctggatgattttaggggtcagaaaactatggcctgctggctaaatctagtccactgcctgtttttgtaaataaagttttattggatcatggccattgtctttgactgccttcatgttacaacagcagagttgagtattggcaacaaggtcctgcaaagcctaaaatatttgttacctggtcttttacagaaaaaagttttctgacctctgtcatattcatctgtctgtctgttgttgtgtatctatttgaagattattatcaaaaaattgagaattaactttaaatatgaaaaacttttataaccccaggaatatatctgtggacctttttttttccccaaattccagttgaggacagagtaataaaatagatgcttattgagatttacttacgttcacaccacttacaccttatatgatatcacagaacaatctttgccagttcaagctgagggagaattaagctagacaagataaaagaactctatgcttaatactgcaattcctcccacagacagggtttatcagaggacaatcaggaaacagtactaataaagctgtttgccagaaccaaaatggctgttctgaggatggaataatgtctacaaatgtatctgcactccttagagaaaggggatgtggatacaagatgatgctatttcctttctaagtcatgttttctcgattggcagattggtctcataggacctctactctgttgtgcagaatgccctttaaaacgatgagctatctttgaaaacatgactggcaaagcgcgacccagcaagtcacagtttccatcacagtgacacataggcctgattagcacatttcccgggcaccagctgatttttccacagaagcaaggcacctgggagcagataacagcaacagaaatgacagcagcccttgggcagggaacagaaatcagaagacagatctctgggtccttgcttcataagggaaatcatttctcctaactgtttttaaaatgaagggtaatggtttggatgtagggtgatgaccattgtaagaattctattagctgagcagttgttattctttttttttttttaaagaaggctaagacaaggccatagatttagattaacttgcttggctcttttattattctcctttattattaaacttcctcagcataatgtgatttgggcagacagagatgttatcctgtggcttattgttggcctatattctctaccaaaatatagctaaactattgagcgcagagacccaatgcctaatacagtgccttgtatagaataagtgcccaatatgcatttgtggaataaatgtgttctttataatcaggcagaagtagtatgttcatggaagaaacatttaaaactactagtgatagtaacaaaatcgacttcagggtcatttcttttgcttttgttgcttaattacagtttatgccttttttccagcctcaataaattttaaaaagaattggtttagtacattattattttcttctagtaattttttgtttagttttttttttttttaattaattaatttttttgagacagagtctcattctgtcgcccaggctggagtgcagtggcacgatctccgctcactgcaagctctgcctcccaggtttacgccattctcctgcctcagcctcccgagtagctgggactacaggcacccgccaccacgcctggctaattttttgtatttttagcagagacggggtttcaccgtgttagccaggatggtctctatctcgtgatcttgtgatccgcccgccttggcctcccaaagtgctgggattataggcgtgaaagttttatttttatagagtctaatttagtatatccctgcttcctagaaaaataaaatactctgagggctgggtgccatggctcacacctgtaatcccagcactttgggaggccgaggcgggcggatcacgaggtcaggagatcgagaccatcctgcctaacacagtgaaatgccgtctctactaaaaatacaaaaaaaattagccgggcgtggtggcaggcgcgtgtaatcccagctacttgggctgaggcaggagaattgcttgaacccgggaggcggaggttgcagtgagccaagatcgtgccactgcactccagcctgggcgacagagtgagactccgtctcaaaaaaaaaagaaacaaaaaaagaaaaagaaaatactctgcttctgttttttgtgggaagcctcaagtaaatgaagaagactgcctaatggaagctccttccagatgaaggagaaaaagcatatgaacaagtgaaaggtgttaaaaactacatgtgcccttgcataggatctgatttcattttttagtgcaaaagtaagactgtagacattacttcattctgggcaaaatgctactctctggcctgcccaatagactagctctctgacattctctttcttttgactttgtgtgggaaattccaggaaaaagccaagatctgagagtccagaccctcctgtgtgcaactgaaagccaacttttcaaatgagcagtactatttagactgctcccatagtatgcaaccaggaattacgtatgaggaaatggtaaattaagaggcatttaggaatggttatgattaagtattttcctcacaaagaaagaatgcaaagtagagaaagctccttgtttctagaactagggaaactttattccacgccagtacacatacattcctatgtttttaagggtaaacgtattaatcttttcccattagaaagatgccggtgagccagtaatttctaaatctgtgtcagttaattcttttgttttgtgatttgttgttgactagttcttgcttaccctcctggcactgcgcttactgtacacgacatatgtgaaagtcatcatggtttctttcagacattgatgattctggcaggcatgtatataccagttctcattgctgtggatttttgtcttggacttgacattcatgaatgttccatgtgagtaaagcactcaagtttacctgtgaccacctggagcagtatgatttggtgtccagttagctgatccagcttaaggggaactgggtcacctgcattgaaggtcagagtggccggtgagacttgaataacaagcctggtggggcatattcctttaggtatcccgttagccaacaaggaaaacctatagaggcgcttgtgttcagcagatggcgctcttttacctagttcacaagaatgatcttgaaggtcattctctcttgcctctcctgtgcctgaggcggtaccatgttgcaggcaaggaaaaccgaagccttgctgggtagcatcagtgcttgcaaagtggtggcctgacctggcacattgccctggttaggcaatgctggtgcccagggcgtcttactgtctcgtttgttctggtgccagttacaacccttgagcaactgcggagaagaactaacaagagacagtcacgctatgggtattcacgagggtggcactcacttagaaaactggaaggtgtagacgcggcatctgcaaagtcctgacagaaagctagtttgctgaaagacccaagcagtggagaaggaggccaggaggggaagagcagccaaaatggggagctctctctccttttcgtgaatgtattatatttattgtacagatgtatgtatattatatatttaaaatatatgatatatacattctctatagtatgtctgtatacacttataagtgtacatgtttctgaatatacatattcctgtaaacattgttaggcatctttaatttgtgatacaaagatgttccaaagtaatcataacatatataatagtttggataggaattgctgaaataaggaattgtggttagagaaagaaacaattttgaggtagcaaagtagcaggggctactgaaggattgaggaaagaaagattatatgttaaataaaagcacgtatcaatttgatatttccgaatgcttcatgctgtttgtctaacctatagtggagaggttgaaaaagtaaaatggatggttttcataggaagaatttaagtgcctgttttaatttgcagtgaaaacaataactctttaatatgagaagttccatgagatgcttaacttggcagagctatgatctaacttagcctctgcacaagcagagtggttatgtgtgtgtggttatagctgtgcttttaattatattaagtgagtttatccaagactcacctactaataggacactgacttttcataaatttcttatttaatttactattggtaggcatgactgatgtgtaaaaatgactaccgtatcttgatttttcttctcttaaaattttttatgaaaaatgattatctcagctaagtttctcacaggtttagtataaaaagttctctctcctctcatgaactgactactccttcatgttcttcctttttccctcttcactgagaattattcttcctcctgtggaaaatagaatcttcaaaactattcacaggacagtttttagaagtcattgaaaaaataattaagataactgttttaacactctttagttatgatacttattttcaaaattaaattttatttatttttatttttattttggagatggagtttcactctgtcgcccaggctggagtacagtggtgcaatcttggcccactgcaacctctgcctcttgggttcaagtgattctcctgcttcagcctcctgagtagctaggattacaggtgcccaccaccacgcctggctaatttttgtatttttagtagagtcagggtttcacccatgttggccaggctggtcttgaactctggacctcaggtgatcctctcgccttggcctcccaaagtgctgggattaccggcgtgagtcactgtgcctggcccagaactatattttattttattttattttattttgagacggagtttagctcttgttgcccaggctgaagtgcaatggcacgatctcagcacactgcaaactccgcctcccggggttcaagtgattctccagcctcagcctcctgagtagctgggattacaggcatgtgccactatgcccggctaattttgtagttttagtagagatgaggtttccgctatgttggccaggctggtctcaaactcccgatctcaggtgatccacccgcctcggcctcccaaagtgctgggattataggcgtgagccactgcgcccggcccaaaaactaaattttaaactgcctcttgtgatttgaaaattgatccatttcaagttctgttatagctgcaaaaagcacagtcatctaaggaaaatttcagtcctgttgtggagatgaaaatgtctatttgggtcttgtaacagctgttattgtcaatacgtcatacgatacatgtatcttactagtgagacaactgaagtatgagagtttttccccctaaatacagtccaataggagaaagtgatgtaggggcgttagagaactctggtctctttctgaggaggtcagaagtccagctttacagaatctgcccagaaagaagggcaagctgggtggcggcttgtgcctgaagttaaggagtgctgtttcctctgcatcccttcctaccaaccctctctgttagtcttgctaatgaatcccgacctggctgtgaaatcatccagtggtgtgaggggtttctggcctctgcagaggaaaaactctgggttaattcaagtacagtgtgttctctttgttttgcagctggtgtagcaaagggagtctagtgcaagtggattgaatcaaaaggaaaatgaaggcattcactgtctgtttcatcaaggatggctcatttaaagtaaacaccatttaaatagtctccaaatggcccattctatatgaagtcatacaggatgccccctttaggctgtcattctcctttaaatggatcgctttgtgtggactgtgttttaatgccattcaaccttgaactccatatgtgggcctcatcaggtcgcggttttcagtacacatgtggcagccataccttcagcattctttgcctttgccttcagaaaattagcctgagtgagcatcaagggtagacagctgtaaagatgagagcttgcagatgaagactacaacaacaacagatgatgacagcacctaatgtttcttgaacacttactttgtgccaattattatgcctagtgatcactctatagattatctaatttaatcctaacttaatcctcacagcaagatactatgataattctcttgttatacatgaggaaactgatgcattagagaaattaagtgatgtgcccaaactggtaaatgcagagcagggaattgaaccctagctgtcagattccagaggtggaactcaatgaatggacatatccaaaagcaataaactctcattaattctcttgcaaggtaggcttattccaaacaatagacaatcctgaaattatttatctttgttttgggaatgcatgctctgctttctggggcagtatttccaccttattctttgcaatttttgtaggctgattggaagataaggttaggtgttgttccctgtggcagtgggcagtcttcatgtaagattgggctcattggaataatccatgaagagacaactcaaaagagacttttctatcaaatgaggatactagaaacatcctcatagcagggaactaatgaaaatcttctccagagcactagcagcgctccatgatctcagcgctggctccagcattcaaccaggatccaggcaagaagcccagggccagactctagtgagaagcttctgagaagagtttgacaaggaattgggtttctggctggttcttatttggcccagccaattgatctgccccgatttgactgtcacttggtagccaagaaacctttttgcttttaaaagcttgaagtctgaaacagttgattccaaatgagctctactaagtagaggaactttaggaatctaagaaaataaaaaaaaacttgcgcgctgtataggaggaaatcatcttgagcacttaaagtatgaatttgtgtgatatttaaaaaccaattattttatttccattattgaacttcagagaagactgtgaggaaacaatgacagttttaacatatttttattggactcacctcaggttctgttaccactattgctatctcactctcaaactctgggtcatttacggtttctgactttttaattgctaatctccatttctctcccctgccacatcctgctgtgacttccggtgtcttccccatgtcaccttgagagtgcagacatgctgatgaaggtgctgggttgtgatgggattgggcgctctacgtggatttctattgaccttgtgcagggatctaacaaatacctctactccattagcagtgttttctcttggaagtaagtttcagtttctgctgtttccacaagtatcatcttgcccatggactacgtggatggtacaagaaccagacaggcagcaagaaaatcaggtcaaaaattcaacgcaaatgtagggagaaagcctgttgtgcgtagtgcttcattcttaaaaggatttcttaataggctagtgcctgctccttatctctaaattgcttctttcttctgagttatatttcatcattttaatagtaccttggtaccagacgtgttattctttttctgttaagattaccttttaattaattgattagttcaattattttacattaaatatgcaatatttaaagagtcaagtaattctgatgggtttattatacccgttttcccaagcagcagtcctttgtaatctctcttcctccatttttcctgctttttagaagtaaccacttttacctctttcggctgattacttgatatttacctgcatgtccttcagtaagatgctttattgttcagggttgttcttcccactatggcaggtaagtaatttagctgtcctcctccctccccaaactccatcatacacaagcccccttcctaaaatcctgtcttctcaatgtaattaatatcataatgttgattagatcagtattcttcatttatattattattatttttgacatagggtcttcctctgtcgcccaggctggagtgtagtggtgtgatcacagctctactgcagcctgacctcctgggcccaagtgatcctcctacctcagcctcccaagtacgtgggatcacaggcaggcaccaccaatgcacctggctaataaaaaaaaatttttttttgtagagatgggatccccctgtgttgcccaggctggtcttgaactattggtctcatgtgatccttttacctaggcctcccaaagtgctaggatcacaccacatccggccttcatttatatcattatatttttgtgtgttattaagagctaagccttgtagcaaaactgtgacttattatttctgtacatgttaatttttttcttggttggaattaataattgtcttatgctttgttttttttttttcccatttgcttgtccttttggatcttgattttctaatagaggctttctagggatggctggaagcttgcatgcaagcattcaggagcaggggactgaaatatgaattggaagctgtgaatacatttggagggcttgtcaaccatcagcttcaccatagactgatttcttaagctaatccccttctttcagtctcttgcctagacagtgaaagcctggctgtcagccttctggaaccaaataagggaggatggctggtggcctcagcatcctatgtgcatgtattcatctaattccattcacttgccttcaactgtgccatttctcctccagcaccacagctgccagttcagaggccctccctttagtctttctagaaaataaacttccagttatttgttgggatatgtgtgggatgggcaaatagcccaggtgtgcagggctggggagaccatctgtggatctgaccacttcttagatgtgcagctgggcctgcttagtttagcatttcctctaccctagagccttttggagcttctaaggggtaaaatgaggtgggtcttatctttccctactgccaacttaggattcaggtctggattcaggtctgctgtgtcatttgccactctgccatctgcattctagcttccagtattctgcaggaattgtctcctgctttattctctctctccttgttggttcatgtctttagaaaagaagttcttttactgttcctgaatagagtctggggaggaagcaaaggtggcctcggcctcatacagttaaacctctctttttacctgaaagcctcaccattgctgcttatttactgagctgccaagggtctgaatttttaaaaaggaaattctaatggttcttggtaaactctaaaatgtacttcagagaaggaatgacagaccacagccctttgattaagaaaatgtgttttttttaggattttttttttaaaccagaggctttcaaaagatttagttccttacccataacttcttgcttcttcttccatctgcacgctcctttctgcctgcttcagctctcattatgtttccagtagaaaatgaaagtttttatggagcagtcatgggagacattgggttccaggtaatgtaggtagttacggaaagacagaaaaatgggagaggtggagtccctatagcccatcatgtcatatccatgtcattctttcatcaagacgtctgtgactgtccctacctccttctactggcttggaatcagagcagtgattctctttgaggctgtggttttgcttcatgcccagtagaagctgtcactggattggcttcagtgtctctggatttgattgtccctttaaggaggagtatgccttcaacttgttcttttttttttttagacggagtctcgctctgtggcccaggcgggagtgcagtggcgcaatctcggctcactgcaagctccgcctcccgggttcacgccattctcctgcttcagcctcccgagtagctgggactacaggcgcccaccatcacgcccggctaattttttttgtatttttagtagagacggggtttcaccgtgttagccaggatggtctcgatctcctgacctcgtgatccgcccgcctcggcctcccaaagtgctgggattacaagcgtgagccaccgcgcccggccaacttgttctttttgttggagaccgagtctcacccaggctggagtgcaattgtgcgatctcggctcactgcaacctctgcctcccaggttcaagctattctcctgcctcagcctcccgagtagctgggattacaggcacgtgccatcacacctggctaatttttgtgtttttagtagagatggggtttcaccatattgcccaggctggtctcgaactcctgacctcaagtgatccgcctgcctctgcctcccaaagtgctggaattacagccaccactcccggcctaccttcaacttcttagctacaaagagagggatctcaagagtggcccttctggttccagaagcagggtgcagcttccaggcaagttggagagaatggctggctctggtgggtttccagcagttctgagcacatcttttgtctctctctttcaagtaactctcttcatggcttccagacttgaatctcaccgaaatattatttattttttactaagtcctaccttcctgagttcagaatttgttttgagatagacaaaggaaccatgcacgtggagatcaaaatctaatctctattattggtttttagtggtaaagcactttaaaaaatgtcatgttaggtctgctggccagtaggggcatgttaatatttcagctctgaatttgacatccaatcaccgaccaaattggacaaccacaggccaatttggtcagtgattggatgtcaaatgtgtttaaccctctaaaacttaaagcaagagaaggaataatagctcctgtaaaggagtttgtgaagggactgaaagagagatttacgctaacagaagttcctccctatgggaacatgaggagtggagaaatgtgttccataatataaagtgatatcccatagcaaagacattgaatcaacttaaatgcccatcgatgttagactgaataaagaaaatgtagcacatatataccatagaatactatgcagtcataaaaaagaatgagataatgtcctttgcagcaacatggatggggctggaggtcattatcctaagtgaactaacacagcatcagaaaaccaaatactgcatgttcttacttataagtgggaggtgaacactgagtacacatggatacaaagaagggaacaacagacaccagggcctgcttgagggtggagggtgggaggagggtgaggacagaaaaactacctatcaggctgggcacagtagctcaagcctgtaattccagcacttcaggaggccaaggtgggaggactgcttgagcccaggagttcaagactagcctgagcaacatagtgagaacctgtctctcaaaaaaaaaaaaaatgtaagctgtgtgtggtggcacatacctgtagtcccagctactttggaaggtgaggtgggagaatcacttgagacattggatattgggtatacaagaggttgagctgcagtgaactgtgatcacgccactgcattccaacctgggcaacagagcgcgaccctgtctcaaaaaagaaaaactacctatcgggtactatgcttattacctgggtaacaaaataatctatacactaaacctacccctaccctgcctcatgatgcagtttatccaagtttgttatacaaacttgcacctgaacctaaaataaaagttaaaaaaaaagatgatataaattctgcttaagacacacgattaatgtatagcagatgctcggaaaatataccattgttaaatcaggttgtatgacacattcagatttcagaaacatgaaaattatttttacatctcagaaatgaggggagtatagtgttacaaattatcagccattcattcctttgataaaaagcctctaaggtttggaccaagtggagagtacaccctcaactggaatggggagccccagctctaatcctggtcctgttacaaactagttaggagtccttggctccgttaaacctctacacgtgcttttcatctgctcagcaaggagtggaagaccagctaaacagataacagggactaagggtaagacctgaactcccacagctaattaatttcagagttgggatgaaaacccaagtgtctcccttccctagtctcatgtgttttctactatattcattttatattgccttgaattgaatttggacaagatagttacagcacaaagcaatcactgctttgctcactctttcactcattcaacaggtatcaattgagcattttttttaatgctaaatactgtgttggatgaatgagacgtattctgtctctgtaggagcatacagcctgtggccttctgtgtttacagctgtgagggaccccctgcactaccaccctcacgtgaagggcttcaaactgatccgtggaagagacccagaccttcctggttgccttgaagccatcatccctcctgtgctttccctgagccctgaaatgtgccctttctgctgacgtgaccgacctccaagagttggctcttaccagcttatcacaaaagctcttcaagtgcctcgagaagaaattatacagcagagcccaggatcatatattggcctcattatggtttttctcttcctgtttacagagtgctcaagctggtattactatgtaactatgccaatgccagcctccaccttcacaattgcagtgggatgctggacagaaatgaagatggagacatggtcatcaaatgatttggcaacagagagacccttctcaccttctgaggccaacttcaggtttgtgtttggggacttgctgggaaggaaaaaaaaaaaaacacttgagggagcggtatgatgcatttcttccaagcactgggaatgtgagtcattcctgctgagaaactaaaccaaaataggattaatcaaagcaggaaaagccctattagaaaggaaagagagggctaggcgcagtggctcacgcctgtaatcccaacactttgggaggccgaggcgggtggatcacgaggtcaagagactgagaccatcctgaccaacatggtgaaacccccgtctctactaaaaatacaaaaaaattagccgggcgtcccagcgactcgggaggctgaggcaggagaatggcttgaacccgggaggcagaggttgcggtgagctgagattgcgccactgcactccaccctggtgacagagtaagactctgtctcaaaacaaaaaacaaaacaaaacaaaacaaaacaaagaagaaaggaaagagaggctgggcgtggtggctcaggcctgtaatcccagcactttgggaggctgaggcgggtcgatcacgaggtcaggagttgaggccagcctggccaacatggtgaaaccccatctctactaaaaatacagaaattagctgggcatggtggcggatgcctgtaatcccagctacttgggaggctgaggcaggagaattgcttgaacctgggaggtagaggttgcagtgagccaagattgcgccaccgcactccagcctggcgacagagcaagactctgtcttggaaaaaaaaaaaaaggaaaaaagaaaggaaagcgagttgagaagaagagatgtgagcctattatttatgcagaaagagagaagaaggtaagtatatatgaaatcatgtgaagtctgctgaaatatttatatgtgtttggctaaattcaaggaatcctcagattcaatgcctcctctcctcccataccttttaagtttggttttcagtgcttatgtggtcaaaaacatagcttctgatggattactttctatgctactctgctgttttggttgtaccaactgctgttagcggtgcactgtagggacagcatctccctcagtggggctagtcgccgctttaggagcacaggacacaaggaaactgatgcaaagcccttgggttaagggaatcctgcttggtcagggctttgttaacatcagtagtgatttctttcttttttgaagtatgaaccagataaaatcattttgaggctttaaaaaattactataggccattggatatttactggcagcctgtctagatgttcaatggtttctagctttgagagccaaaagagggagaagggggacgctgagaaggtgcacagcacatgcatcatgctgcactcccaggattttatacccggctcaattgtgtcatttttcctattgacagacagtcactaagtcagtaccttctggtggagaaagcccagggtaatggtagagatgattagttactccttgaaaaccagctaaggtatactcctaatgcagattccttttgtgttggttttattttgtcatgctgcttttactagtaccacagtaactgtggcagttggtcttcatctttcagagatgaagctatgttctctctcttctgatgggcatgtattattgcctgcatttttccttttttggcagaagggaggtaatttccacttcctgttcagtagcttgcctattttggactgtctttcctgagctatatgaacatcctagattgcgtattagattttacttctgtattcttgagggaagaagggaattgtgggcagaagtgacatattctagtttcatgtgggaactttaattgcatgtgagatcctcctgtgctctctttcctgcagtacaaaacagagcctacaaaacagaggaggctttgttttgtaatttcaggtggtctgaatttctgagtgaggatgacaggtggtctggagagtcacttagatctacagtggacttggtattagcaagaagcacactgttttgtgttaagccactgaaacaccagggttgtttgttactgcagcatatcctagcctatcctgaattgatacagtagccattagttgttccaagtcagaaactaagtcttgatctaaatataatctcatttagtcctaaggataagcctgcaaaacagattggatagattattattcccattttatagataaggatattgaagctcagcaacttgttaacattaatgtccctactaagtagcaatacctggatttatatccaggcctgaccccagagagaggtgagtcagaatcttacctggagactttaaaaaactgtatgtaacattaatgcctcacctggagtctgatccaccttcccatctggagagtcactgccatgatttgagccaccattattgactggagtgtgttgtgttggaacagaaaacagaagttgagagcaatgcctttgagcctgaaagtgccattcttggtggttggatatacctctttggacaaagccacactttccttatctgtagaatgaaggctttgtccatgggttctcaaattcttgatggtgaagaagtactcttctctttttcatctaaggcctcagcattgattgattgttagaggagctgtgcagttggaaaatgtgtgcctttggaaggctaggggaaggcaaagacagacatttgttattttgcctttctagccatattccaaagagatgtggggttgaggagtgggcagcagccactgactctgtgctctctccttcctgctcagaagcaacttaaatggcttctcagttttcttgcatccactattctgaaaggaggaagaaatggttaaatcaaatgaagattctgggaagagatgatgtctaaaattcctgtcgggctttaggggaagaagcaagtacaactcctctcttgtcctcctaaattcaccagttgaggaacagacagaggagataaaaataaaggttttattattgacagaagctggactgaaggaatactcaggtgcatggtctcagtggggtttctgagactccatttccaaatgagacaaatttacccacccagttaccagcccagctggactgctgctgtcctctataacacagatgtagagtccacctgacacatggcaggggcaggcccaaagtgcaccctctgtgtgcaagcagattcaaaagagaaagcctggaatggcccagccagtcaggtaagctggggagaggtccgggtgccactctagggaagcgcgtctttccatggaactgtgaggactggtgaatggggttcctcccatgcccccttccatgtccaataaactgtgactgagttttcccttcctttatcaatatgcttgtccttcaggaatatgctgctgataaaatcatagcttgcatttgcttagttctgccctggctgtgcacttcatgtgtgctgtctttagctgtcagaaagtggctttgttttcatccattacatgtctgactgcatgcaaagtttgccagcaaaggtgctctgaagtgccagtcacagtggtgtttttggttatgttcacatctggtcccttttgccttccccagcacccgttctacttcaaaccttcctaagaccaccaatcaaattcatgtaaatccaactttcacaggggcctgctataccacaggttttcatttgcctaaagtgctcatctgggttccagaaatttggccaaagtgttggtcactgaacttttatgatcagtgttcatgtgggtaaaattatagtaagaacattccctcttccagctccactttcacacatgctccagccactctgggtgagcattttagtaaatacattgattataaggctctcagataagctgttgaaagtttattaattttattcagctgtagtataaccttcagccacaggggaatctttgtgttatgtttctttaacctcttgaggcctttgtgggggccatacagtttaaacacgacacagaaacttggataaagtccaaaggaacttagcaaaaatgattaaaggcatggaaaatgggcactacaaagaagaaaacacattgagactgattatttgaaagaagaatctggtggggaacaggtcttctttagagttgtaaagtatatgaaaagttgctttgataggaagtacagcatctttgagtcggtgctgaatctatggaagactattactttgtaaaaagcacagaattggccaggcgcggtggctcacgccattaatcccagcaatttgggaggccaaggcgggcggatcacgaggtcgggagatcgagaccatcctgaccaacatggtgaaaccccgtctctactaaaaatacaaaaattagttgggtgtggtgacgtgtgcctgtaatcctagcttacaggaggctggggcaggagaattgcttgaaccagggagtcggaggttgcagtgagccgagattgcaccactgcacttcagcctggcaatagagcaagactccgtctcaaaaaaaaaaaaaaaagtacagaatcccctgacctcttcagaaacaaggcgattctatgaagaatggcttatgtgctgagttatcatagaatcatagtgccagaagaaaccttagaaaagattttcatttgtttatattttaagtataattaacatacaacaaaacgtgcagatcttaagtgttcagcttgatgagtttatgatgattgtatacagcctaaacctgatagagaacattcagtctccacagtaagttagtaaattctctcataccttttttttttttttttttgagacagagtcatgctttgttgcccaggctggagtgcagtggtgcgatcttagctcactgcaactctgcctcccaggttcaagtgattctcctgcctcagtctcccaagtagctgggattacaggcatgcaccaccacactcggctaatttttttgtatttttagtagagatgggttttaccgtgttggctaggctggtctcaaactcctgacctcaagtgatccacctaccttagcctcccaaagtgctgggattacaggcatgagccaccatgtctggcctctcatatccttttctaaccaattccttacctcctccagcagccactttggtgagactatgttaaagatggggaaaaagaagccccagatactgagttgcctgccttggtcacaagtgagccagtctgagaagacagtgaagcccaggtttcctgatccctatgtgggaacgcagaagtggctttcctgatgccatttctgtgtccatttctatgggagccttacccttctcacctggtcagagcttgattgccttaaagtcctgcattttttcccaggctttgattacaatggtactaattcacacaactagaatcatcttcatcatctgagctagtgccttttatgcccagagagattctaacttgccttgttcctgattggaaaaggatatgagagaacttaccgtggagtcagaatgttgtctatcaggtttaggttgtatacgatcaccagaaattcatccggccaaacacttttgggtgtatctttggctacctcagtattctctaactttagggttcttggcagcaggaaataatcttttcccatgttatatttagagagaccattagaatgacctttttgcaaaattgtgctgtggtagatataatttaagcttatgcctcagctttgtccagaagatgcctgcacactccagtttctctgtggtttaacacgatctgaaagctttgcaatagagattatatgaactgaaattactgtagcacattatatacctgtgtaaatacatgagaaaaagatactgtggtggttaatttaatcagtggcctttttcactttgcgagacctttgaccacattcatgcacaagcacagtacttgtcattaggtgggcattgcagcctttttagttaaatgttcaccaacaggcaccttgactcactctctccacaaagcaaggttatcaatccagggactttggccagaattaaatgtcaagaattatattcttcatgtcatcttattctgacaagtttttatgggcctccatccattttcttactctccgttgtggtgaaatgccttcagtgctggaagctgtgttctatgaaccatgctgctagaaggtgaggcttatctgtacctagccatattggtctcctgagcgctggccttgggtaagtgaaaggtacttcttacatttggagaggaattattgttgcattctgcccatattgggacatgccagcatcttaagatttttcattattcactgtgaatcaagtgagcacctgtagttataattggctgggtgcagtggctcatgcctatgattccagccctttgggaggctgaggcaggaggatcatttgaagccagaagtttgagaccactctgggttacaaagtgagaccccatctccagaccccatctcttaaaaaaaaaaaaaaaaggctggatgtggcatggcaacatgcctgtagtcctagctactcaggaggctgaggtaggaggattgcttgagcccaggacttggaggctacagtgagctatgaccctgccactgcagtccagcctgggcaacagagtgaaatcctgtcttaaataataataggccggttgcggtggttcaagcctgtactcctagctgttttggaggctgaggcgggtggatcacttgaggtcaggagtttgagaccagcctggccaacatggtaaaaccccgtctctactaaaaatacaaaattagccaggcgtggtggcacacacgtgtaatcccagctactcaggaggctgagtcaagagaatcacttgaacctgggaggtggaagttgcagtgagcttaaatcatgccactgccctctagcttggaagacagagctagattccatctcaaaaaaaaaaaaaataatgaaataaataatgattagaggggtttttcattgtgtttgaataaaagacatgttagcaggtgaaaaaatggagtactgttggatgtaggtttgagtagataagttctcttgagtcctgtgagtcaggttctaggaattctctttcagttccgcctttgatggaataactggcagtggtcggatgaagcaggctggggtctgatctgtttccttaaaaggctggctcagttaaatttgttctgaaagtgggttgggaaaaatactgtatcaaaagtgcctctgtattccttaataacagcttttgatgggctgtgtaaagaacatttagattactattcagtaaaatggtttgtgttctttcgaggagtttgagcctgtaactttcatttggttcatggttctccctcagtccaagtcttttattctaggtaatcccagaattggatctttaatttgtgtgtactgctccttcctttctgagttatgaattgtctctaatttggagattgttcatatggtgatacttgaaaacatctaaccgagggcaggaattgtttgtattttggtgagaagttttattgtttggagtctttagaggtccccccacaacaaagtttattctaaaacaagattttactgctttctcttatcttagattgaagctagtctattgattcaaacacatgaatacgtttttgtcctgtaaattttcactgctgcacagagccagtcaagccaagaattgaaatgagcagtctttgcttgtgagtctgtctgaacctctgtctcctaaaagttgtctacatctgcaagattgcctcacctccacagcaagaataataaacatgttttaccatttattttgtgttattcccaggcatgttggtgtttgcagtcacatggaatacccctgccgcttccagaatgcttctgccaccacccaggagatcattcctcatcgggtctttgcccctgtgtgcctcacgggtgcctgccaagagacccttctgcggctgatccctccttgcctctcagcagcacattctgttctgggagcacacccgttctctcggctggatgttctcatcgtccctgccaactttccaagtctggggatggccaggtatgttgttccattgtggcacttggggtacatacattttggaaattctttgactatgtcttgctttccttgagctctgtcagagcagtcatttgattagaatggaggggctatggttgctcatgcttggacatctcattgctgccttgagggacaattttaatgcagactccctcatgcacgagcctttgagtgtcatgggctcagttcagactgtgttgaaaagaaaaggctcacattgttgctgggattgagaatacatagtgccccctgagtggtgactgttggatcatggctgatcagtggctgttagcttggatgatgacagcataatgctaatgagccaaaggttatagcatcaggctctgggcacagtaacatgacttggtcccaaggccacaggctactcacctaatcctgaccagctgtcttgtccattctcaccactggtcacaagggcaatgacttgagagaccctgagtcagatagactgtggatggatcagtgtaaatctatccctactgctagaaaaacagctcaaagcagatggcttactgtgggggttggaggaggagtcacgtgctactattttttaacaaatgcacttttgctgttgtgtcctggtttggttccctgtatttatttaagctaaaatctattaattaatgccattgttcagtcattaatgggtatctgtgttccactgagaaaagatagagaatgtacttggttatatttccattttaaaatcttaatcattagcagtgaatatgcttgactaaggatgggaaaaataagctcatcaaaacatgtgacttcaagtttttccctattagtcaaggaaattcctgctgccaattaattcccatgcttttgagcagctgtcatttgtggtgttttccctgaaaactgcacacattcttagtaaaaccatgagcagaaaagaactgaccagaacatttgcttttgatctttactacatgtatgtactttaaagactggctggcttgccttaatccttgaggaggtctgagaaagtcatttagactgatttttatcctatgtttatgaagataatgggaatgcaggaactaggataattatatatatttggttacgtgcatcatataattgtcttggatgtctatatatagaatttttcttaatggaggggggggcttcttttgtccctttgaagagtctgctggccttaatttaagtagtagaggtgttggtgaaaaaagagttgttcattaaatgtttcttatttgtacatgggtttgaggggccctatttacttgggagtttttagcacttcatgagaattgcagttttttaaggcatgtttgctagcagttccaagttctggcctgagggaaccaaaggcagagtatttttcatgcacaggattctgttttctatagctccttcctgacatcagtctgccaaatacagaatgagttgacctgcaggcaattctctaaagcttctcttttcaagtttgcatgcccaagcaggtaggctgtgtgtttgctgctttttgcgatatttgaagtgatttaaacatgcttaactctgtatttttagagtggcaagcctgagtaccataagaccaaatggtcctgggcacaaattttgaaaaatatggtggtgatcataacttagcaacaacaagactgcttttatgcttaaaagcaggagaaccgtatattcaaaatttgtggttggttgtcaaataccatttttttcccttccttttagactgtggaagtaaagtctgcccaggtctagatgtttttctggacttattaccattccctggatgagagctgtggaagggggattgtggtctcttccactgccaggtggggtggggaagggaggtgctctgtttttccaaactctggcttcaattgattctgcttgcttggcttgactctgtcgggatcccaacaccttgggctacatgcagctgagtggggtttatgactcagctggctactggggccctgctgctttatttatggtcgagactttgcttgaggttttataaagcaaagctagaacaaaaacgatggttttgtaagtcaacttcataccctaaacaggaatagagaaacctcaaggctaggaggagtcatccaaaaagacctccatactgaaacctgccattgtcttcttagttataatatgctgagagatcaaaggacttcttggtaaattaaatggctctttcccgagtccatattttataaacatgtatgcaagatcgtaaattccatacctctggacttctttagtgattaggtcttaattataatgaataccattttataccatttcagtattcttttttggcaaatgatattaaacattccctcatgaactaaaatgggtaaattattaatcatgttaagcagtttctgagaattttagataatataatgatttcactattttgaatattacgtatcatagtttttattgaataagcttaaaagtctcctctttgattctgtttttgagctggattctgatatttcagtgaagtgaggaaaaacacatttataaaacttgaatgtatgataatgacaaatcagtttataagaaggtaaataatacacaaataatattttagaatttcgaatgcttttcaaacatggcagtaactagaacatttatcaatactgctcttcatgatttttgtcaccttttaatataacaggagccattactaactgaccccctcccctaccctggtccttttccaaatcactgttccaggggagagggactttaattctttgctgagaaaaatcactagtttgcctttcagatgctttcctcagtgggtgtgtgtgggctttcagtttttgtttcattgtgtttttgccttccatgaagactgaatctgccatatcaggaaccgtaaagtatacatttcttgacttgactactatgatgtctgtatgaagatatgcatgcatttaaaatgcatctctgaagtacacacagctctcttcctgttggtttaattaatattctactgttttcattgtgtcctcgtatgttctcagagtctctgctggggattgactggcaagcctagtttcttaattttgagaaataatgaaaggagctcatcatcacacttacactctctgttataacagcagtaacgttaatggaatcatattctagaaccaggcatatgacagttgcttaaaaattaacaccttaatcttacctttgtatgtgtgtataggaaatgctttgctttgcatttgtctctcagcagttcacaattacatgtcatggcatagttaggttggcagaactacctagctgtcgtccatatatgttcttttttttccttgtatttgaatttcaagaatctcttgcaacttatttcagagtggttttctgtgaagagcactgaagttaaaaaaccatgtgctgtgtagttctgcttcatggctcagctgttcacatgcatcttcacccttcatcccactgggaaaattgaggggaaaaaaatgactatagtgtggccgatgacaggtgacagattgtttgagcttttccccacctgttctataccagataatcttgataatttggttattgtttatttattcttgcaataaatatttatcaagcgtatactgtgtgccagatagtacttacgatgcaaagcctacaagggtgaacgagatagaggaggcctctgtccttatgaaatggacattctagtcaggggagaaaattagtgtacgtgaaacaagtaattaagatgtatgctatgaagaaaataaaatcaagtaagtgtcacagtgggagaatcaatagcatcgttagggtgagagggaaaagcttccttaaagggtgacatttgggctaagactgaagaataaaaaggaatcagctttgtgaccatctggtggaaaagcactccggtccacaggcctcaaggtgggaaccactctcatgggttggaggagtagaatgaaggccaggatggtggcaggtcagtgaggtcttaaaatggctttccttagccccgttcttagtgagcttgggtgccaggagcaagtgagtcactaagaaatggcaagattaagtcaggtccatcattctaggcagacgggttatgggaagagatcaaatttttttttttttttcttgggaccgtagatacctataccatctcccgactggctaatgagaacctgattggcttagcagctgctgttcttgagcagaattctccatggctgaagctatcagaacacctggcacccagacgggcaaccgtccctttgtagagaagggagaagtctcagatcaccacgttttcttcccctggcagctgttgattgattctttgcaagggtttttgacatcgttggtcacagagagggaagctgtgtctcatcctagttttatttgctcatcctagtttgaaaggttttttgttttttgttttttgtttttttttttaaaaaaagcaacaacaactgaatgaaaataggattgacaattaaagaccatagaaaaaattatcaattattaaaatcttcacaacatgcttcactatgaggaaaaactataaagctccctattacacaaggcttattcttaaaaggtttgattgtgcaataaaagacttctgaatgtttatactagttcctgactattgcatgcacaattttcttaagtacctcaatttgcaaataaacggtatgcacgtacatgcccaagaatgaatgtaaccagccttttcctccactccctcctcccgggttagacagggtgttgtcctgtttattcttatctcccagccaatgtgtaatagaataagcaaaacataacatgctggtacaaagggcctgttgttttcagctttctaattatgctcctttctgctggggaaggaagcagtcataaatttctgtcattatcttaagtagcaaggtttcacagctttgagaatttttctttgtttgttctttgttggctttacttgaatttttgatccctcaaaccaaaaccaccctacttttaaacaatccttctttagatttcaggggatgtgaccccctgatttcaaggcaagatgcagccatagtgattctttgcctcaggaatcagattttgagccttaaattagtatgcctttgaattcaccatggctgccaacttctctactttctccgatgtgctgcatatttttgttttgtgtgtgggttttgtttcttgttattgttgtcgtttctttctcagattttaataaattctcaattttctttctgcatggattgttttttaaaaagatgttgaatgggcatttctttcccctgttgtgtggtataactcttctctgctttttcaaacaggtgggtgtgaatgatagaaagcagctcataccatcctttttttctgtaaaattttaatcccttgtttactggcaaccctgctgttgctgtagagatgaacaaacagaatgagttgtgagctgtgaggcacatgcaaggtgatttatgcccatgtgtgcttcccctttgttgctttctttgtgttcactttctccattttctcttttatttcaattatccttcttgagaaaattatttgactttatttgcgtcctatgttataggtaggggctttccccttctaatgtgttctggttctttcatttttgtgttcctgaaatagtaactggtattcataaagtgatgttcttctgggaccctgaaagcccttggccaggattattttgttcgtcttgacaataccactttgtactaagcaaggtaggtagtgagaatgtgtgtgtatgttccattttttacagagcgggtattaagaggatatataatgtcccaaagtcacttagaagcaggaagtcagggagacaagtaaaatggcctcatcttgtgatggctgtcaagagtctggtggtccagacttaggcaaggctgatgtgtaactgtttctaaggcagtgagtgcttgatttagggtctccacacagaaaccatactgaccctgtgagtgaagatatcattgaagatcagcattcactgtgggctggctttgaggcagccatagaatctggataccaggcaaattcctggatcacatgagttcttgggggccaggctctctctcttctgttggagcaacaggcagagtgaactcacagcttttgggttaactagaatcttctttttgccattaaacagctgtgttgcttgtcagatcgagaagtagcatcttatcatcattataccatgattcttcaccctctgaaagattatgcttaagtgtttggttttctttgaactgttctccccacacaaagactgacagtcctaccttcagagaacactgctggggccatccttcaagagaaattgtcaggcctttgaaaggccttcctgaagcaatcattcctctacctgcgtttgtaatctctctattgatgtcatcctaggttcctaatgtcttccagtccttgagcctgagacggccagtcagcaccaccttgccattttttccattgcaaagaaaaggctttttcccccgccttgccacttatttctttaccgaagcatcattactgaatagaacatacacactccctgggtgaaaaagaacaatggagttcagtgcacaaagttacctaacttgggatattcccaatcttgcaagctctttctccttataccactacacagagtgagcaaatactaccagcttctgtactgctgatgtatgcatgtggtcatggagctatgtaagtatttcttttaagggtagatttcttttagggaaaacaccaactctggaaagtcctcaggcaaagtacaatgtgtgaacagctctgctggagggaatattgccaagatgcagctggagcccacctctgcgccatagaggcctgtttgcataaagtgggtgagaaattgccttgtctctacatttcacccctaataagtaattggaagagtgtctcagccaccttttcttttttctttctttttttttttttttgagacggagtctcactctgttgcccaggctggagtgcagtggtgcaatcttggctcactgccacctatgcctcccaggtttaggcagttctgcctcagcctcctgagtagcaggggctacaggtgcacgctgcttcgcctggctaattttttgtattttaatagacacggggtttcaccatgttgcccaggctggtcacgaactcctgagctcaggcagtccacctgcctcggcctcctgaagtgctgggattacaggcgtgagccaccgtgcccagcctcagcttttctttaagagaagtttaacattattatattaaaatgccacagatgtgagggggatgcccccttcaaaaatggattacttttttttaaaaaaaattgaataccaagtgggagttgaggtacattgcacaaatccgccctgatttaaccccagagtggagctcagagtagaacatgttatatttcttggttaactaaccatgctatttatagaggtgactcctcggaaagtctagacattgttcccagaagacagaatgccaaatctgcagtcattgaacaaaccaaatctgctcctaccttcccagctagcttgctaagaataatcacctccctgtttctcaccataaaatggaaatcttggaacttcattctaagaaagtgtgaatgatatttgggttccccagccaagacttggggtaggcaaggaggaggaggtgctcctgtgagcctggtcctacccacccttggcctgtgctccttggagcccaccttgctaagttgttggaaactgtggttggcaggtcctagtttttgagtaggtctcctctaaaaggacatcttgaggacctaaggatggtgcttttctttgggaatgagccagctgcagtttttgccttttttcatagatgtgcaatcttagaacatcctattgaaagcgcagttggaaaggggtggatggacaaagccaagaactcactcgacaaacatgtatcaacggacaggtgtgatgaatgctgatgatgctgtggccatgaggaagtatagacctttagcctaaatctaaattgggagtttctaaagttggtttcaaggaagactagttttatggaatgttaataatgtgggaaaaggaactgtaggttaattagtttaggaaataaatggattaaataaacttaaaagagattctttactggagggcttctaagaaagcctttaatattcttatgatcctgatttaatatcctggtatatctgtgcatcttgaagacagagacaggataagcagtattcccccaactgttgtgtcgagggagccctttttacagtgagcatttcatggaaccactgtggtttcaaaaaaaccacctcctcaaaacacactttgggagatgattctattcagaaatatctgggagtccatgatacagctggagatggaattcgcctttcattctgtcagtggtgagtgaggacctgacctgcatgcgtcaggccctgggcaagggctttgctttacagcagtgaggaagcacaggtcctgccctcttgggactcacagtttggtgcaggaggcccccatgcttttctgtttatagacctctttttgagcaattacccaattcatatatctatatttatttatttataagttatatgcatttagtacaatgttaatatattaggtacactataaaacacatacacaaaatagaaaatgtaaaaggatgagaaaaaaacaattatgaaagtaaattctgtcacttttatcccaaagaattggcacgtgccctgggctcccttcagctgcctgggccctaccctggagactgactcagtgaattgagccgcagtcttggtatctggaaggctaacaggtcttcccagctgattgtgctgcaggtgttggagagcagtgtgtgttgcctggggactgtgtggactggtatcacccagacagcttgcactgactccagaccctgccgtcatgtcacaggtaagaaggtcaggaagaggctggagcgtgccggtgaatgggtgagaaagctccctggtgaggcttcctgcttttctgttgctcagaaggaggccgtgcttcctaggaactgcatccagtcacaggcggggactttgggcaagtcactgggcctccctggcctaattttcttctctggaaaagtaagggggtgatttagaataacccgcagaatgtcttagggcccctacatttgatttaatcagggtttttttgtttttttttttttgagacagagtctcgctctgtcacccaggctgtagtgcagtggcgcaatctcggatcattgcatactctacctcccaggttcaagcgattctcctgcctcagcctcccgagtagatgagattacaggtgcgcgccaccacacctggctcgtttttgtatttttaatagagatgaggtttcaccatgttggccaagctggtcttgaactcctcacctcaaatgatccacccacctcagccccccaaagtgctgggattacaggcgtcagccactgcgcctggcctttaatcaggttttttatttcaacaaggcatgggggtgattcagtttcgttcagcaatttaaaatacatgtatattttctttttgatgtaagagctagttagatcatgaggcttggattttcttggactctgtgggcacctaggcagtagtaggtgtttaaattttaggcccccaagcaaaagtttcagaagggggcctctttaacccttgttaattgcaaaataaacagatctcaagggcaggggccccttcttttcataataactgcctctgttttgtgtgtcatcagtgaaaagcatcattttcaaatactccatcaggagtgggttccatcactgaaggccttcttccttcagcccatcaaaggacctcctcctttgacccctcagagtcagtggctaacctgccccctacccctgtcacatgtctttagcttccagatatctccatttgcaagctaataagttgcacatacatatgtttgaacagttgtcaggcttgtctgctgctcaaactgtgttttagtttaaaacaacaacaacagagaactcagagcgggggaatggatgaagacatttcagttgtgcctgcaggtggtgttgttttgaccttgacagtcagttttaaatgacttgtcaagtaccaatgtgtgcttctgggcacacccacctggaagatattatgtcccctaggctttatatgccccagcaggcaggcatgaggtccctggattttgttttcattgatggaaggttaatgcatgcatggcagaactttactgagaggggcgcagctacaaaccctgttttcatttaattctgatttctcttctcccttggcctttccctccctgcccccagacctcttccgtctgggctctctccactccccatcagcaatcccttctctaccacagctgccccccaccaccactttggcttcaaaccatttatcctggctttgatatctccttgcagagctgtaagcaaccaggagatgctgggtcccagagctcagcagggtgcactgcctggtaggggactgggccccagtctccaggccactgcaggaaattgcacccagaaagcctgcccaggcccctgtgcctgtcccggtaaccactcaggtgcagcccccagaggcggcatctcctcagcttaagtgttgtctggggagaacttcttaggattattctaacctttccgatggtccaggttcatctctctgaattttacctgtttaaacttggagtgtctcccgtaccctcaaaggccacacatgcttgtgctggcaagttggggtgaggagaataaatggacagatgaaaggaacctattggattcatcctcctgcctaccaacacttcgatagtttcaagttatttgagagtacaattgatggtcccttatccagggaacacttcttcttcagcttccttgtccaaggaaggagacctgtactaattagatcatgaggcttggattttcctgtactatgtttctaaaggtagagatgagggaaagggtgcttgttcttaggaccacgtgcacatcttctcactctgtaatacttccttaaacttgggaagaagtaggcccagagctagatatttacttctctaatgggtaacaccaccagcaatgtgctccactgtttggtgggcttacgggaacatatgaaggagagggtccctgcctggccccttagatatcttgctgagatctgacttagaatctaagaggaagaccagtgcttgccaacctgtcctccccagaatccggaagtcttcccaaggccatagaagtgcatcacactgtctcgctccaagggactcaaaccactttctctttataccccctgcctgaggggcacctctgtaagggaatcttattacttacctttggcacacatcctgccctgggatttcccagttagaatgccaagtagaggaggctgagaaatgtgtggtatgagaatgactggaccatgtttcctatcactgggaggagcctggtgtcagagaatgtaggagaagcagagtaagggagagaaatggcattcactctgtgcccctgcccttcctatgggtctctgagccttcaaataaggactttatttggtcaaagctggttgagttgagtttctgttgtttacacccacagccctgaataatttacaaagggacacttcccttttggttttacaagcaaaagcatcagttagaccttaggattgggaaggggagtcagtggtgtagacctaaaaggaagaagctgaagcaccaaatataatttaaagcgttttattgagccaaagtgaggatggctgcctggaaaactcagacccaaggaaccttggatatgagctccatcctgcctttgttacaagcaggtttttagaggcaaaaaaaaaggggacaaggagtgggctgtacaaagtggtttattaggaattctcgtgggttttcgaaataacattgattagtgattggctatacgttgttaagctatagggtgggttatagagtctgctgtggcattattaggttgatttatagctacttctggcagtagcaaacagttacaagagatgagtgcatagctcaaagggaggggtaagatgtgattgctccctcattttaatgtctctctggacctgataatctaaaataactcactttcttcagattaaagatcttggttgctttgagtaaacctgacagtgtctggtttgatgaaggtccacctctgaccttcagattctttgatgatgataccacctgactttatagctttcggggtgtcctcagatatgtctcctctcacaaacaagctccaggtccttccacagccctgctatcacaggcttcctgtaacttccttccagactagccctgtcctccccctcaccagcctgtgctaagacctggaatccttgctactcagagagacctctctgctctgcccctcccatgattttccacccaccaggaagggcaagctgtgctttctggttccctaaggagtttctcatgcagggtaatgagtcccagcaggtgctgacagtggatcagggcctgggcttctatagctcttggcctctgaagcacagggcaggtggatcctaatggtgagttgtttgcttgagctgagctgcagaaatgggttggagcatgagcaagggcaagccccagacaaccaagaacatttcatattctgctccccataggatgcaatgtgagattgatactcgagggacctccaccctggctgtgttcaggctcttgacaccgccacaagaaggaattcaaggacaagttggaagataaagtacacactcaagaaaagggagtttggtgtactaaagagagagagtcatgcacaaggggggctggggtttctatctctatgggtttctgaaccaaggggtggaatatctatgttgagcagtggggttattgaaattatgtagcaaggtagtctgttggtaaatctttcaaacttgcagtttaatcctgaattgttaatataagattaataggtgtggtttattaccacacaaacacctccaattggttcctgctctggccctgttggggcctcatatgatggcttaataatgagcccaaatcctgcaaaatcttgctgtactcaggaaagttctgagttgcttcttcatttgtggcagtcccaccttttagacagcctcctttcactctgtggagaaggtctggtttcctgggcttaggatgtaccccaggtatttaatttttggttttagaaatctgggccttggatggagagacctgatacccaaagagggaggttaggactttcccaggaggttaggacttgaatggcattcttctctgagtcctctttagtgggactgcatacaaggatgtcatccacatattggagaatgactccccatttctagctctagctccttttactcttgtgccaaggcatttctgaacaagtgagggccatccctgaagccctgaggcagtactgtccaggtgtgctgctgggtaatattagttccaggattagtcctctcaagagcaaacaaatactgagagtcagaatgcaaagggatacaaaagaaagcatccttaagatctaatactgtgaaccagttggtctcccggtattcgggtaagtatggcataaggattttgcactgtcggacgtaagggaattacagcctcattaatggctctcaagtcttgaactagacggtactctgtttggtttttggttaggaaggaccaggagtattacaaggagactgacatggaatcaggaagccatgttttaaaaacttgtcaattagaggttggagtccttgcttggcttttggtttgagaggatactgacgcttgtgtgggaaattatttttgtcttttaaagaggtgatcactggctgagcataaattgctttgccagggctttcttggtcccatatttgtgggtctgagaccttattttgggatggatctcctgtcattccgaggctggcttaggaaacaacactgccaaaaaggagggccccccacccagggcctgataaatgtaaagtggcctcaggggtggctaggaagtcccatcccaatgaaagagtagaatactgtggcataactagagattcatgagttaccatatagtttcctagcctgcagttcagaggcactgtaaagtgttttgattttggggtgccactgacacccatgacagtgcagcttttggaagataagggcccagagtggccatttaggacagagtaacttgcccctgtgtcaattaagacattgatattcttagttgccatgtcaagagtcacctgaggctcctcagttatgatgaccaggccttttatgggagccgccgagaacctcgggccccttcaggcctcagttatggccattatggactgggtatcctcctattcctttggagctgaaggcaatcccttttccaatggctcccctgcttgcagtgaggacagcatctgggtgggctcccctggctgcgacagatcttatcccaatgtcctggcttcccacacttgaagcagcaaccattgcctgcacggttgctgttaggcctttttggtccatgggtgaagcatctctctggatgaccctgaggttgcagggtgctgctcatagtaactgctatcatttgggcctgccatctatcccattgtttgccacactgggtcctttcagccttttcagccctgtccctattactgaatacctggaaagcctcatcaagctttggtttaataggtatttggggtctcaaagacaatttctgtaattttctcctgatgttgggtgctgactggcttataaagtgtgtccctagttaaatttggccagcatcagtactgaggtgagtgttaatatattttcttagggccttcacaaggtgaccctggaacaaagcttggttttcatcctttccttatttcccttattttatcatagttcacagccttagtgtacattttttattctctccactaaccaaattgccatacaatttctttttcttggattagcctggccttgtagatagttccagttggggtcattgttaggcacaggcatggcccccacagtgtatagttcagggtccccagctaataagttgtcagcataagccttggcctccacgcagatacactgcttttcctccagggtgcaacatgtggacgaggtaatatgaataactcaccaagttaactcaggtgagagtgagagagcctgaaattcgtcctgaatttagttgggtcctctaaaaattggcccaacctttggctacatcatgctagatcaaacactgaaaaaggtacatgcacctggatggtcccagcatccccattggccacctccctaagtgagcataacttagaatggttaggaaggtaggaaatgccactgtaggtgaccctggcagggctctgttccttcagtagggagggcatataggttggtaaggaggtgggctaacgggagactaagggctggagatggtggagctagaagaagactggggagttggaggtggaattgggtggtagggaggagcagggagtgctagacctaggtctgggttaggaggtgggggaaggctatgagaggtatattcccaaaaagggtatcatctaggatatctggttcccatttcgttctcctaaagggatgtgagtctaacaaaggcagcagttcctgcaacggtcaaggttctaacagggccacgaaggcctgtgcacatggtgtttcagttcaattctcctgacattgataaaaaagatctaattgcaaaatggtattacaatttagggtcatgttctcttaccattgtactgcattctgtttccttttttttccttttaggatctcacttttttacccaaggctgaagtgcagtggcacgatcatggctcgctgcagcctcatcctcccaggctgaggtgatcctcctaccccagccccctgagtaagctgggactataggcgtgcaccaccatgcctggctaattttctgtgtgttttttgtagagatggggtttcgccacgttgtccaggctggtcgcgaactcctggactcaagcaatctgtgtgccttggcctcccacagtgctaggattataggcgtgaaccaccacacctggcccttgtaccctatgttctaaaagaaaggccttgacttgtctttggcatgaaatgaagaagaagaggaaagttaacatattccctcatggagggactggtcccagtatttacgaaatgctgcatggacgagtgtggtgcttacaattggccagctccatggccatgcctgagagacaagcatccttgttcccttggctggctgccttagtgtccaggtgtccttggagccctagcattgcccaggcatccttggctcctggggctttgaaaatgagaaggcttttgaggtctagtaggacgagttatggcataatttgaaagcagcaagcatgccaatatccatccgaatatttatcctcaagtaaaagttgggaacagaagtgatttagcatggccaataaaccaaggaccttgaaggggccccttaagaactttaggcctagatttggcattccggagggcagtatctaagatgcctatcttgctgggtccaaagagttccctaagctttcatgtgaagtatgaggaagaagcatgagaagagaaaatctcaggagctgagtttaaagaaaatgggaaagagaaaacagttcccagccagggtcagtgttttggcacagctggtcccttgggagaatggaagcctcttcctgggcaaaagtcatcatgctccttggaagccatccagccactgcacagtacaagctataggatgttaccctaccaccctaccatggtgcctcagacctgccacctctgcttgtcgcccaagatgatggagagagagctctgctttgcagtcagtgctctatccccagctctgccgttgactgctgtgtcctgttactccctggtaaggtgccatagaccactcatctccagaactcttgtggataagattatgtgtagatgccgttacatcttaggtcctcagcagatactggttccttgcttcagtaggcttaggaaaatttggtagttttatgggtcaataaacacataagttttgtggcttattagtgtgaatcacagattctacagttcctatcaacccaatgtctaaaataattctctaaaataatagctccagggagaaaataaaaataggtatggtgacttagcatggtagtatgacaatatgaaaggtttgttacagagttgttggtccacattccttacattgtacacattggaatttctccgtttcagaaggagcatttagagcagcacctacatttttgttaggttttccttcaaggctgtagcttgaacttttaatatacatactcacttttcttccccccaaaaagaagggtaaagaaggcagtaaaggtaaagaaaccagacattatttgattcagctcaaaatgtattttttagttccttttccacatttaataacaaataaaggccgggcgcggtggctcacgcctgtaatcccagcactttgggaggctgaggtgggcggatcacgaggtcaggagatcgagaccatcctggctaacacagtgaaaccctgtctgtactaaaaatacaaaaaattagccgggcatggtggcgggcacctgtagccccagccactcgggacgctgaggcaggagaatggcatgaacccaggaggccgggcttccagtgagccgagatcatgccactgcactccagcctgggcgacagagtgagactccgtctcaaaaaacaaaagcaaacaaacaaaaaaaataaaaagaaatcttgtacctgatcttcagggatttgggatcccacctggattaaactagactatccaagccctatttgcctggcttccagccctcctggagttctgttcccaccagttagacaaagctctctgtccttgacctcttttcccatcacttttggatcagagattgagcctgtcagctcctgaaacagctgtctctgatctgttctcagtattatctgagccattatctgacttgtgtctgaaaggactgcgtgatggaaacttctgaaagaaccctctgtcaccccacccgcatcttccaaatagagccagagaggcccagagtcagaaggctaagaagaccaagtgtgtggccagcagctgcggggagccagggcaactcctgcccgccactcttcctctgaatgcctagccctctccgcctgtgttcacaggccagccctccccggggcatacacagcattttgtaaatagtaactgtgtgtcttggttgagataatcttgtaggccagaatggaatgtctcaagacactttgcaaacgggattttattgtttagttttagggataggatctcactctgtcacccaggctggagtgcaatggcacgatctgggctcattgcagctttcacctcccaggctcaatcagtcctcctcagcctcctgcgtagctgggactacaggcatgtgccaccatgcctggctaaattttttttttttttcatagagacggggtctgactacgttgcctaggctagtcttaaactctgaggctcaagcaatcctcccgccttggccttctgaagtgctgggattacaggaatgagccactgtgctcagcccaaaagggattttaattttgcaaaaggaccaaccttaaaagagctttgaataataagtttctttagtgcaattctttttttttttttttttgagatggagtctcgctttgtcacccaggctggagcacagtggcgcaatctcggctcactgcaacctctgtctcccgggtttaagtcattctcctgcctcaccctcctgaatagctgggattacaggtgcccaccaccacgcccagctgatttttgtatttctagtagagatggggttttgccatgttggccaagtttgtctcaaactcctgacctcaggtgatctgcctgccttggcctcccaaagtgctgggattacaggtgtgagccaccgcgcctggccagtgcaattcttttatgtttttgttccccacctctgttccgattttccattccttaggtatagtactttatgagctttttgtattaaccccctgtgttccttcatgcagatgcaggccaattagacgatacatattattactctctctcccttttcttaaaaggagatagaacacacaccctattttacactgtgcttttgtcaattatcattatcccctagatataatattaggccttaaagagtttctcattcttttttatttagctgcatagtattctagtctatggatgctctcagttatacttttccaaaatatggatctttgactttttccaaaattttactgttgtaaacaatgctgtgttgagcacctggtatatttaaatagtcagtgaatcacaaagatttcattaacatacctgccatattgtgggaggtagggatgtgcctgcatcttatttatccttcactagtgcttggtaactgtaggtggaaccacatgcaatttctgtttggggaaatcttaaaagcagtagaatatcagcacttttgcgtagctcactgatatttagagaaacctacatgccatagcagggatggagataagaaaaagaagtctctcgcccccaacctaatgtgtcttggtgaagatcttgcttatttaggtctaagaccttgtttaataaaccaagtggaagccgtaatgactccttttcagcaattttataacgatgtagttcttcaggtttcactaattttaacaattctataaagttatgttcatcctattttcactaactttggaagtttaaagagaaactctgttgaaaaagtaaatccacataccaagtgtttttaaatagcatggagaaatgcaatttatttttctggttaagagaagtaagtattatttatgcttttttgggcttttgggtttatttatttaggtggtgccttggcgttgagtgaatgacattagctggtgtggggacctgcagcagggctttcaggatagagcgttcaccccacagtttcagtggtgagcaggcaagaggttgcccagatcctggcccaaaagaccaaccaccagtcttacaaactaaagggaaatcatattttaccacaatgagaaaaaatgaaggggaaggctaatgctgtattttttgttaaaatggaaggatgttgagaagacagagactttcagtggttttaatcttcagactttggcagaggccaagcatgatttgaatacagagaaagtggagtgacatgacagaaagggaagtggaaagtggtggcttccagaaacaaccagatgtgtttgaatttccaggctcctcaaggaagagtgagttgagctggagctgagttgctgaaaccttttttaaagactcagttgaacatccgtatgcccctgacatgtaattctagagcataccacccaaaactcaattttaaatagtaggcagagcctatgctgctaccctgttatggtttcatgttggcctaactaatctattttttctttttggtggtaacatcaatgggaggcaagcaatagatgtgatttatctcagccttagtaaggcatgacaataagaacaaattcagaaaatgttctttaccagcatggcaagtttttttttgtatttctaaaaggcaaccattttagtggatacaaaattaacataagccatagatctgtgcaccctgtgtgtgtaaacacacacacacacacacacacacacacacacacacacacacgcaggcattcagcctactgaccccgctcgtggctgtgtgctatagacacacagaaatacagtgatccccaggctggtttggcagggcactcattacatagagggaacagacaaagagaaccatcatagaagggctgagaggcccagagaacatggcagacgagctgctggtcatttgtgtcacacactctagcccctttgcagggccctttgacccctttaaggatgtgttgatcttgttagaagctgaaacagcagcaggagggtcattttgttgtgctttcaaatgaatgcctgatcagctgtgaaatagacttgtgcttgtctagtctctaagaccaagggaaatgacttttcctaaaaagaaaagtttaaggaagttttttgtttgttttgttttttatggctaagctttgctgtttttgctttaacaaaacacctccctgcacagcctaattccaacagcagagtatctgattacctcatgctgaataatgcactgttgtttatttgctttgctaccttccagatttttcttttctgggctagataatcccaacagctttgagttccgtttttataacttctattttcctattctttagtcatctcagttgctttctgctggagcattttctgattctcttcattgctcggaaattaagaagtctgaaaccagacacaacaagctggaaagatgtctccatagctgatgataggaactgtttatcgagctctgaactctgtgcctcgtgttgcgctgagtacatgtcatgtatcatcccatttaagacttgcatcctctatggaatagattccatttgggcattttgtagatgaggaaactgagaaaagagtaattctgtatctcgcccgtctcctaagtgatagtgccgaaattctacccagttccctgcctgtggagcctgcagtctgaaccattatccctggtgccacaatttcactcacctgtcccctaatctttttttttttttcttttgtgagatggagtttcgctcttgttgcccaggctggagtgcaatggcgcaatctcggctcatcgcaacttccgcctcttgggttcaagtgattctcctgccttagcctcctgagtagctgggattacaggcatgtgccaccacacccagctaattttgtatttttagtagggacggggtttctccgtgttggtcagtctggtcttcaactcctgacctcaggtgatctgcccacctcagcctcccaaagtgctgggattacaggcgtgagccaccgtgcctggcttatatgaaatgctaacagctgtactgggcagttgactcgctttctatttaaaggtcagtatacctctctaccttttactcctttattaacacatggttagtcatgccttccttcagactagtctgcatgtccttctggaaattcattttgttgaaccacttttccagattctttgaatctcactgaattctaatttggtccttctagagcatgttcacctcctgtagcttgattctctggagcatctaatgaagtctcttaactggcaagcctcctgggggcttttaggtgtccactgccctttgtgatgtcatccttcacacttaccttggctcttccccgggttcccacaccaggctgagtggaaggaggtgtagattgagcaagctgtctgggagcgtgaatttttaggtagtagctatcttttcaaatttggagaattcgtcagagttttacaatagcctcagaagtagggaaatctcacttagattttgtttcaagtccacagttatcgggtgctcattgctatcactgagaaccctaggcattgccaagctatcactttgtggaagccatgcctttggagtgaaaacaccatctatgaaagatagtcacgtgacgttgaattgtatcacacccagcttactatgcagtccctggcatggaagtgaccctttgctactatttattaaatgagagaaagaagggatatagaaataggaatcgcagtggtgattaaagttattttgctttttgctgaagacctctagtgtgatttccccaatgtacaccaatttaaccagaggagggtacaacaggaatcaccgtgacagttatcctccaaattaaaatgaaagtcaaaaatctctcacaacacgttttttaggaacaacaacagtcagtgttccaaaatctccttaagcccccaaaaagaggatttcaagagcctttagtctttagttttgcttctctctagttcttgcttcttctgtaacatcatggcccctgcctctttggatactctaagatgtcaaatcgactgaggatgactcctgaggaccctttgagatgattaccatcgttgtaggtatagcttgatgtattcttgtgtttatgaatgcagaggtgtttagaaacactactgggaatattctctaactttcaggtggaaccagaaaagagaaaatttctgttcttctgatcatttgtcaaattcagctcgaaacaggatcttgagtacagaacatttttcctggttgctgcatagctcagttaatctgtatatcatgggagtgtgttattgagagcatttgcagaagggtggaaccaggagctcatggctcaagcaggaaaatgtttcattatttgcagagcaagagaatgaaactcctgagacctgaatttcagggctccttgaaatgatggatgcattcttttaacttggtggagaaaaagaacataataaattcgagaaaataaccattcttttacacttcttttttctcattcagttttgctctttactttttgtaataccactctcaagtctctaaaatacaactgcttcccatttggtgagtgtttttttttttttttccatttgacaacagcattttcctgtgtttttaatggcaccaaaattaacatggctgtttcaatttaacagaaacaacttcaagttttatattacacgccctaccaaagaatctttgatttttgccctggcgtttcccaagatgttagcatggctttgaaaacagggctgtttaactgctgctgcagaagagatggccaggggagcacagcagattggggagggaggagggagagaatggaggagaggagggaaattggcctcccccaagttactatttttaaagtttgcttgcctactgaatagctcaatttacaaatcctactggatatggttttgtgcttccccgtttttgtttcctgttgaaagtgtgatggatgccttggtggaagaccagccccgcatcctgctgttttgcctgtgcctctttacttacgaaggctgggcccttctctccccttgagaggggagacccacgttgtcgaaggcatctccagggagatagccagtcccggaatttcttaggaggtgggacctcaaatcccaattagaaacactccaggaaacatacatctttatttgttaaacaagtagtgttgtgtgagccttggtgaagacgctcagtcgttttaaataagtgaagtaaacattcccttccaggggagcgccctccctaggcgctgtcactttgaagctcagttttaaggttttcagttggaacatgcagtgttcttttttccttggcttgggttctagagaatgttgtttcctcatttggtaattggagagttaatagggttctttgtgatgctaccgtggaagagagactgttttattccattcagggactataattacagggcgcccatcggcatggttaaagttaaggttgtttcagcttttccaatgtaaactcatatttcaggggtttataactagctataaaaatttgcttctagctacagacctggcatattcagtgtcagcctaggaataacctttacgttttaaaaagtatttttaaaaggataattaaaaaattctgtttagctgtttataactgttgttacaaggattcaaggaaataaaaatagctttttctttttttagcaaaaacctgtgacccatatttttttaatgtggacaaagttattagatttttttttttatgtcttcaaaggaaaatacggtgaaatctgtgtcaaagctattttaaaagggtattgtttcagttttccttgtggcagcgggcagggcaccagaacatgccctccttgttctccgaagacatgagcctcccataggactgctggcaaagctgtttcgtccgcgggcttcaagttcattgtgacagaactcctggccaaggagtgcacagcagcctcttggcagatggaagaaacatgaccaaccatcgtgaggccatggccactctcctcttccccgcagccctgtccctctggccctacatgttgggacacagtgagcagcacaggtacagagctataatagagacccactggggggaccacagagcctcttcgttcccttttcctgatccacatggtggggaaggggaggagggagtttgcctctctaggaatctctcttcagctcggtggcatttgttgcagtaagtagctttaggtgggtctgtttttgtacatgctgacagatgggtgtgacacattgcacaggtgattcaaaagttctccaataaaactttctttaaaacttcatgctagacagatttacctttagcaattctttttctagcagctagggtcttgattgatgtcatgtgataataatgatggtggtggtggtggtggttgtaatgtggggaaggagaagaggtattggtcatggtgatggagctgatgatattagtggaggtggtgatggccacaagggtagtggtggcagtacagtggaagtgggggaggtgacagtggtgatgagtggtcatggcaacagttggggctatagatttctgcctgcctgcctgagctgtttgcacaagtcattgttcatctttgcagaaagcagcagcttagggaatctgccattgtcccttccctctacataacatgccccagtggaacttgcaactggcttttggtagatcttgtctaccaatgcatgataaaatttggtttgtggaagagatggatacatgcccccttttcagaagctggtctccattttagagccagagaacagcttctcttcttttctgtggcttctcgtttaggagcaaagaacacggtgagctggagctctggaaccccagagtcattagtagagagatggtggtatttctaccaaaattgaagtgcttaaccacattctaggaaccatgccctgtgatttacacatattaaatcagtaaatctttttaacaactctgtaaagtaagtttttatcttgactttacagatgaggaaagtgaggcttgggtcataggatttgaaaatcttggtctttgagcctcaaaccctttacattttcgtccactgaagccaccagatagtttcttagaacattctaaaatgtttgttgtcttgggtgagtgtatgggaagaaattcataagagaatgttccatatttggtttcttctctaacttatcatgaggacatagactgtcttttcttcctacacatttccttacactgatagtgtactaagatgacccttttaaaatttatatgggaactgtttagaggctcctaccgcatgttttcagggctggaactgtggagtgatcttttcctgacctgactggtctttgtccaaataggacattgagcaagccagaaaccaggccccagcagaaaaaagcaaatagagataaatagttatcctcgtcccagtgggatccctaggctttcaagatcaaaggcctactttgtgtgtgcctgttcataagccagagagaggggtacagaagtaggcaggctgtagtgtagactctggtgcccaggctgtttaactctcagattctctagtgatattatttaaaaagattcccatttataaaaatcagaaatataacttgcatttcccggacacagaataagaacaagggagagaaccagatgagaacagagaaaaaaagaagaggagaagtaatggcaaagaaaggaccagaggcagaaggcgagggaagcagggaggaggagcagtggttgtggtcagcacggggaatatttttataggaggcgtggaggagaatgctgcgatagatgtttatttctcccaccctgtgggctggcttcattttcttgatagtgtcctctgacgcacagaagtctttatatttgatgaagcccaatttatctactttgttctttagtttcttgtgcttttggtgtcatatttaagaattcattgcctattccaaagtcacaaagatttctccctgtgttttctgctaagagtgatttatttattatgattttagctcttatatttaggtctttgatccattttaagttgatttttgtgtaaggtgtgaggaggggtgttttgcctgtggatatctacttatcccagatttttattatttaattcatcaaatgtatattatgtacatattaaatgccagacattgtgctggacgccagggatagaatagtcaccaaaacagtcatcagtgtcatagtgtctcaggacctgggggcaaagacagcatttcaagaaatttgagaaggtagacttttggaggaattcagctcttgagcagagtttttcaaaaagtgtaatatgaggaaaactgcatagaattacctggattgcctgttaaaaaagcaaacagaccaattatacacatatacacacacaatatatatatatacacacacacaatatatatatataaatcacatactttagttatataataaacacattatttatatatatttcttattatatgtatttcttacataatttctcacatcttatttgtatttcttcttactgtttttttttttgagatggaggcttgctctgttgtccaggctggagtgcagtggcccaatctcgactcactgcaacctctgcctcccgggttcaggtgattctcctgcctcagcctcccaagtagctgggattacaggcgcggggcaccacacctggctaatttttgtatttttattagaggcggggtttcaccatgttggccaggctagtctcgaactcctgacctcaagtgatctgcccgccttggcctcccaaagtgctggaattacaggcatgagccactgtgcctggccactaagtttcaagatataaaccagtttacacacacacacacacacgcacacgcacacacacacataattacatataataaatacatataaaaaagctagctaggcctgtttattatttcctcttagatgattatcaaatacctatttattttcaatgtggaaaaatttcaggccttttctgtggccttaaaagtttgagatccaaagaagtgaagccattgtctaaccacatacccaactgcagttgtggaagtcattcttccaaaagcatcttgacaaagaaatgttttgatgggaaacatgatatatctctggaaagagaagtaagaaacttttctccctttcttaagttggatgtacttcacaaaacaaacaggccacgcccatgatgccagggtacggggcagtttccctcagcagctggctgcagctgctttttctaccgaaattctctgtttcataaaagctcccacaaaacacccttgtgagtcccctccactcaccctggccacatgtcagatatgttcaccctggccacatgtcagatatgttaaccctggggagaatccaataccccattacacctatatttcctttgccattcactccctgaatagggagggaacaaatgccttgactctagctctcttggcatttggagcaattggtggtttagttaccatctgacgtcatgactacaggtggcccaagggagttctgtgaaggagaaacacaatgacatattcacacctatctctgtgctttgcctgcatgatctaagggttcatgtgtgtgaaagaacaaaattaggagagtgactgcatgaactacatcaggtgtttaatttttattatttatttatttatgtatttattcaacttttaagttctagggtacatgtgcaggatgtgcaggtttgttacataggtaaacgtgtgccatggtggtttactgcacagatcaacccatcacctaggtattaagcccagcatgcattaactattctccctgatgctctccctctccctgctccccgtgacagactccagtgtgtgtggtttccccaccatgtgtccatatcttctcatcattcaactttcacttataagtgagaacatgtggtgtttggttttctgttcctgtgttggtttgctgatgataatggcttccagctccatccatgtccctgcaaaggacatgatcttgtttattttatgcctgcatagtattccatggtgtatatgtaccacattttctttatccagcttatctttcatggacatctgggttgatttcatgtctttgctattgtgaatagtgctgcaatgaacatacacatgcatgtatctttataataaaatgatttatattcctttgggtatataccctgtaatggtattgcttacatcctatttgggtcgaatggtatttctgcttctggatctttgaggaatggccacactgtcttccacgatggttgaaataatttacactctcaccaagtgtaaaagcattctttttttctttgcaaccttgccagcatctgttgtttcttgacttttcaataattgccattttgactggtatgagatggtatcttgttgtggttttgatttgcatttctctaatgaccagtgatgttgagctttttttcatgtttgttggctgcacagatgtcctctcttgagaagtgtctgttcatgtccttcacccactttttaatggggttgtttatttttttcttgtaaatttgtttaagttccttgtagattctggatattagacctttgtcagatggatagattgcaaaatttttttcccattctttacgttgtgtgtttactctgttgatagtttatttttctgtacagaagctccttagtttaattagatcccgtatatcagtttttgcttttgttgcaattgcttttggcatttttgtcatgaaatctttgcctgtgcctgtgccctgaatggtattgccttgattttcttctaggatttttatagttttgggttttacatttaagtctttaacccatcttatgttaatttttttataagatgttaaggaaggggttccagtttcaattttctgcatatgggtagccagttctcccagcaccatttattaaatagggaatcctttccccattgcttgtttttgtcaggtttgccaaaggtcaaatggttgtaggtgtgtggtcttatttccgagttatctgttctgttctattggtctgtgtgtctgtttttgtacaagtaccatgctgttttggttactgtagccttgtagtgtagtttgaagttgggtagtgggatgctcccagctttcttccttttgcttaggattgtcttggctatataggctcttttttggtttcatatgaattttaaaatagttatttctaattctgtgaagaatgtcagtggtagttgaatgaaaacagcattgaatctataaattactttggtcagtatggccatcttcacaatattgattcttcctatccatgatcatggaatgtttttccatttgtttgtgtcttctctgatttccttgagcagggttttgtagttcttcttgaatgaactcttattcccaagtgctacaaagagaaaaaatacctggaaatacagctaacaagggaagtgaaggatttcctcaaggagaactacaaaccactgctcaaggaaatcagagaggacacaaacaaaggtgtttaatttttaaaatgagaggtggactgcttccattaagtgaactgactggacaggaggctgcttttgtatattctccaagggactgaaggggaaaaggtgatgatcattaaaaatgttgtgttgagccaatgggtgaatttatttttaatctgaaagtggagaaaacttctggttttaaaacccagaaccaatagaaggaaagattgatatattagacacatgaatacaaaatatttttgcatgtaaaaaagcaaaacaaatgactcattgggaaaaaatattcctaatttataacacagacaaatatgagcttctgaaaacagaatagaaaaaacaacagtcatatagaaaaatgagctagagataagaacaaacagttcacaggaaaagagatgcaactgtctcttaaatttatgaaaagatgttcaacttttcttatcataggagaaatacaaattaaaacttcactgagatatcatttcttacctatgaggttggcagacatccaagagtttgacaacgtactctcttggagttgcaggggaagcgtcaatgcagggggcttcacctccatgggaaggagtttacagtatctagcaaaacaagatagactttgactccaaatcttatgaatttattctaaggatacattggcaaaaatgtgaaaatatgcacatatacacacagttgttttttggcatagcaaaagactagaaacaacccagatgcccatcagtttgtgccagtttaaagaaactgggatatccacacaatgcagcactatagctataaaaatgaatgttcactatctctaagactgtggtaatcttcaggatgtcttgttaagtaaaaagagcaaggtggagtttattcaatatgttaaatgtcaattccattggacttttataaaaacaatggaaatttaaatgataaaaaaattttaagtggttacctatagtagaagaaagcgggggaaaaggtcgggggtacagatagtaagagttagacttctcctcagtatactttgctttgtaaatttgatttttttttttttttttggtgacagagtctcgctctgttgcccaggcgggagtgcagtggcacatgatctctgctcactgcagactccgcctcctgggttcaagcgattctgctgcctcagcctcctgagcagctgggattataggtgcgtgccaccatgccctgctaatttttgtgttttgagtagagatggggtttcaccatgttggccaggctggtcttgaactcctgacctaaagtgatccacccgcctctgcctcccaaactgctaggattacaagcatgagccaccacacccgtcctttttttttttttttttttttgagatggagttttgctcgttttccacactggagtgcaatggcatgatctcagctcacggcaacctttgcctcctaggttcaagtgattctcctgcctcagcctcccaagtagctgggattacaggtgtgtgccaccacactcagctaattttgtatttttagtagagacagagtttcactgtgttggtcaggctggtcttgaactcctgacctcaggtgatgcacccgccttagcctcccaaagtgctgggattacaggtgtgagccaccgcgcctggctgtgcctgaagtttcttacaccaggaagcaaagaagctactgaagattattagagccacaaccaagggactcaggaaccaaattgaagtttctactgggacaatttgagcattaataagataactgcaatggtttgaaacgcatcaagtccatgagttcataataataaaaataaacttgtatcattggccaccttttaaggataccagggaattaactcattattttgaaaactggtaaataaagagactcaggcatttattttgtcttcctgtatacagcatctcagcataaatcgttgagaaggggagtttgtctttatagaatgtagctaataaattaagtaatggtagaatgagagtattattttttgcaactcgtaaatcattaatggatctaggcaatgatcattttgtgtttcctaatgggagtacataacaaccctgttgaaatactcttgcccaggttgcccaagttacaccaacctgaatctgatcaagccccgagatctgattaccagcttacaggaagtaaagaggacagagaaacaaattaaatgacactaccggaatacagaggatagaaatatctgataggcaatcaggaatatctgcttaccaatttacaggaagtacagaggaacaaattaaatgataccacaggagtacagtgagcaaaatccaggcaatcttaggctctgtaagataaacaacgtggtttcttcaaaagatacattgcaaggaaaagagagagagattgggagaactgaaaagaaatttagagaaataccaaccaattacagcgtgtgggccttatttagatcccaatttggatgaaccaaatataaacaaacatttatgagcttatcaagaagttgaacactgactggatagttagtgatattaaggaattattatattatttaaggtacaagaatggtattgtggttttgtttaaaaaagagtctttgtttaaaaaagagcctggtggctcatgcctgtaatcctggcactttgggagtctgaggcaggtgaatcgcttgaggccagtagttccagatcattgtgggtaacatggcgaaaccttttctctactaaaaatcaaaaaattagcccactgtggtgacgtgcacctgtagtcccagctactcgggaggctgaggcaggagaatcgcttgaacctgggaggcagaggctgcagtgaacagagattgcaccattgcacttcagcctgggcaacagagcgagactgtctctaaatgcatgcatgcatgcatgcatacatacatacatacatacatacatacatacatacatacaaacaataaaacaaaaaagattttttatcttttagagctatataccgaaatatttttttgagggagacaaactctgttgttagattgaagtaattcaaatgtcagaatgggaaatttatacttcatctgagagacattgaataatccttatgggtacctgagaaaggaagaggcatggtaataggataaggagtgtagagtgtcgaagtagacccacacatgtatggtcatttgcttttcaacagaaatgctaagttatttcatagggggaaaggacagtcttttcggggtattgttttggaataactttcccttccccccattagtgcatttcattgtgcgtaagtgggcagaatagattggttggacaagagtctagctaggggaggccaccacaggatgtacaggagtaattttttccccaaaacaatgagtactttgactctgtactaaggatagatgtggtcaaggttttgctttggctcatctgttgtccgacctgtgatccccctggtctgtctcttcctaaccttggccagtattttcttttattctgcatatcactagaaacagaacagtggggagaatctagtgatggatggaaagggatacagaaaatttgcaaccatcaaataataacctctatttttttctcctttaaaagaagttgaacttgctctcattgtctcaaactggtttcctgcacgtcccagtgacttaaattagtacaagggtgcaaggcctttctgagaaatgcattgagactcctgtttatgttgaaatcttgctctgtctctttctgtttaaaccagaccagagcaaagactttaacagcttataggcaaatgcctgaacggtttttctttttgcttcagttgaagtggtatctatgcaaaattccaaagagtgggtgagtggagggagtgcagtagggccaaggtatttctttattatggctgttcccagtgtctcttccagaccatggttcaaaggctcctttgatcaactgattgatgtttcagtgggttttctagattcttctaccgctctttgtttttgtctttgttctatccctatacctctccatacctctaacccaaatcactagtcaatccctaagcaagggatcttgaggtctgaggtgcagtggtacagggtagggatgcttacctacagaagaaaggaccttgatcagattgcctgaatttggttgatttttgtttcctgcttgtgtgtgtgtgtgtgtgtgtgtatacacgtgtacaagcacatgcaccttttccaaggaaaatgtaattgccatgtaacttaagacatacatagagctcctataaacagtcatagcacaggcttttgtgtgaacataaatttttacttctctagagtaaatatctgggagagggattgctggatcatatggtatgtatatatttaagaaatttcctagcaaattggctttataatactgcattcctatcagcagtgagcaagagttttccttgctctgcatcctggctagtgcttggtattattagtttttaaaattttagtcattctattaggtatttaggggtatctcattgtagtttctcattgtgtttccctaatagttaatgatattgaacatttcttcatatgcttactttctttggcatcatatctgttcaggtcatttatgcacattattaattgggttgttttcttgctgttgagttttgagagttccattatgtattttagatagaatcctttgtcagatgtatgatttgcaaatattttctcccagcctgtagcttgccttttcattcctttaacagtatctctcatagagcaagtaatttcagttttgatgaagtacaatttatcaatcttttctttcatagattgtggttttggtgttatgggtaggaattctttgtctaactccagatcacagagattttctactatgtttttacaaaaatgttacagttgtatgctttataattagaactaatgtcattttgagataaatattttgtatggtgcgaggattagttcaaggttcattttttttgcctatgcttgtctaattattttttaaaaaaattttttatgaattttaaatgaaacaaaagctggttctttgaaaagataaaaaaattgatagaccattagcaagattaaccaagaaaagaagagagaagatccaaataggctcaattagaaatgaaatgggagatgttacaaccaacaccacagaaatacaaaagatcattcaaggctactgtgaacaccttaacacacataaactagaaaacagaggagatggataaattcctaggaatatacaactctcctagcttcaatcaggaagaattagaaactctgaacagaacaataacaagcagtgagattgaaatggtaataaaaaaaattaccaacaaaaaaagtccaggactggacagattcacagccgaactctatcagacttcaaagaagaattggtaccaatcctagtgacattattccacaatacaaaaaaagagggaatcctctctgcatgattctatgaagccagtatcaccctaataccaaaaccaggaaaggacataacaaaaaaagatattgatctgtagttcagtatccctgatgaacatagatagaaaaatccttaacagaatactggctaactgaatccaatggcatatcagaaagataatccaccatggtcaagcgggtttcataccagtaatgcaaggatggtttaacatacgcaagtcaataaatgtgatacactatataaacagaattaaaaacaaaaatcacatgatcatctcaatagatgcagaataagcatttgacaaaatccagcattcatttgtgattaaaactctcaacaaaattggcatacgagggacataccccaatgtaaataaaagccatctatgacaaacccacagccgacgtaatactgaatgagaaaaagttgaaagctttctctctgagaactgaaataagataaggatgcccactctcaccacttctattcagcatagtactggaagttctggtcatagcaatcagacaagggaatgaaataaaggtcatccaaattggtaaagaggaaatcaaattgtcactgtttgctgatgacatgattgtatatctagaaaacccagtaatttttttttttgacggagtcttgctctgtctcccaggctggagtgcagtggtgcagtctcggctcactgcaagccccgcctcctgggttcacgccattctcctgcctcagcctcccgagtagctgggactacaggcacccgccacccatgcctggctcattttttgtatttttagtagagatggggtttcactgcattagccaggctggtcttgatctcctgaccttgtgatctgcctgcctcggcctcccaaattggtgggttacaggcgtgagccactgtgcctggccaaaaaacccaataatgttttaacattatttgttgaaacactactctttctccattgaattgccttagcatctttatcaaaaatcagtgaccatgcttgtgtgggtctatttctggatgttttcatctcttccattgatttctgtctctctcttctataataacacatctgatttgatcactgaagctttctagtaaatctcaatattggctgatttgattcctccaactttattgttcttttaaaaattgttttgttctgggtcttttgccttttcatataaattttagaattcacttgtgtatatctaccaaaaaattatgctgggatttggttcagattttcattaaatcttgagataaatttggaaagagttgacatcttgaccatggttattcccagtgtctcttccagatgatggttcttactttgaatcttttgatccacaaatatgtttctccatttatttagaggttctattgtttttctcatcagtgttttgtaatttacaacatagaggtcctgtatgtattttaccagattgatacctaagtatttcactttttttggaattactataattaatcactataaatgctattctttttttttttttttttttttgagatggaatctcactctgtgccaggctggagtgcagtggcgcaatctcggctcactgcaaccgctgcctcctgggttcaagctgttttcctgcctcagcctcccgagtaggtgggactacaggcgtgcgccaccacacccacctaatttttgtattctttttttttttttttgagagggagtctcactctgtcactcaggctggagtgcagtggcgcgatttcggctcactgaaagccctgcctcccgggttcacgccattctcctgcctcagcctcccgagtaggtgggactacaggcgcccaccaccacacccggctaattttttgtatttttttttggtagagacggggtttcacatgttagccaggttggtctcgatctcctgaccatgtgatccgcccacctcggcctcccaaagtggctgggattataggcgtgagccaacccgcccagcctaatttttgtattcttactagagatggggtttcactatgttggccaggatggtcttgatctcttgacctcatgatctgcccatctcagcctcccaaagtgctgggattacagctgtgagccactacacccggcctataagtggtattctttttgtattttagtttcattttcataactagtatatagaaatatgattcattttgtgggtgatttgtatccagtcattttatttctcatttattctgtgagtcagtgaatagggacagttttatttgtttctttctaatctatatgactttttctttttcctgccttattgcactcttaggacttacaatatgatgtggacaggagtggtaagagtggacatctttttcttcttcctgatcttttttttgagacagggtctcactctgtcgctcaggctggagtgcagtggtacaatgatagctcactacagtgtcaacctcctgggccccattgatcctcccacctcagcttcccaagtagctggtgctataagcaccccaccacacctggctaacattttaaattttttgtagaattggtgccttgctatgttgtccaagctgatcttgaactcctgggcttaagcaatcttcctgtgttggcctctcaaagtgctgggattacaggtgtgagccacctcgtctggcctctttttcttcatcttattgagaaagtgtttgatctgtcaccattaagtatgacatgagctgtaggtttttgtaaatgtcctttccaggttgaggacagtcccttctactcctaattcactgagaaattttatcatgaatgggtgttgagttttgttagatgctttttctgtattaattgacaggatctatgatttttcttttttaggctgtcaatatgttggattacagtggttgattttcaaatattgaaccagctttccattgccatgataaaatcacatttgattctgatgtattattcttcttatatattgttggatttaatttgctaatattttgttgagtatttttgcatctgtgttcatgagggatattggcctgcagttttcttttcctgtactcttgactggtgttaatatcagggtaattctggccttataaactgagtttggaagtattcccttctagaagagaatgttttctggaagagattgtgtagaattggtattatttcttctttaaatgtttgatataattcacatgtgaaacctgggcctagagatttccttttcagaaggtttttaactacagatttaatttcattaaatttctaggactatttatgctgtctctttcatcctgggagagttttggaagtttatagtattcatgcattttttttttaatctaagttgttgaatttatctgtatagagttgttcattgtattccccatttttttaaatgtcttcatggtttttagtgatgatttcattcctgatgttggtaagttgttctttttctctttgtttctttgtccatctggctagaggtttgtcacttttattgatcttttcaaagaatcatcttttggtttcattgatttttctctgttgtttttcttgcttacagtttaatagattcctgatcttacttttattatttccttcctctacttgctttggaatttattttgcccttctttttccagtttcttaaggtagcaacttagcttattgatttgagacctttgttctattgtaacaagcactgaatgacataaatctcctttaagcactgctttagctgtgctccacacaattttttttttttttttttttgagacggagtctcactctgtcgcccaggctagattgcaatggtgcgatctcagcttactgcaggctccccctcctgcgttcaagtaactctcctgcctcagcctcctgagtagctgggactacaggcgtgtgccacgatgcttggctaatttttttgtatttttagtagagatggggtttcaccgtgttatccaggctggtcttgaactcctaacctcaggtgatccgcctgccttggcctcccaaagtgctgggattacagatgtgagccaacgtgcctggccactccacacattttgatacattatgttccgtttttattcactttgatgccttctaattttctttgggactttctctttgatccatggactgtttagatgtgtgttgtttgagttgcagttgttgggagatgctcctattacctttctattattgatttttagttaattcacttacgtcaaaggacactttttttgtgatttaaattattttctttttttaatttaagagttttgtctcaggatatggtgtatcttggtgaatgttccatgtgtactttaaaagaatatctactcctagctgggcacagtgactcacacctgtaatcccaacattttgggaggtcaaggcaggaggactgcttgaacccaggagtttgagaccagccagggcaacaaagcgagaccctgtctctacaaaaatttttaaaaattagctgcgtgtggtggcacatgcctgtggtcccagctacttaggaggctgaggtgagaggatcacttgagcctaggagttcaaggctgcaatgagctatggttgtgccgctgaactccagcttgggtgacagagcaagaccttgtctctaaaaaacaaacaaaaagaaaacaagaagccaggtgtggtgtctcacacctgtaatcccagcacttcgggaggcctaggtgggaggatcacttgaggtcaggagttcgagaccagcctggtcaacatggtgaaaccctgtgtctactaaaaatacaaaaattagctgggcatgatggcgtgcacctgtagtcccagctactcgggaggctgaggcaggagaattgcttgaacctgggaggcagagtttgcagtgagccgagattgtgccacttactccagcttgggggacaaagcgagactccgtcttacaaaaaaagaaaaacaacaacaaacaaacaaaataaaaccaaaactaagtttataaaaaagaatgtctgttctgctgttattggatggagttgtctatccaaggctctccttcccctttccctctatgttatagttgtcttatatattacatttgcaaagattgaaaatctcatcagacaatcctatgtttgctttcaattgtcaaacacattttaaataactgaataacagaaagataatctacttacccagatatttaccatttctgttctttcttcatttctgatgtttgaggtttctttgtggtttcattttccttttatttaaagaattttctttagaaattattttagagcaagatttgttgacaagaaattatctcaatttacattcatttgacaatatctttatttcaccatctcaataaaaattaataaaaataaaaaataaaaacattatgttttttcctttggcctccaaagtttttattttgaaatccaccatcattcaaattattcttcccttataagtagtagaaggatttctgtgactgttttcaagaatttttactttgtctttagttctcagtatttaattatgatttgtcttggaattgacttctttattgtttaagctttgctcatcttcttaggtatgtaagtttatgtattttgccaattttgtggggtttttgactctatgtcttcaaatattttcttctgtactacagcctttctctctctctgggactctaacgacacaaatattagaccttttagtattggttcactcagcagaaacgctgatctctctcccatccagattcctccgtgctccagggtttctcaggcctcggcacttttcacatcttgtttcccttacctagcctccccttcctgtttccccaccccactttcctgctgcctagcaagcttctactcatccttgaaaatccacttcaggaatgtcatgctttgtggcctgtctttgatcacctagagtgagttaattccagcctccaacccttgtagagtccgtgtgtgcttattgacctttttgtactttagtttgctgggtctgtgtcagtgtctctgagccttggttctcaggagctcaggtctactgtgtcttattatgtcctcagtgctgggcacagtgtctggcatctagaataggctcaaccagaggctgagcagtcagtttgctattattaccatatggcttcttcagcctcctggataggttgaggaccagatatagaatgcccatgagcctttgaaaccaagtttttagtggatattaaactcattccatttaacccaactcgctttttatctcatctattattgctctaatgattttgcctcttgaataccccattactattcagaaaggaaaagattgtactgtttcattgttttttctctcataatccaaactatagtatttgcacttgacttttggtttccctcaaatataccttcccatcatctcatgtatgccttggtgttattttttaagttattgctatctttttgttggtaagttatttaaagatattgctatcttttatttttaaatttaggtaaagttattacttcatctgactatatctgggctatttatttttctccatggagttgcacagtcatgcctggcatatcatttattttcttaaaggaggatatttattagttttgttctgtttttttgaggcagagtctccctctgtcgcccagctggagtacaatgatgcgatctcggctcactgcaacctccatctcccaggttcaactgattcttattcttcagccccacgagtagctgggattacaggcactcaccaccatgcccagctaatttttctgcttttggtaaagatggggtttcaccatgttggccaggctggtcactaactagtagttttaatttttgagaagccccccatacccttttaagaaaaaaaggcaaaaaatccaattactttgaaaagaaatttgtaattgatacataatattgtacatatttatgtggtacaatgtgatgtttcagtgcatgtatacatagtataatggtcaaatcggagtaattatcatgtccatcactttaagcatttgtcatttctttgtggtgacaacattcaaaatcttctcttaaagttatcttgaaatatatactacattgttacttgctgtagtcaccctactgtatagtggaacccagaacttactcttccagtctaactgtaactgtgtacccactgaccaacctttcctgtccttcctccccatgctggcatattatttaaatccacagacacatatcgaatagccactttgtgccagaaactcttgacactggggtaccagacaaatccaaaatctgtgccctggaagaactcatagtctcagggggcagatggtctgttcctagggttgctgtgagactggagcaggccggatgtgggctgtccgtgggagtggggttcaggtgggatggtatggtacctgtgaggccagggtacaagttacctgagtgagtgctttgtggaaatagaaaagtgaccatttcagaaaaaaaagatgaagtccaagaatttaattattcattcaatcaattaacaaatatttatggaacacctactatgtgcaagcactattccaggtgctcagaacaaagcccattgcatatggaacttgagttctgctaggggagacaaataggcagatgcatgaatatttaatatgttcttaggtaatgaaagcactatgaagagaaataaagcagagaaaggaaacttgggaataaggaaccctgctggtttctgtgggatgttcaggtgggactttaggaaactgtggtattccagcacagacaagacacagagtcaggtggggcagagcccccgaggtgggaagcactttgcaagctgggagaactgcaggaaggccaggctgctggtgttgaatgaacgagggaaaaaatggtaggaagtaaaactggagaagttgctgaggacccaattccacggggccttacagggtttttattctgagcaattgtggggagccatttgaaggttttaagtaaggagtaacacgatttgaggtgtgccttgaaaagatcatgctgggtggatacccgttttgggggaacgggacaggaaaggggcagggaagagcagacatacaagttaaaaagctaatagagaaatctacatgcgagataatggtagcttggactagggttggtaacagtgagaagtgttcaaatttgggatattttgaagagctgttgggattttggagtggtttgtgtctaagatgtgagagaaaaagaggtcaagaacaatttcaagatttggtgccatttgttgagggagggctgggcaggggaagaataaggttgtaggagaaaatcaaggttggttttaaatgtattgagtctgggccgggtgcagtggctcacgcctgtaatttcagcactttgggaggccaaggtgggggtggatcacctgaggtcaggagttcgagaccagcctggccaacattgcaaaactccatctctattaaaaatacaagaattagtcaggcgtggtgtcgggtgcctgtaaccccagctactggggaggctgaagcaggagaatcacatgaacctgggaggtggaggttgcagtgagctgagatggcgccattgcactccagcctgggcgatgagagcgagactccatcttaaaaaaaaaaaaaaaatttgagtctgaaatggctagtggaaatacagctggagttcatgaggcagcccatgactagagatctgaatttgcggagccttcaggatacagatggtatttgacgtcatgaaactggagaagcacaacgtggaaggaggtggaaagaagatcagtggtgtgcggactgagctgtggtgtcaggaatatcagctgctgagaagtggaagttatgaggactgagggtggactgtgggatttggttcagtgggggtcactggtgacctggaagaaggcaattgtgatagaatattgggaaaagaagtttaactggagtgagttgagagaaggtggggcaagaaagttgagacatcaagtacaggcagctctttcagggagtcctactgtaaaattaaagaaatagggaaattgctggagaaggatgtgaagccaagtgaggatgttttaagggaacagtctatcagagcacatttgtgtgctgaagagaataacctgggcaaagagaaagaagctggctgggcatggtggctcacgcccgtaatcctagcactttccaaggccgaggtggtgggaggattgcttgaacccaggagttcaagatcatcttggaaaacaaagtgagactccatctttacaaaaattttaaaaagttagcttgcgatggtggtgtgtacatgtgttctcagctacttgggaggctcaggtgtgaggatcacttcagcccagaaggttgaggctgcagtgagccagggatggcgccactgctctccagcctgggtgacagagcaagactctgtctctgaatgaatgaatgaatgaatgaagctgatgagaatggagcggatagtggatgattgcagtgaccatatttattgaggtggtgggagggtggggatctacaataggagtaaagtgggtctttgatgagcacacagaaggtttacccactatcaaagatggggaggcacatgtggaggtggctgcagggaggttggtagatttggtggttccctttgtacacacacacacacacacacacacactctctctgtctctctctctctctctctgtctctgtctctctctctctctccacacatccccaccctcccaccatgcctgcagtgcagggtacaaggaggaaatgatgggctgtgaagctggaagggtgggtggggaatggatattgtggagaagctcttccattcacctaaggagtttggatctcattcttgggcagaggggagccctggtggctagtaattatgggaagagcctgatcttctgtgggatgtggaggcagcaggaactccagtggggcagggctggttgggaaaacctggggcacagaggctgctgccagggccaggtgaactctacttctttattctgtcaatacgttgttaacacgtacttttctgaaattgaatagattcttatagatgattgaagaaaatcaaattaattcaagtagtcatgaagcagaactatgttagctgccaggcaagcagctgatttcctttaataagatgaatcattaatgggttgggagatttaggccttcgtgtgcagtaagggaggaaacagatatgagtgggagaaaatgtgaggtattttggaaccacaacaatcctgttagttactcttaatacccttagaccttctgtaggcactgttgatatcttttaacagatgaaggaggagagtccagggcatttcagtcactgctcatagcacccagaaaatcagttggtagacctaggatttaaatggtgttcttgaatttctagttctttacttggtccttggactgaagcaaagtgagaaatcttggcgataaaccacctgcaggactggggacatatcacttaggctttaatgttcaggtccacactatttcacaaaatttctacaatctaaagtggggattacttggctaccagcatcaggggaaatgtgacactgcagttacttattagattctcattttaaggccctctgtggaagagaggatctcaccagcatatacttggttaataagtaaaacatggatcttgggccagtgcagtggctcacacctgtaatccatcccagcactttgggaggccaaggcgggcgggtcacaaggtcaggaggtcgagaccatcctggctaacacggtgaaaccccatctgtactaaaaatacaaaaaattagcagggcatggtggcaggtgcctagagtcccagctactcaggaggctgaggcaggagaatggcatgaacccgggaggcggatcttgtagtgagctgagattacaccactgcactccagcctgggcgacggagcgagactccgtctcaaaaaaaaaaaaaaaaaaaaaattagccaggcatggtggtgcatgctgtagtcccagctacttgggaggctgaagcaggagaatcgcttgaacccgggaggcagaagttgcagtgagccaagatcacgccactgcaccccagcctgggtgacagagggagattcccactcaaacaaacaaacaaacaaacaaaccaaaaacaaaaaaacaaaaaaaaaacatggagcttgactcggagatggttgtaactgctgcacttcctctcctgtgaatgccctaccaagctaatagcccaggtaaaaggggaaagcattattatagtgaagtctaaacattttattttgttttattttttgagatggagtttcgcccttgtcacccaggctggagtgcaatggcactgcagcctccacttcctgggttcaagcgattctcctgcctcagcctcccacgtagctgggattacaggcatgcatcaccacacccagctaattttcttggtatttttagtagagacgggttttaccatgttggccacgctggtcacaaactcctgacctcaggcgatccactcgcctcggcctcccaaaatgctgggattagaggcgtgagccaccacacccggccaagtctaaatattttaagaggcatcctgagttcagaaatgctaaaatggggcagggggtaggaatagtaaggagagaaagtgtgtcttagaactaggaattgagtagcttaaatttttgtttaacatgaaattctggaaaagtttgtcctttaaaaacaaacttatattttcattgaagtttagttttaagtgttttactgataatcctgactccaaagattggttttagggttaaatgagataatgtatgtaaggcatttaaagcagttcccagcacatagtgaaggctcaataaatattcatagtaaattgtaattactgttatcttaatatactttccagggagcagtagattttttgaagtattcccaattgttaaatgttaccttttacttggtaacatttcttttttttctttctttctttctttttttttttttgcagtaatatcttcaaatactttagaacagtggtccccaacctttttggcatcagggacctgttttgtggaagacagtttttccacgggggtggggaggagggcatggtttagggatgaaactgtcccacttcgaatcatcaggcattagagtcacataaggagcttgcaacctagatccctctcatgcacagttcacaattgggtttgtgctcctgtgagaatttaatgccaggcggagcgcagtggctcacgcttgtaatcccagcactttgggaggctgaggtgggtggatcacctgaggtcaggagtccgagacaagcctggccaacatggcaaaaccccgtgtgtactaaaaatacaaaaattagccaggcgtggtggcgtgagcctgtaatcccagctacttgggaggctgaggcaggagagtcgcttgaacccgggagatggaggttacagtgagccaagatcatgccacggcactccagcctgcgcgacagagtgagattccatctcaaaaaaaaaaaaaaaaagactatctaatgctgctgctgatctgacaggaggcagagctcaggcgagaatgctcacttgcctgaggttcacctgctgtgcagcctggttcttaacagtccccagcctgcggggtgagcacctctgctttagaagtatttctaattgtaaaaaagttactttttagttggtagcatattttttattagcaagaagaagacatagattttaaattattaatatgcaaaaaaatgaacttattgaatgtctaattgagtgtggcactggctcagtgctaatcagagaaaacctgtcttacccacagatgtggtcctgcctgttggctgttataacccatggcggacactacagaaatgaccactaacattgagccacatcataatgtgcacatatgccagagttgcttctaagcaatgtacctttaatcctcatttcatcttcccagcaaccccgagttaggaactcgtatcatttccttttcagagacaaaaaaactgaagcccatatactcagttggcaatggtagagtggaatttgagctcaccgcccgactccagagtggtgcccttaattacgatgctgtacagcctctttctgatatgaggcaaacgctattggttgcctacccaacaaccagtcccactgtcttacttgctggaaaatccttgactttgtgtggttgtttacccctccctatgtgtctgtgtgaaagcaaatctggtccacatttctgtgagttcatcctggttcatctaagctgatcatggtgttgcatttctccttgccaaagattgggttaggcagggacatttgacaagattctggctgcgggaatatgaggagtaactctctgcaggcttctcagaaaactttcttcacagggagacatagacatacaaggaaggacacctctcttcctcccctgacctgatcacatctagcaatgtggcagcaatctggtaccagcctggggatgacaccaatgccaagtaaggcacagccaagaaaatgacggagaagcggagctctgacagtctatacttggaggtgcccatccctgtgcctttcattctgtgagaggaaaagacccatcgtcgcttaggccagtttgaattggcttttctgttactggtagccaaaggggtgctcatttggagcgtccttgcaggcgtgccttggcatgcaaagggtgaccggtatgctgagatctagctgccctcagctggagtcccacgcccgttacctccaccagtaagagcctcctttaatcagggaatatgcagatattttctctttgtatcatggcatttaaaagagtgggaagcattgtcttaactgatcaaaaacatgtaatagaaatgttatgtgtcagtatgcataggtaattaaaatattttaaagaatgaatgtatgtttctaagaaaacgtcttttgcccctcatcctttgggctggatgattccctccagacctcgttcaagtataatttcccctgacgagccttccctaacttaaccagccattacttgctctctcctcagaagatgtttaatctttctgttggcacttacttcactgtgatctgatgactggtctttcaagtctgtctttgccagtggactgtaagctcttgagcgaaagtagttccttgttgagaatggctgtcagctcagaacaagctcatctgtagtagctaaattaacctagatgtggtagtcatactagatactgcaactcctagaatactgcttctcaatcctagctgctttttaacccctctcatgattcccatccctggaggtggtggtttatttggtatggggtacagcccagacattggtgctttataggcctccgtgattccagtgtgcagtcaagttgggaagagagttgcaggaagagagtgacatagccagagggaaagacagcaaagaccgtttgacaactgtgatgacagtagatgtcactggatccagagaatccaacaagaagcttgtcacagtagccctgacgagagatgaacctagaacaagggtggaccccgtagacatgataatttgagcggctgctatgggagatgccttatgtcagtgtcatcttaggcagttatcctcatcctgcctacaccagagaagccttttaaaaatacaagtacttggatcccaccccagagattctgattaaattgatctggggtagcttctaggcagcagtactttgaaatttttttaaagctccccagatgattttaatgagttgccaaggttgagaattactgccttagaagaacagcagtaggattcaaccctagttcaatgttagtatcacaggcttcctgacttgagatgttgaggagaggtttgcatagaccagggtgggaagagcagtggctgggagttggacatagggtaaggaacaaggagagaagacagatacttcttcatggagttcagtttgaattgacagtgggatcggatatcatgacaacttttggctgtgtgtttacacaagcctaactaatgtaagctggaagactgagagcagagtttctcaatgtggctcaaagaccactgggggatccccccaccaccataccccaaagtcagttaggtgatctgcaggtgctttcgcagtttcagaggaaaaatcaatgcagtcattttattcttacgtattttattaattaaaaatcgtgtgaatcattattgttgtaggaatcctgttattaatcatctttaagattatatatatgccaaaaagagtgttaatcactttgtcttggctagtatttggtcagctgagtgcagttcacctcagctgatatatttttccattatctgccattcttattcacaaattttcattgattataggtattctacgccaattccaaaaaatagctcaatggctcagtgttgaagggcaaaagcagagatagaatgaatcgagtaaatattagaattcataaaaatattagaactatagtgactaggaccacagtacagatatagaaatgtatatgttgtggatgagacaaatgattcctttgagtagaatgatttaacacaaacagccaaaaaaggaaaaaataattattactatatgaaattagattttattgaacaaggctgggcgcagtggctaatgcccctaatcccagcagtttgggaggccgacgtgggcagatcacttgaggtcaggagtttgagagcagcctggtaaacatggtgaaaccctatctccactaaaaatacaaaaattagccgggtgtggtggtgtgtgcctgtagtcccaactacttgggaggctgaggcagaagaattacttgaacctgggaagtggaggttgcagtgagttgagattgcgccactgcactccagcgtgggcaacagagtgagactccatctcaaaaaaaaaaaattatcgaacaagcagtccattcagtctcacctcactcactgtgtactgtccttttatcagatggtgacatgaagtcatgaagcttttctattatttttaaacacaaagataaacctattgtttccagaacatatccaaaatagtggtttttcaaagtgagatttgaaaatgttgaatttgagattctacagtgatatcagaaattaggtaaaaatgtcagaggcaatattcagagctctactccacacagagaaaacaaggtacaagtcgcactactattggaaagcttagtaagattagctttgacgttaacgatgagtttaatgtgcagagaaagcagaatagggtattcttcatcagacagatattgtataatatccatggtacacgcatggagaagcagttactctcataggtacatgctagcagagcttttacttcacacttgggcagaaccagtgatgggcagattatcaatcacctcttagcacatgcgcagcacttatgtgaaagggaattgcctgatgagtttttgttcaatgaaaacccacatcgtaagagaagactgctttgtttgatttggttaatgattatattgtgagtcatgaaggagaatgaaaaaggtaagttgggtcagtggcaaccagtaagaaaggacaaaaaggacattgttacatgactcagaagttgcattagaatatggtggacggcagtattttattttcagagagcaggtggtggtctgtactgtgcctgctgacactgtagttgaaaggaattgtgaaaatgtgacaatttcttataaaaatgaagaaaatgggcagcaagtcatgtactggaggcaaaggtgcctcatgaaagattttggaatgtggtatgaattaaaaacatgacactgaacagtgtctctaaaggccatttctattatttaggtggctttctcaaatgatgtgctattttaaggctgaacattaagatttttaatgctaagcacaagaaatcctgttataggtatgtgagggcagagaccatcttctggtttccagctgtatccctagtgccaagcagtgtcaccagtagctactaaatatttgctgaatgaatggatttttattccttagtcaaagaactaatgacatactataggttatgttttaaaacgacatccaaatgctaaaacatgcttgctaactgcaaccaaaagcaggttacacatctatttgttgatttctcttccccgatggaacatttaacccagccttctagctcttgaatttaatatgcccatcaatttatgtttaccataataaacatgaaatcacctcataatttgtaggactatgttggatcggaacatccaaatgtatctgacagaggcaccaaacgagctctacatatgagttaggatgttctaacttagaagaaacaaaaagtaagaaaatgaactacctggaggacaactcaaactgtttgtcattatacatgtaacaagcatgtataaaatgtcagattctatacatactctaaacagtactgtaaacagtatcatcctgctcatagatatgaacctattctttaaaataattttagaattagcatattttattttatttatttttgttttgagacagaatctcattctgtcacccaggctgtcgtgcaatggtataatctcggctcaccacaacctctgcctcccagattcaagcgattctcctacctcagcctcctgagtagctgggactacaggcgtgtgccaccacgcctggctaatttttgtatttttagtagaaacggggtttcgccacattggccaggctggtcttgaactcctgacctcaggttatctgcccaccttggcttcccaaattgctgggattacaagtgtgagccatcaggcctggccgtgttttagtttattatttagaaattgtgggccaggtgcggtggctcacgcctgtaatcccagcagtttgggaggctgaggcgggcggatcacctgaggtcgggagttcgagaccagcctgaccaacgtggagaaaccctgtctctactgaaaatacaagttagccagacgtgatggcgcatgcctgtagtcccagctactcgggagtctgaggcaggagaatcgcttgaacctgggaggtggaggttgtgtgtggtgagccaagattgcgccactgcactccagcctgggcaacaagaacgaaactctgtctcaaaaaataaaaaaaagaaaaagaaattgtggggcatcttgtttttaatttgcctagaactggtggttcgcatgtgggtcaaatgctcattaagcttgataaatgatgacctagaaatagagaaaatatataaattatccttatgtaacctacattatacaaagtcacaggtgtcctcttcttagattctggggtgagactgaaagaatatatataacaaaggacaggcatgctcctattatcagatgtcaccattgaggaaacattagaataagaaccccagcaatgggacttatacgtaggtttcttgcctggggttgctcacaccctatgttctatctactgaggccacaaagcagcttttccaggcatcagctctagggtggaggcacagcagcagagagcttaatggccctgaccacgaatggctgggaatgtgccatgtctgtgcatttgactcaggccacgtgttcatagaccagcatgcacacgtccacacctgctgagtgtctgtactcaggtatagtgttagcacaggtttttttcttcagtgtggcgggtaaggactcaggtataaaagctaggtagtctcagtaaaaataattgggccaaatagctatttactacccatgagatcaaggagacgccagggtaaaagaggcagcagaaggccgggtgcggtggctcacgcctgtaatcccagcactttaggaggctgaggcgggcggatcaccagaggttggtagtttgagaccagcctgaccaacatagagaaaacctgtatctactaaaaatacaaaattagccaggcatggtggtgcatgcctgtaatcccagctactttgaaggctgaggcaggagaatcacttgaacccgggaggcagaggttgtggtaagccgagatcgtgccattgcacttcagcctgggcagcaagagtgaaactccgtcttaaaaaaaaaaaaaaaaaaaaaagcaggtagatgatgaggggtggcatttgtgtaaatgtcgtattacaaagaattggtaaaaagcaatttggttgaagcgactcataggatagattcatagtgcttaaacattaattggcctataagaaataaaaggtagcttgtcattcattatttaagctggtagacacacctctagcatctgaaataaacatggagaggcaaagagttcgctcatggcccaacagacagtactagaagagggtctaaaaggcccaaatttggatcacagcttggccacttaccaggtgcttgtccttggggacgtgacctaacctgtttttgcctcagtttttcgtctataaaatggggctgttgaacttaaaagttctttcctgctctggacatattattgtaagtgaagtactttaaagtttttctaactgctttccaaagctgctctgggctctctgaaaaaatatctttgctcaggacattttcttacatggaaatatcctcacccttctgtctctgtgaagattcagcaacctgaagtcagctcacctagtttcctcaaccatcttttctctatccctctcatcatagagttcgtgttatgttctcttatagcagttcttatgatcgtcatttcttcaaccatgttttaactgctgcgaattcacctcatgtatgttcatcttaaactgcagagccatattgacaacagctttggaaatttccgatttgctttggtaggattaatctccaacgacttaatattcctttcccatctggaaactggatggaataatagcaagatggctgctctggtaggagcgcattttccttgtcttctgggaggagagattgagagtatgttaaaatgtttttcttctcagtgtatctcaccttgtaaatattatttgacttcttaggatgttaaaacaagccattaaaatttatatttctacctatctatcttataaaattacagattgtcttcaagcagagtgagttaacggtatttcaagccaaaccccagtatatgatgcagaacaaggacccaaagtgaggctgaaaggtgaacttgcaagtacaggcttatcatttcatggaatgtgattatttagctattttaaagcagttgcttatctactacaggttacttattgtatggcaaaaatgaaaacacagatctctgtggatccaaaaacattttggaagctatgttaagacatcatttacgttggttttcacgtaagtgctgggctttgaagcattttttatttttttaagacacaggatctcactgcgtacactggcgtaccctggtgtgattatagctcactgcaacctccaactcctgggactaagcaagtctcccagctcagcctgtagctgagctaccacgtctggcctgaagcatttctagttctagtttgaaaaaaaaaaaaaacaaaaacacatttagaaccctggttaattgttacatcgttttgtcttccgattttccgattcctcaatgctgattcttggcctagggtatgtatagtggaaatggtgctaagaatggaggtgctgtgtttatctgtgtctgaaatatctggcgctgtacagatgggggaagtagggagtaaaacctttccagatgtaaacctctgtgttttagcaaaataacgttatggattctatattagtttcctgtgtctgctgtaacaaattaacacgaacttggtgacttaaaacaatggaaatggattctgtcacagttctggagaccagaaggctgaaatcagtacgaccagtaggctaaaatcaaggtggcagcagggccacactccctcctgagattccaggggagaatcttattccttacctcttccagcttctggtggccactgatgttccttggcttgtggccacatcactccagtcttcaaagccaacatcgccaacatctttgctatggactgaatgtttatgtccctcccagagttgatgtgtttaaatcctaactcactgatgtgatgggattaggaggtggggcctttgggaggtgattaggtcatgagggtggagggtggagccctcattaatgctataagtgctttataaaacacactgaggctgggctcggtggcttacaccagtaatctcagcactgtgggaggccaaggcgggcagatcacctgagatcaggagttggagacccgcctggccaacatggtgaaaccctgtctgctgggtgtggtagcgggtgcctgtagtcccagctactcaggaggctgaggcaggagaatggtgtgaacccgggaggcggagcttgcagtgagccaagattgcagcactgtactccagcctgggcgacagagcgagactccatttcaaaaaaaaagaagacctggaagtggaggttgcagtgagctgactgtgccactgcacttcagcctgggcgacagagtgagactctgtctcaaagcaaaaagacacaagagcttgttttccctctctgttctttaccatgtgaggatgcaatgagaaggcagtcatctgcaaaccagaaagagggtcttcaataagaacctgaccgtgctagcatactgatctcacatttccagcctccagaagtgtgagaaataaatttctgtttataagcacccagtctgtggtactttgttctagcagcctgaactaaggtcatcttcaaatctctgtcggcactgtcttcacatccccatgtcctctgtctgccaaatctccctttgcctgcctcttacaaggacatgtgtgattgcatttagggcccatgcagataatctaggataatctgactaactcaagatccttattaacttcattacatctgcaaagacccatgcttgcttttctttttttcccatagaaggtaacattcacagttccaggaattaggatatgaatatcttttggggagctgtttttcagcctttcacagactctatttgttccatatgaatcaagtaagcatcaaggcttactgcctcttatatcttctctcagcctattccatcctggtgtgatctgagttaagggcatgggctttggggtcagctaacctgtgttggaatctcttctgtgctacttacttattctaggtcttgggcatattgcttaagttctttatgcttttgtttgctcatctgtaaatgacaggcactattatactcaagttttctgtaaactaattgataaataaattcagcagacacttatttagggcgtcctatgtactgaacactaaattcttcggctacagtgatgaacaaatagagacagtccctgtcttcaaggggcttatagtctggttggggagatagatagttattaaacaaatattctcaaaaatggagtacgacaaactggtcagtcctgtgtgggaggaatgcagggttagaggaaacactcctggcagggccttggggcaggtgcctctgaggcagtgatgtagaagctgaaacctgaagggcagtggaacgtgagccaggccaggagtaggaagaagggcatattatacaggaggacaggctgtgattggaagcaacttggaactttggaggacccgaaagaagtgttcatggaatttagtgacctatgggaagattggcgtgaaatgagattggcagcatcataagggcgtcagaccaagcagggcctcatataaatctgagcttcattctgagcgtattgggaagcccagcaggtttaagcagtggcaagggtggggacggggtgggcaggtcgtgacctggcttatgttttgacaagattgctcaggtttctggttctagaatgaagcgacaggagtagtggcagtggaatggtgagatgagatgatgtgtggccgcaatccaggcaggagatgaaggtggcttagacctgggtggagagggtgctggtggggaaaattggagagttccaagatatgctctggagaatgcaggacttgagagttttatatggggagatgatgaggaagagggagatgtcaagggtgactcccgagtttctggcagaagccgctggatggatgggtgctccattgactaatgtggggaggacaggaagaggagcagattaggagaaaagattctgagttctctgtacatgtcaggtttaagaagccacttagcacagtgcctgacacagagcacaccataaatagtagattttagtagcttctaattctgtccatttcaaagtcataattgaccgttgagtcaggagacttgggttctagctctggctagtccatgttagataaataaacctcttagggcatcagtgtcctcatctacaaattgggggcagtcagattcggtgctttttgcggtttctttcagcttcagtgtgctgacaatgctatgagattctttggtcttgaccacctggaatccactgtggccagctggatctgcttcagaggggctgatgaaccagaactctgcatatggatggcagtttctggtggaagctgacgtacggggagctctggccaaggcaaattgtggctctcgaggaggcttcatgacgaaggggaaggatgtggtttgagggcagcagcagcagctgctgtcaccaaacaagcatgaaatccactgagcttcagatgacattgcaactgaggatggctgtttattaattggcaaattaatatgatgtgggggcatatggagaaatggtgatgggcagaaaagaagatgaagagagaaacatatactggttctttcctgtgtattcatctgttactgacacagagtcatcattagtgccacaatgagtatcagggatgggtcatctccagttgaactcccttaatttacagattaagcaaccaaggtcaacaacgacttccatgacaacagagccaagctggcactcaggtctcttcacacctggcctgtgctttcctgctccaccaggctgccaggggtggttcccatgagctgttttaggcccatttttggaaaaagagtcatttggtttcatttgtcttagactagatcccagagatgttatttactgttcccaacccccgatataaaaccactgaatgtgcaggccctctcatcagccagtgcttgacgagtagtacacctggtgcagcctggattccacagccatcctccctgtaactgcatgggtcgggtcctccgtgcttctgtaggacctgctcttctgaagcacgttctgcgagtgaaggctgcactacgtctttcatgaggctagacggtgctcttcttgtcctcagagttgtttgttgtttggttggattttaaaaactcaacaacggctttgtttatgaaaagcagcttactaggaaagttgcttcatcctgtgatcgtggctagtttgtgagtgattaaattccctggcctcctctttggaagcaatgaccagtcattctgttggtttattactatttcacaacataggaagcagagcacaccacctctacctaacagtttaacttgaaacacctcatcagagtatgtgagtgagacttcacatgtgcctgttgcatagtaaaaaggacgtttctttcaaagtcactgggctggctgagcaggacccccacagaaaaacagtgttcttgggcctcaggcatacctcagggcgatgctcagggatgtctgagcaatgtcaagcctgttagatgcatggcagggaggatctggagcacagattgatctctcagatgtggggtgaatggggaggtaaatcatcctttaaagggactctttttcaaggctgagaaaccatgtcctgagaaaagggagggctctgtttccagaggccacacgtctggttgacctccttccagtctccttgaacatgctctgttcattactgaaacagcggtttgcctgcgactggtccccacccttgaggatgctcagccagtttccactgcatctccaggttctgcccctcctgcaaggcccaccttaagggccagcgcctccctggaaccttctcccagagtctccgtcctccctgtttttggtttctggattccatccccacttgcaatcacactgcacagttttgcactttgttgcctcatgttgtttcctctgggtggatgtgttgggagagaggataggtggtgcgtgtttgtcctttctcagtggcaaactcactaacttcctaaggacaagaactccgtcttggacttctttatattctctcatagtgttaggcttaattctcgggacaaagtatatgcgcacaaatacttgatcattcactagaaaagagtttcagtgtgttcgtcgagtaataggtttaaaaagacacacataaagtctacatggacttgttttccaaattattttcaaaagcataatggcaagatttaatttggttgtgcgtgacagaacacttgaaataatgacttaggtaagacagaagtttccttctttccccatatgaaacaagggcacaggtagagaggccagggtggagtgggaaccggggctgcttctcgcttctctcctgctgctctaccatcctagcctatgatttctttctctcctctcccctctcttcccctcccctcccctctcctctctctgtttccctcttctttctctttttctcttttttttttttttttttgagacggagtctcgctctgtcacccaggctggagtgcagtggcgtggtctcggctcactgccagctctgcctcctgggttcatgccattctcctgcctcagcctcccgaatagctgggactacaggcgcccaccaccacgcctggctaattttttatatttttagtagagatggggttttgccatgttggctaggctggtctcaaactcctaacctcaggtgatccgcctgcatggcctcccaaagtgttgggattacaggtgcatgccacaacgcccagctaatttttgaatttttagtagagacagggttttgccatgttggccaggctagtcttgaactcctggcctcaagtgatccacccgcctcggcctcccaaagtgctgggattacagacgtgagccaccacgcctggccatagcatatgattttcattctcagggtcaactcatagtacataatagcttttggaaatgcagcaagtgtatgtgtatgcacattgtaggcagcaggaaggaggaaaggaggaagaagaaagagtgaaaggcctgcaccaactgtccttcaaggagctttcccagaagctgctgcagaatactttcgcttgcatcttaccagttcaaacctagtgacacttagctgcaagggaggttggagaatacaggcttcattctagatagccatgtattcagtggaaacttgggggtactgaggaagaagggggaaaatagctggatactcccacacatgggccaatttggatgaaataaggtatgctgaaataactgtctttttagccttatcagaccctttatgaattcctcagtgagccactttttgcatctgctatgttctgtggtaattattagagatagaacagagaaaagactgatatggcctttactctcagaaagatgacaattcagcatggggagacaatacacaggaggacaaataaatgaacgaaataattatgagataatagtaagtactatatgaaaaaagtcacatggtcttggtttaaaaacttttccatttattggctattactcagttgcttattatatgaatgagacattcagtcttcatcaaagctattttggtttctcttttggattgtgccagtaaatctctatgagttttttagaggggaaaaaaatgcgttaaaaattgctttgctggaccattcataagaggatttatttagactggaaagttttacgctgacatttctaaaaagtttatatctgggtatgtttatattaattaaggttttatttatataatatgaatgcacattttcaggagccatttatttaaacatgtaaagaccattaagaaaagtgttgtcagtaatagaagagacttctaatggtatgtgtttaataaagcaatgtaatttataaaatacttagaaaaatattaatgttttatacttttttcccaaggtaggaatttttattttcctgcatttcatacacaacagtataattcagttattttaattttataataggttgctgttagagccagatctgtctttgcaggagagatttttttaaaatgtgagtaaaacaaagagccatcagcaacacttgtgtggctttgatttgatgtactttttaacactccacgctgatttctggagtcttgtactaaaattgcttagggttaaggagctattttatacaatcttcattttacgactccttcattaacacacactcgagtaattttctagtgtctaacactaattttcagctatttaaatccatggtttatcatctcctaactatgatgaagaccagaatctggagaaaaaagggaatctgcattgtttggaatatctttaaataagaaatcctagagaatggttctggattttacatgtagaaacgttaatcaacagcaataaactctgtgctgacgacatatttaaaacaaatgaggacttaggaaaaaacaggaaatttgaccaaacgactctcctagtaacaggttttgtgtgtctttgttaagagcatcgcagcttgttttaattctttttttacttcctttccaaaatttgatgttaagtttcttcacagttttatatacagcttttatttaataaccactcttcacttcaaacgaactgatttctgtaacaggaattacaaatgaaaggaatctgtaatgaaattgaaatgctgcatttcagtccataggcatattggtgttataaattgctgattagtgagtcttttgctaggctagggcttaaactgctttcaagcccacttttaattggtaacattacttggcattttgtagggtggaaatgccttttgcttaccattcttagccttatttttatattcttaatttaaacttgaccctttgttgtcactgtaatgcaagaaaccattcctgtttaatcttggacagctgcatatgtttagagactatatgcataggttctcacagaaatctgacctaaaacagacagatgttggaactcttatgtaaaaatctattctaaacaatctgggctactgctagacaggaatgccaaacatttccaaccgcaaattatacttgataataaccaccttgatagcagaaagcagcagacccctgttccatgacaggatctagaggaaggtaacaggtctttggcattttaactcagatttgctacatttacagagatgagggccattgcaaatggcatcattgtgaaaattagaaactattaatttacgtacagaaattctccgaacacaaaagtctttattctctttttccatgtaaccagaccgtagcaaggagtcactgactgggaagcaggagtcggcctgaagccaggagggccgagcacacaaagagccatgtggctcaagggggagatggacatgcgtgcccttttcaagtttctgaaatcagtgtatttctgaagaatcatttaaataagctcaccagcgtgttttattttgtgaaatgtggggcatgccggttatgaaatggggactctgaaatgtgatacatccatcttaaccagctcagggtttattcaattcttccagccctaatcctattaactctcatgcacaaaggaaatacaggactcctctctgatgattctacccaggcctcctggcatttggaaaccaaactttaaattttacaaatgatgtctactagttcattaaaaactaatcataataatgtttttaataaactaataggctttacatgtaaaatctaaaatttgaaggtagcttcaagcatcaaggaagctacctttcaaaattttagattgtttactttaagaaaaggcattagaagagattgatgatttcaatcagtatatagaattgtaggatttttataaaaacaatttatttgaatatggaaatttttggtgtgaagtacatcaaatataagtctttttcaaaccaaatctttggttttacaaataaagcttattggttgattaaaaatacagccagcatcaatgtaaccagtgttcaaattggattttttagactgtttacttaagggattttgaagagtttggtgactcataatcagtttataaaatgtgaggattttttaatagcagccttatttaaaataagtcaaaatgttggtgtgaaatgcatgaaacttatttctggctgtatgtcatttggacataaatctaacccagcaaaattccaagatctaattatgatgctatgggaagctaatctcattgcagtgaagatgagctaatgacacattagtccatattgtattatatacttttcagtctgctgcctgctattttgattaaatttacttcctaccattcagatttgaaacagcaaagcctttctgttattacctatcaagtttataaagcttttctctgaaattttgaagtgttttagatttccttcacttaacaaaattttatacaacgcttaatgtaaaatcacagaagatttgcatttatcccctttctgtttagaagtacttgctatttccaggtaccaggctgtagtcagcacggcccactctcggccgaggtggcctggaatgtctagtcatttcagtttacgtaacagtttccctggcctgtttgctttcagaggtcacttcagtgtcagcctcagcagtccacgtataagtctgcctgttccacacgattcacagagggaaagaaaatactgtatctgaggcattcttcctactttgcgtagcccatattatttgaatgtacattaaaacagtgataacattcacctcatacactgaagagtagatttgcttttctttctgatttcttattctgtcagactcttttcctgactggaagacacctagttttctagccaggatagctgaatgctccctttgcaaacaccttggcctgaagttagaatgaaactgtagtcagcaccccttatcattcttcagaaagtcttcccagccctgataggatctgttctgattcggaatatcagggaacatttcttggtgaataaacctggcttcttatatactggtgcagtcacttccctgtaacgaggtaatttaagccagttgcctttcatttcaaccatgtcaaagtatcaaataaagctataacttcagaccagccaggaaaatgagaggccggacagagtaacatgtttataatataaatccttcctgttttctcaacccatgctcccctggctgttttccattctgacagaacactctggagatttgcctacagacagtgaccaccaatttaaagatttgttgatgactaagaaaaattccaaagctgcaaatgaacgaatccaatgctgactaaaacaactgaccaaaattactaattcctaggctgctttagcacgaatggtcataacaactgggatagcaggcctgtgtcactcattccctagtaaagcagcttggaggccacaggtgacttcctcttctttccagactgagatgtaccagaaatagtgcagttcaccagtttggggaaggcagttgtctgggagtaatcatacctgcaaatcacttgatctcaaggactgtgcttgctgacttgagaacatctattttcttcaattttagatgtaacacggctaccttgtactcactttgagtctcaccgaattcccgtgcattgagggtccactggaattctttgttcatgggcattttgactgctagtatggatgaggtggtgagaaatggtggcagacacacataatttgtgtgtcccatattttcattttgcaccaagcttctttgctcccatgcatgctccattgctgcatcagatttcacttacaaagcgtaggtccaaagataacattaacaggagtttcaagacagtgacagcagatcattaaaccaagtgtgggatgagtggggccttgtgactacacaggccaatgcagtggaagctccctatgttaccttccctgatttcattcctttccctgcccctctcccagcaaccactataattttctattctcatgtgtatctttattattttacttcatgtgtattcggaatgtatttagtattgcttgccatattttaaaacttaatgtggacagtgtcattaggaacctgcagcttgttttttcctctcaaaacgtttactgtatgtttttggccaggcatgggggctctcgcctataatcccagcactttgggaggccagtgcaggtggatcacttgaggtcaggagttcgagaccagcctggccagcatggtgaaaccccttctctactaaaaatacaaaaattagctgggcatggtggtgtgtacctgtaattccagctacttgggaggctgaggcaagataatccctggaacctgggaggcagaggctgcagtgagccaagactgcgccacttcactcaaacctgggtgacagagcaagactccgtctcaaaaaataaaaataaaaaataaataaaaataaagacatttgctgtatgttttaaaaatttgtccatgttgctgtggcaatagcctttgtgtccagtttaattttatgtgtctgaagttccaagtttttgatcctttaagttgttgactgttagtgaatgccctatttctagcttgggtggggtgcatgtagtgattagcttttgaggctgtatttaaccaaaaatttgtttggagacttgagtcatcaacccttatctgttgtattgagtttccactcagcccattgtctgggcggaatgtgggctggaaaagtttactagtgtctcttggcaatcaattgctgtgggatggcacagcccacatagaatggggttggtaatgttttttgggttagaccatttaccttcaaatgaaattgaattagtgtaaaaggaagcctgtagaaatatagaatcaaagccagatacggctcgtgttacccagaagcagaatgaatgattacttatctgtagaatgtcatctgagtacagcgtatctgctgtgaatctctctccacagatttttcctttaggtaatcattgcccaatctcattatactcattactttttacagtttgtaatattaagtgtgaccctttgataggagtggcattatcaaattgatttctcccctaataggaaagatggaacatgattgggcacttcgtcctcaggcaggagagggaggaatagaagccatgaattttttttttttttttttttttttttttttttttgagaaagagtttcgttcttattgcctaagctggaatgcaatggtgcgatctcggctcactgcaacctccgcctcctgggttcaagcgattctcctgcctcaacctcccaagtagctaggattataggcacacgccaccatgcctggctaattttttgtatttttagtagaaacggggtttcaccatgttagccaggcttgtctcgaactcctgacctcaggtgatctgcccgcctccgcctcccaaagtgttgggattagaggcgtgagccaccgcgcccagctgaagacattaattattttaaaagggaaggggggcagtcaaaacatgaatttttttaaggagaagagtatcgagaattaataataatcattttcatttctagactaccagtctgtctggcagatgctgagtggcttacatacattcaaatcccattcagtcctcacaacaaccccaaatgataggtatttgttttattttataaatgagaagtttagacacaaagttccctcaaggtcccagatttggtgatgggaaggctggtatttgaacccagaggctacagaggcaggactgcacatattccagtaagccaagcttgctgatgctacagtttagcagtgagccagccttgtctcaggcaggggtcaccactggtgcctggtgccaggtgatgactagatgtacgctgtgacatttgcggatagtgaagatataagttggatctgggtcggccaagtgggaaaagtagtaaaatgttagtggttatgtggtttctaaggaagagccagaaaaattaaagtcactatcttttgggtttttatagacctgcctttggcttcaaaggatcgctgccctacttgaggtctgtctgtgtctggctggccttcataagggtgttcgggctgctgccctcctctctctgccctgattggactaggccattgtccgctccctcagcagtaaagtagtgcacatgtgggctgttcctctttctttccactcctttttcagccctcctcctccactcttcctaatgtgggtgtgggcgcaggcgcgactcccagttccattctctgcaaaggtctgtagcctggagggcattctgatgccccaccctgacaccatatttttgagcctgtgtcagcagcctttctactcactcttattatatcctttcatatgaccttgattcaacttgctatctttagctttgctctcttaaccacaggcacaggtaatgccaccactcaagtgatcactttatctacaggcctctgttttaaacatgtcttttatttatcatctacccaggaacctctctggtttgatcacatgattttcagacttcctgacatctgagtgcgggacataccaccctgcgtaatggtggctgattttaatcttcttggccacaataaatctgacacatacctcaagccaatggcatgctcatcttgatattttgatcccatttcctttaccacagagattgtctgattgaagaaagtagctcagcatgtgctgtttttggttttactaatgttggagtgtcagattggcattccagcacacttgaatttctgcaacctcttatcaacttgattgttacagacttaaaagtattttgcctatctgatatttattggtactgaagtttggttaattttttttttcctatcttgcatctcattcatcaaagtaacaagaaatatgggctgggcatggtggttcacgcctgtaatcccagcactttcagaggctgaggccagtggatcacttgagcccaggagtttgaaaccagcctaggcaacatggcaaaaccctgtctctatacaaaatactaaagttaaccaggcatgtttgtgtgtgcttgtagtcccagctactcgggaggctgaggtgggaggatcatctgagcttggggaggtcgaagcagcagtgagccctgattgtgccactgcactccagcctgggcaacagagggagaccctgtctcaaagaagaaaaaaaagacgaaattttcctcctagttttttctagctcagcaagacacctataggaaacatatggttctagagtcagcaaaagtagtgtctagaatttccgtgtcactttcctcccccaggtctttttgggatgagtttttctgggtatatgaataagtgatcctacaagtgaggcgtgtgtttaaaatggatcgatggcagggcgaaccatcacgcactctggcagagatctaaacgggggcagtagtcattcttcagtcgtgtttttcttttggttggttggtttttaaaggtcatctgtctaacccctcattttacagaggcggaaacaggccaagaaaggttgccttacatcgctactcagagaattacatggcaaaaatgggcccaaacccggggctcatgagtgcatgttctcagaacccctaggagggatttcaaaacccaagtcccacatgattctggatcattaactcaacaagcagcagacatgcctctttaaggcaaaagttctatgttccatcagtgagcttctcataccaccgtgtctcctatattcttcagtaaaagactttaatatctaaaactcctttaacctcaaatcctgttatccccaaatgaggcaataacttactcggtgagatgtgtgcaccatcctgctcagtttgtgaatgcttcattacatttatatggatggtatattttccaagagctagataaaatatttcctcttctcaagtagctgcctactcatttggaaagaaaagacgtgaaagatgaacaaacagccattaagtgcaatcattggtgccttaaaactttaaggaaaataaaaatcactggaagtcggggcagtcacgggaggcatccagagagctttctcactcacaagagggttaaggtctttactggcaggttaagtagccaggcaggaagatttgtcaaagaggaacccagagtccaggagaggcaataaggaaaggaaatatatccaggggcagtgaagtataacacaaataaataggttgaggcggatagcagaggagccgatgatccaaagagaaggcaacaaggaaagggtggggaaaggatatgaggggaaaaaaaacagggaggaaaaaactgaaaatgaatcacctaattaatgggtgggaatactggctgatggtttccaggggcattgtttctagtccagttatctgtcagaaatgctttggattcatggccaaaggaaatttaggagaaacctcccagataaaatacttgaatgctttccccaagcttctatttttacttgtcttacttcaaagactacgaaagacagtgttataccttttgaccaagaatataatttgaaagtcctgattccagaattctttggaattaacaaatatgtggtgtggtccttatcttattatgttgggaagcacctgacatctttggagccagagcataacttgataaataacagttgcatgagtggttaggagataactctgagaaggagctggggactttgcacagattcaaagaagagacagaagagggaaactgctgccttcacatcatttctcccttcctttgtatctggtttattcatgagaaattatgaatcaacctgaagaatctgagcagttatttgtagaccttaaagaacaaatttagtttcctttggtttattatgtttacatatttaatatattgattgaacaaagagtgaccgaatgcttaatattttttcaagcaacttctttgatatgatattgtcttattctttgtttcatcaagatgctatacaaattttcaggtagtagaagtttcagtaaatgatatatattgctgacatgtttagtcaagttatagccactacacacagtaaagtgagaagattatacatcttctctcaatggaggatgaataaactattagtagtttattgagtacattcctttttgtgtatacctgggatgtatacacacaaaaaaggaagaatgataggaaacatgtaaagtatattagaaataactatgttttattttgtgatcatggagaaatatgggttcactttaatattgaattgaaaaaataaaaatgtgattagaaatttttgtatttaatgagtcattagatatgattataaatttttcaaaaagcattatacagttctccaatgttatataccaggcagcactgtgagtgttctcaaaggcattgctcagtctccactcccttttttaatccaggaaaagtactaatgatttaatatttttctacaagaatatcccactttcagaggtttttattattttttaaagagaaagttggttacaaacagcatctaaaagaacattcctttaaaaaaaaagccacaggaaaatcgagttatttttataatgataatactttatacagatctgtggtctttcatctaagaactttcaagcacttttgaaatgttgactcatcaatccgtgacacacttagcagattgggcagtaattctgcttccatttggtttcaaagaactcactgtgtcctaaggtatgcggatgctttttttaaaagaattattgttttgatttcttccctttttctttttttaaattttattttattttttatttcttgttaaaggccagaagaaatatggcttggtcccaacccactaggaactcagtgtgatgaaggcaggagccacagaaaagttcttccaattcccaataacacatgctacgactcaaaaaccagagacggaaatctctacatattttgaacagtccagaaaggcattcagaagatttgagccttaaattattccaagatacagaaggcagacttgctttgctgaattgacattttaatcagtatttccttatttattttttaacaaggcaactatattatttataatatcctgccaaacatgaatgcatgcctttcacctgtgtaaggggctcaaggatggattcttggctgaagaattcctctggaaatatttcccaggccaaaggtgggaaaataggctgccagtaattggaagttttatgaagtatgcattaagattttatttattaatagtctcaagatttagccttatctttccaattttctttgataggtaaaatcagtagcctttctgctaccctttagggtgttaaagcagtgagttgtgttgggggttatttttcaacccagggtccatgttttttcacccacatgatttttaattacttcacttccagttaaagaatggtatgaaagtactgtttatatgtcttgttaaaataaaaacttagacaaattaaatttaacagagtttaattgagcaagaaaaaaaaaaaaaaaaaaaaaaaaagactcatgaaatcaggcagctcccagagtcaaaatggattcagagacttgggctgccacatggtcagataagatttatggaccagaaaaaggaaagtgatacacagaaaacagaagtaaggtagagaaacagctgaattggtttatacctcgacctttgccttatttgaagacagtttgaatagttggccacctgtgagtggttgaagtaaggctggagtggttggctgagccattgttatagaagcacactcctcagttacgttttcagtttgttatgtactaagattgtagttcatttctaagaactgaagtaggtgagtacgtatgctttctcaggctaaattttagtttgatttcagaattccacctgtttggtcggcctctcagttttgagagattaacctaaattctgagcatgggcaccactctcattacagttgtaaatgactcctttgttctgagtatggaattcacagatgacaatgtgaaactagctgaataattctttcttacttacctagttgaagtgagaccattcaacactcaatagatagctgcatacaaaacatttaagacgtgagaagacacaaggcaccagagttactattatgatgacttccaagaggatgatatcaaaagagcaaggagttcacaagcattcttatgaaacaaaccaaaccaaatgaaacaagtcacaattgaggcaatataggcagttcaacagtatttgagtctaattggtcatagtccttgttcagggtctgatggtgattaaggaccacagttgcttgtataatggcctgattgaaagaggtattcattttcattgttagcctggtaacacaagtcataataacccggagacatacctagaatatatttaaagatgacaaaaccttggaaaacccaagcttgccatccaccattgaggatgcctgcagaccaactgttagttgctctcataaacacatcagttgctttttcttttcttttcttttttttttttttggagatggagtctcgctttatcccccaggctggagtgcaatggcgcgatcttggctcactgcaagctccacctcctgggttcacaccattcttctgcctcagcctcccgagtagctgggactacaggcacccgccaccacacctggctaattttttgtatttttagtagagacgaggtttcaccgtgttagccaggttggtctcgatctcctgacctcgtgatctgcctgccttggcctcccaaagtgctgggattacaggcgtgaaccactgcacctagccgtgttcccttcttttaggagattaatttccttagtatgtttggtggcagtatctaaggctaccttttaaattaagccttctgtagtaacaaaatcaggggagagatactcagttttcctcagtaccaaatataagcccccaactagagcaaaaaggagccctaaagttgcatgatgttccattaagtgttttggttgaatgcatatattgttatccacctttcagagagggacatctacccatctgaacccctgggaggtctgactgtctacaaaatccaagatttttcccaatttacagattatctttaaattctatacaactgataccccactactgccaaaagtgagcccccaggagccccaccggagtttcttcttagttgaaaatagtttatctattttaaggttgggggtaatttcagttattgattattttggcctctgatcctaggagctgttatgggaatttgtaggggaagctatttgaatggccggagtgagccaggctaaatagcaacatccaaaccagacaggaagcagattttcctcagacccaatagaagcccatggggattggaaaagagggttacctagttgcatttgtgcaagggtcagttaaatttatttgtctgtaaatctgcatagctcctgaacaaagttcagtgggtaatgtacttttttgggttcgtttatagcatgcggtaagggtgtatagccacatttagtaaaaaaatgaccctactggatttttttttcttttctttttttttttttttgagacagttttgctgtgtcgcccaggctggagtgcagtggtgcgatctcggcttactgcaacctctgcctctgggctcaagcgattctctgccccaggctctggagtaactgggactacaggcgcccagcaccatacctggctaacttttgtatttttagtagagacagggtttcaccatgttggccaggctggtctggaactcctgacctcaagtgatctgcccaccttggcctcctaaagtgctagaattacaggcatgagccactgttcccaacctcctactggatttaatctggtaacattatacaagcaattacttgtatccatatagctaattcccaggtctcaagtgcgtgatgtctagaagcacaatataccttttgcaggcatcacttggataggttttctatgtttggtaacaaccaggttattcattggaaaagttaaagtgctgtttctagcgagtgcaggaaagcaaatgaagcagtcatttttagaatatcaaggataggtttccactccctcctcctttggagtttgaatcactgccattgggaacatggagaggcatcaatggaattgttttctgattttttggcatttgcccacaaacccaacagttactctggttttgtgctagaacataaggtagagctaatgccatctagtgattatggtcccatggattttcctgtaggaaaaaggaaagtattgggataaaagattagaggaaaaaagcaaaaagcacaaggctttcataatggcagaaaagtcttgatctgtgatcttgggaaagctgtccgcatctaggatgctgtccactttcggggagaagtattcctggtcagctttaccttaaagtctccaacaggtgttctaagagtctgaaggggcccttttgtgttgtgagatgtggacccaaggttacaggtgtgggtgtgagaagaacttggtgtggtcctttccaacagggttcaagggcagtcttcctctgatgttatttcccgaagacccaatttccaggctctagaccatgaaggatttgattgtacttagtcagtggatcacaaaaagcttcctgtacctggtaaaaatacactttggcataatgcattaaaaccttgcgttatttagtcatatcagagtttaggagagtggaacatccattaggttctactattaggggcatacgtttccagtgactatttcataaggggccaacttatgttttccagtgggagtggatctgattgccatttaatgccaacagtagtacctttggccaagacaacccaattggctcagctaactttgccaatttcagttttaagataccatttgttctttcagcctttctgtaactgcccagtgggttccccttgcccactgcctagacagagctgatttatcaagacaggggaattgcaatagagaaagagtaattcacgcagagctggctttgtgggagaccggagttttattattactcaaatcagtttcctcagcattcgaggatcagagtttttaagggtaattgggtgggtggaagaactcagctgtcttcttgtgctgagtcagttcctgggtggggaccacaagatcagatgagccagtttatcaatctgggtggtgacagctgatccagggtctgcaaaatatctcaagcactgatcttaggagcagtttagggagggttggaatcttgtagcctccagctgtatgactcctaaactacaatttctaatcttcaggctaatttattagtcctaaaaaggccgtctagtacccaggcaagaaggaggtttgttttgggaaagggttgttagcatctttgttttaaactataaactaagtaattcccaaagttagttcagcatatgtgcaggaatgaacaaggacagcttggaggttagaaacaagatggagttggttagctcagatctctttcactgtctcagttataattttgcaagtgtggtttcatttccagaagactgagggtgataaaggcaatggtagtatcactgcatccacaacaccttatttaactgcttttaacttacccagtaaaatgagtttccctatctatagctggagatttctccaggaataccccataaaggaaaaacattttctaataatttcttagctgctggcacagcaccagcttttctacaaagaaagactcgatttgaccagaaaacatacaaactattacaaaaactgatacctcagcaagggcgataactgaataaagtccatttgtaaatgttcaaatggtccatcagatggtggaaatatactatctgaagtttttattgttttcctcggattatgagtttggtaaatcaaacattggttgtaacccattttagcagttttggaacatatacctcaccaattttttttataatttggatcattttgtgtgttccatgatgagttgtggagtgcaggccttttaacaacggaagctttaaagactcaggaaggaccaagtggttgtcaggccctttgtgaatccacgcttaacattgaatttacatttttttagataccaactttgtttttccaaattaaatgcattgcactgtttattaaatagatcaccgtatgggagttgatttggatcagtcttatggagttcattcagattgcatattctcacagtgtcagcactagctgatttaacatgcacatcggctagggcattcctttgatattcagattcagttttacaggtatcatcttcaatcttaatcataacgatctgtgatgataacagtgttaacaggatagctgaaaggagttcatctaactggagtcccaatagaagtgagaaacccctattgtttattttttaataatgtaatttttattatgcatatttgtctttttttttctttttctttttctttttttcttttctttttttttttttagacagggtctctctctgttgcccaggctggagtgccatggcgtgaccatggctcactgcagcgtcgacctcccaggctcaacccatcctcccacctcagcccccagagtagctgggactacaggcgcaagtcaccatgccaagataatttgtagagaaggggttttgccatgttgcccaggctggttttgaacttctgggctcaagcagtctgcctgccttggcatcccaaagtgttgggattacaggcatgagccatcgcacctggtcccattgtttccataatgtgccaaaattgtgtactactctaaaagcatatctgctatctttttaaatatttactgacgtgtccttaactatatgacaagcttgggtgggagcaaaaagctctgccagctgagcggacttaaattgaggaagagttcccttctctattaactcattttgggcagtaacaacataccctgcctgatattttccttctgagactttggcataggacccacgaacaaaaagtatcaactcaggattatccaatggagcatctcataaatcaacacaaggggctactagtttggatactacacctacacaattgtgatctttaccacagtcagtcagaggtaatggagtagcagggttaagtaggttttagatggagtagcattttagatggaggtcagaaggaggcaggagaaaatttcataagatcataagatgttagttttcttgctgaaaaatgctgagcttggttggaatttaatagactttccacagcatgtggaatttgcaaattaagttcattccctaaaaccagctcagatgaaacttgtagcaacttggtggctgctgctgcttctattttttttttttttttaagacacaggatctgtcttaggcttcctttagtggtgaaacagtgtggcctaatgggaggaggcttattggtagactaacagagaagcagacaactcttttccagtgtcctgcttatttgcaaggaaggcagacatctcggggaaaagaatttcttgttctaggatctatctcttggttgtgatttaaaataaaaaagaaggttcctttggtctcagcccctgtaactgttgtaattggtgagacataagcttggtagtcttttgggttttttcttgctccagagtcctctcaaaatgttcagctaaggccaccaattcagtcatgtctgtaacttcccatccaggtttatgtttttttaattaaactgctaagtttgggacagagtccatttataaatagagtagttgatgcagttcctgcaggaaatattccttgctgttattttgagccccaaatgcttcacaagcagtgtttctaagtgagttctgtcgtccgaaacttcttttgtctgtatggtggaccagtcaatttttttgtgtggaaaaatcttaggaattgaatctaaaatgattttggcaatgtttctagcttatttcagccattcctgtgagggggttttggaggggtctttaataccctcctcaggttggctccattctgcagctgtcactcattttcaagcttccacaggtcccagtatcatgtgaataaactggtaaaggtcagggagtcctggattgtaagctcttatgagtaaatttttgaggacttccccttgggctagggagtcctttactatggctctaagctcagctttagaacatggagtgaaggtggttatggcgggaaggcctggctgatcacaagctcttactttgtaagacatctgtccaacttctcttttttcgtcatctttaaagggtgaaagggtaatttgactagaagattagtggagcaaattatttaggtagagatgggtaaagagaggaaacagggttatttcagagtacagtcctctttcgtcatgttcttagtctgttgtttaaaatgtttgcttgctttttgcaaagaatcatttaaggaggcaatttttaatttgtttagccttttagatgccttgcataccaattaaagaacacatctcattgttttgtggggtttttaaaatccccttttttctaatacgcctcccaactaaacaatcttatccaaaataaaacttaactattggctgggtggggtggctcacgcctgtaatcccagcactttgggaggccaaggcaggtggatcacttgaggtcaggagttcaagaccagcctggctagtatgttgaaacccagtctctactaaaaatacaaaaattagctggatgtggtggtgggagcctgtaatcccagctcctggggaggctgaggcaggagaatctcttgaacgcagaaggcggaagttgcagtgagccaagattgtgccattgcattccagcctgggcgtcgcgagactccgtctcaaaaaaacaaagcaaaacaaaaaacagaaaataaaaaccaaacttccctattgtggtcatcttaattctaagttgtctccagaaaggttaacccgtttttccaaaaatacgtacattgtggacccataatttttacggataaatttagctggagtctcagaagctacagtctctgattctttggattgatatgaacacattatcaaaaagttacttatctgaagtctggggcttctaaattcaatctgatgctatacccagtgcagtataaatactgcttacatcaactcagggagctgagaacacaagtcagtggagcttgggatttgagagaaaactcacccacaaacctccagttacaaacaagagagcgcacacaattggctctgcaggtgccccgcttcgttgcctgctgttccaaggagtcactggaattgtacttcactcttcacttctactccagatctgatgaaagaaaaactttagacacatttaacagagtttaattgagcaaggaaaaaaatgatttgcaaatcgaacagccttcagaatcaaaacagattcagagaaactttggggctaccacatgagcagataagatttatggaccaaaaaaagaaaaaggaaaatgaggtacataaacagctggactggttccagcttgactttgccagtatgttaagggagtttgaacagttggctgcctgtcaatggttgaagtgtggctagagtgatgggctgaggctcagcttttgttacagaagaaactcctcaggttttcagtttgttacacactaagttaagttacaattcagactgaagaactcaaggaagcaagtattaataccaaggctttctcagaacaaattttagttggatttaacagtatagatcatgatgtattagagtaataaagttctaagaataagtacctctaagtatcagaaaaatatatttctctcatctaacataagtttattcttatgagacagtttcagttgatggcagaggatgttagtttaaaatgttaaacataagttgagggttgacctagagatctgagaaattgtatctgacatactgaagaccatgtgaagaggatgagccaggagaccacacagaatggtgggtattgtgggacctccatccccgtcaatattctgaaaactgggacccagagcaaacttctggccaccccttgatccatcaggactagaccccaagatagagtttcctcatgggttgcttctaccttgacatttcacgaggggcatccctgcttcatgcgcacctgccttggaaggcagagagctgcttggacctgccctctgggtgtctgtcctcatcagcacaaagaagccccaatccgaagcctttgccctcctgattctgagacagatggcgagaagaagaaaccattaaattccttctaatagccctgtttactttttcctttgtctcagattgttccttgatatcagtgggtacaattgttaacaaaaaacaattaagggtgcttacgtgagactttgaaattcaaacccaagatagctattctaccagctaaggaatgagtttgtacggaattggcctgtggtacctcagtgagactaggaaagttgaaaatgagatgctgttagccagtaaggatgttctgaccaaatagacattaaggctaacttggcataatcacaaacatgaaacactaccaccaggaaagacttgggatataaagaggctgtacagcacagtgcacaggctctggagcaggaccgcagggtgccaaccccagacccccagacctgctacgagttaactgtgtgatagaagttacgtaacctccccaaacttcagtttcgtcatccaaaaagtggggatgatattactaccatacctatctcacagcgttgttaagatgaagcgagtaaatgcatgtatagctcttaaatcaggcactggccgggcgcggtggctcacgcctgtaatcccagcactttgggaggccgaggcgggcggatcacgaggtcaggagatcgagaccatcctggccaacatggtgaaacccgtctctattaaaaatataaaaattagctgggcgtggtggcgggcgcctgtagtcccagctactcgggaggctgaggcaggagaatggcgtgaacccgggaggcggagcttgcagtgagccgagatcgcaccactgcactccagcctgggcgacagagcgagactccgtctcaaaaaaaaaaaaaaaaaaatcagacactggtgcaaagtgctatattaacatttgtgcttgccgcatgcagtggctcacgcctgtaatcccagcacttggagaggatgaggagggtggatcacttgaacccaggacttatagactagcctaggcaacatggaggaaccccatctctacaaaacatacaaaaattagccaggcacagtgatgtgtacctgtagtcctagctacttggtaggctgaagtgggaggatcgcttgagcctgggaagttgaggctatagtgagccaagatcatacaactgcactgcagcctgggtgacagagtgagatcctgtctcaaaaaaaaaaaaaaaaaaaaaaaaaaaaaaaaaaaaaaaaaagacattgtgctagcattattattttgtactgaaaaatacaaatatatcctatattagttatttactgaatgcacgtggctaaagggaaaaagcatggaggaatacacacaggaagtttttatcagccaggcctggtgctggctggtgtcactcctactcgcattcctcagctagaactcacatggccacagctaactgcaggggaagctgggacatgtagcctaacactttgagcccaggaacaagaggagaatgtgaattttgctgagtagtcttcatcaagccaaaacccatccataagtgcctacatggttttgcattcttgggttaagaaccactggaatagacagatcaagtagataaaatacatgtatagtaatcatattttgctagcagaattggagtgtgtggcctaaacattattttttctgatttacaaaagctttctgtatgaaaagtattataaaataataaaaattaaattaatttggttgtatatttaaagagttgcctttattgaaaaggatataattgtatgaaatcagggcagtgccagaagatcgcagagttctctgttcagtaacgaacaactgacccaccattgtaaaatccatatttactctcttggttcagtggccaggattagtatcagtatgacctgaggttagtagagtactacaaaaaaggtgttggtaaaattaaaaccacaaagctttgtggacaatggagaggtctgtatggaacccaagggtgaaagcaatagaaaattgatgaaaaagctagcccaaaggagaagcagaagccagggcatctgtcaggtgctgggcagtgaaatttcctagctactttctaaagtacacaaagaaaatagagccagggaccaggtgtgctgtgttgggtgtgtgaacattcctgagacgtccataagctgatttataaaaacttagtcttaatgctttagaaaagatacctatataattacgcctacagaaaaggttaaaaaatcctttttattcatgtggttttataagcctaagcatttaccaatgttcttgaagaagattgtcacactagtttatgttacatatttaagaaggcaaacttgtgataatttttaaaattcagaatataaatggctcactatgaatttttttcttttcaaattttttgcaacaaacatattagtttctgagttagcattaagaaaaataaaaagataatattatgcaagattttcttagaaaaagtgtttagactgatttcctacagtttgattgttttctgttactttgcattcttgaattgttgtggaacagtgcagtcacattttatgcaaggtttgtacaacattttaaattaagctcataagtctaaaaatcccaatagttgcaatcatcctgaaaattctttaaagtacccacaatatatactatatatgggtttgtatatataaatctgttgcttaatatgaatgtgtaatatagattaaaatacagttatatatgggtttgtatatataaatctgttgcttagtatgaatgggtaatatagattaaaatacagtccataatgaaatatacatgccaagtgttgtttcatggtactatttaaattattagtctctgtttcattattatgagtgggcgtagtttaactcatgtcaggtaaggctaggtatagtagctcatgcctgtaatcccagcactttgggaggccaaggtgagtggatcccttgagctcaggagttcgagaccagcctaggaaacaaagtgagaccccccccgtctctacaaaaaattaaaaaaaaattagtcaagtatggtggcatgcacctgtagtcccagctacttggggagctgaggtgggaggatggcttgagcctgggaggcagaggttacagtgagctaagattgcaccattgcactccagcctaggcgacagagccagaccctgtctccaaaataataataataataataataataattcatgtaagttaaattcacacaggatggaattccatggtataatggcataagcattgtacttgagttggaagtcctggtattttatgacctgggacaagtcatttgacctttccaagccttacctctgatgcctgtaagatggggcttctactacttacttcttaagttggattaaagatgaagtgaaatgacataaactctaaagtgctaaacctatcaagaggctgctactagattgagagtgttgggagggcaggtaccatgtcagtgttactgctattgcattttcataagtttttgctggaagtcacattggaagaccaaatcagtgagataactcggtcctctctttcctgtccacgggcagacaggacagatagacctgtgcacagagtggtgtcaacatatctgaagtaatgaaagcaaattaggctttttttttctgaaacttcagtccatacagagaaactagggctgcgcatgtttaagtgaaacaagcctctacagaaattcagtgtaaacactggaaatttccttcattaggcagtgagcagtgggttttattgggaaaggatttgtcatgttgaaagctatccaagtataaggccattgtttgctttgactattgaaaatatgtttgttcactaaactttcacctttttatccaatattacatcttaaaaagaggattattttaattatagtagcacctaactaatttgataagtgacaagtcaaggagtgaaaatgaaaataagcgagaaaatctctccataacagctgaggtgactgtgtcaaccaattatagttttattctcttctccacaaaatgagactttaaacattttgtccatagtgacctcaagtgatgtgaatccaaggaataaattgagatggaatcatgaagaaccttaccgtgtgtgtgtgtgtgtgtgtgtgtgtgtgtgtgtgtgtactttttattttgaaataattatagagtcacagaaagttgcaaagacctgtacaaggagggcctatgtacccatcagtcagccttccatagtgttaacatcttgtataaccacaatacagtatcaaaaccagcaaattcacattggtgtaatccacaatttattcagatttcagcagttatgttgtagtcttgtcaatgtatcaagatgtactagtctgtcgttgtctgagatggtacctggagttctttgtctcacatctaagagaattaaggagtgtggacacaagggtggagtgaaactttaataagtcaaagaaagttttttgtagtggaaggtgaggcctgaatgggttgtcccctatgaggttggggtctagggtttttatggactgggaaggggaaggaacgtgtttagtccttagttctcttggacatgagtaaagggactactatctcagacaacaagagactattacatcttggtacactgatgagactacaacagttatacatgcattattttctctctgcatgtgtacgtgtatagttctaggtgattttatcatgcatgaagctgccaccaccacatgtaaccaccaccacatgactgtggtataccattgcctcaaggctccctcatataacttgcttagagctctagcggcggcttcctctcccctgcccctcgaaacctctcctctgttctcctttttgcagtggcgtgatctcagctcactgcaacctctgtctcctgggctcaagcgattctcctgcctcagcctcctgagtagctggtattacaggtgcccaccaccacgcccggctaatttttgtatttttagtagagatggggtttcaccatgttggccaggctggtctcaaactcctgacctcaagtgatccacccgccttggcctcccaaagtgctatatctttttaaaattagtctttttcactcagcataatttttttgagattaattcaatctactgtatgtatcaaaagtttgttcctttttactgctgagtagaatttcatggtatgaatataccacagtttgtttaaccattcaccaccaaagacatttggacaattttccctatttggatgttacaaataaaactgttatgaacattcatgtgcaagtttctttttgttgttgtttgtttttggagatggagtcttgctctatcacccaggctggagtgcagtggtaccatcatagctcactgcagcctcgacctcctggggtcaagtgatcctcccaccttggcctcccaaagtgctaggattacaggtgtgagccaccgcacctggtcatcatgtacaaatttctgcatgaaaataatttttcagttctctagataaatacccaagacagttcaattgtgggtcatatggtaagccccttttcagtttaaaactatttctcaaagaaatgtgccgttttacatttcttctagcagtgtatgagtgattcagtctttccacatcgtcaccatcatttagtgttaccactttgtaattttagccaatcagataggtatgtagtggtaccacattgtggttttaattcacatttctataatggctaattatgttgaatatttttatgtgcttaagtgccatctgtatatcctctttgaagtatctgtgcatatcttttgcccatgttctaattgtattacttgatttttttttttttttttgatacagagtctcactctgtcgaccaggctggagtgcagtggtgtgatggtcttggctcactgcaacctctgcctctcaggttcaagcaattctcctgcctcagcctcccgagtagctgggactacaggtgcgcaccactatgcctggctaatttttgtggtttttttgtttttttttgaaacggagccttgctctgtcacccaggctggagcgcagtggcatgatctcggctaactgcaacctccgcctcctgggttcaagcaattctcctgcctcagccttccaagtagctgggattacaggctcctgctccccacacatattggtcaggctggtcttgaactcctgacctcaggtgatccacccgcctcagcctcccaaagtgctgggattacaggcatgagccactatgcctggctgtattatttgatttttaatatgcagttttgagagttttcattttcagtgatttgtgttctaatctttactatttccttccttctgtttgctgtgggtttattctgctctttttaaaaaattgtttgtagatctttcctttttttctaatgtcagcagttctatacattcgcttctccacattgctttagctgcatcccacaaactttggttttttcattcagttctgtgtatttttaaatttttgacactctttgatccatgcattattatgtgttattgtttaatttccaagtgtttggagattttctattgatttctttctagtttcattccattaaggccagagaatatattctctatgatttgaattattttaaatttgttaatatttgttttgtgactcagggcctgttgtggtgaatgttccatgggtgcttgaaaagaatatgtattctactgttgttgggtagagccttctttaaatgccaatttgatcttgttggttgatggtcagcttttctagatccttgctgattttctgtcaagtagttctatgaattgctgaaagcagggtactgaaataaccaactacaattgtagattgccggtttctccttttagctttatcagtttctacctcatgtacttttaagctcttgtttagtgcatacacatttaggatagctatagcttcttggcagagagtaatgtttgtcttttttacttttctttgctcagaagtctacttagtctactttatctgatagtaatatagccactcctgcttttttggattaatatttgcatgatatatctttttctatcctgtcactttcaacctacctatgttgttacgcttgaagtgaatttcttacagtttcttctatagttgggttgggttttacttttaaattggcatatttaggccatttatatttaatgtaattatgatatgctagggcttaagttagccattttatttttattttatgcttgttttgttattcttctgtttcttttatcttgcttttcattttgatttttttagcatattgcattttacagatttttttagtggttctttcatgcaataccatatacatatgtaacttatggcagcctactgtttttgacattttaccccttaaagggaaatgcagaactcttccatttagatacctttaccctcctcacttctgaaatatattttgtcttaggtgtttcctctagatacattgtgtgtcatattaggtagtgttataacttttgttcaaccataaaataagatttttaaaacccataaggtgaagaataggctattacatttttactcattcttttcttctttcctttctgaatgtcccaaccttcttctgttattatttcctttttgttaagaagagcttcctttaactattctttaaaggtgggtctgctagcaacaatttctcttaatcctttatcttagaatgtctttatttccccattatttctgaaaggatttagggttgatatttctttcagcacttgaaaaatattatgcatcttccttttggcctccatagtttcagatgggacaaccactgtctttcaaattagtatttacttatagataatgtgtaatttccctgtgttttcaagattttttttctttgtcttttgttttcagaagtttaatcctaatttatcttggcatgggtttctttgggtttatcctatttgggacttactcagcttcttgaaactgtaggtttatgtcttttgccaaacttgagaagttttcaaatctactcccttcctcctctctttctgagacctttatgatatgaatttagatcttttattattttcccacagaaccctgaagcagtgttcatttttttctattttctcactgttgttcaaattgagtaaattttattgatctgctgtcagattcattgattctatctccactatgctatcaagttcactcaaaacacccagaagttggctacatagagctcgctggaagaagcaggcccagaaaggggcagattaagagacagacatgttagtgacagccataaattctctgagtggagcaagaaggaagagtgagggctgaggatagtttctgtgagatggcctcatttggagggtgaagagaaaagaaaccatggagcaggtgctgacttctgtgtagagtgaaggtgctattgtcctgttgtcatttggctaactagaatgttttatgctgttttctttttctttctattattttttaaagagggagggtcttgctctgtcactgagcctggagtgtattggtaccagaatggctcactggagtcttgaactcctaggctcaagcaatcctcctgcctcagcctgtcaagtaggtaggactagagatacaggccacgtcacctgactaattgtttcttgctaggttgcccaggcttgtcttgaacacctgacctcaagcaatcttcccacttcagcctcccaaagtgctgggattccaggggttagctacctcacttggatgttttatgctattttcttgatatagtgcctctctctgctttgtataatcaaatatatgacagaatgattgcattttttaagccttgagaagacccttatagaaaactgagacctagagtgtgaaattacttcactaaggtcacaagactgtgacgtggtagaatggcaactgaactctagagtattattttctcttagcttttctcttgttgctccagcagtcatttattgaacacccttttgggtgcattataggatagaagggaacataagacactcaagttgcttatagttttaccgggaagataaagacacaggaaatagccaggtagcagtgtaaggcccattggatggcatgcagaatgagtctagtcagtgagggcacgggaggagtgaaggaggggtcaggaagggcaggtggcctggtttcatggatgagtccagactcgagcctgaaaaggtaagtataaaatgaggaaatgagaagacatttgagaaaaagaggtatataagccaggtttttaacaacctacatgtcaaatcctgttctttcttattggctcattttgccatgcatccctataaaactaatgatttagtagtcagtcttgtgcttgtgtgaggagaggctttccagagccagttaacctcagaaacataaacccattgaatacagacagcattcattcattcagcctacctttactgaacaacagctatgtaccaaatacaataccaggtgttagagttagaaaatgaacaagacaggtctctttctcttaagaaaccaataatacagaaataacattattctcttcttagaaagaaaaatgtaaaatgtgtaattgtctgctttataaactgacagttcatggaacatttgtagaaattaatcacattggaagacttgctaaaaatgtcaatcagttcctcaaaagtagaaataagactatctttggtcacaatgcagtaaggtaataaaatgaggaaataataaaagaagaacaatttatccctcttctactaaaacctctctgaacttttgggtcaaagaataaattaaccccaaaatgcagaatatctagaaaacaatatatagctcaatctatggaatgccaccaaaattgttcttgatgaaaaatgtatagtctaacatcacttctgaggttagaaaacaacaataaaatcaacctacagaatgcaaaagaaagaaagatcaaagcagatatgaattaattagaagatatgagagaaaaaccagaattgacaaatacaaaagttgatttattgccaaaaccaataaaacagagataacattggctaactgcattaagaggggaaagagaaaaactcactaatccagaggattagaaatcataagtgacaaatagtaacagatgcagaggaaattaaaagaatcatatatagtactttgtgaacttttcagcaaagaattttgacaatctgactgaaataaatgattttctaagaacatatgagtcaccaaaaattgataccgaatgaattattagacaacctaagtaaacaatacccatggaagaaagttagcaaagaatttttcctggaaaaacaccagacccacagagtttctttcataagtgaatttgctcaaaatttcaataaacaggtcagttctaactgtaaagatattttcatagaaaggaaggctttcaaattatgtttatgaccagcaaaatactaatgccataacctgacaagttagacagaacaataacatactataagctactcttatttgtaaatatcaatgtaaaaataacaaacaacatacataactcaataacatatcaaaagcatgataaacccaaactagatgggttttatcctaaaagtgtaaggatggttccatcttaagaaatgtgttaggaaaacttatatttataggtcaaatatgtcaaaactcagtagttgcaaataaggcagttagcaaaattcaataatatttctaataaatacttctagagaaaataggacgaagtgatatttctttaatgttatgtaaactctctctctgtgtgtttgtgtgtgtgtgtatttgtaatcaaaaggcagcatgaggctggatgtggtggctcacacatgtaatcccagcacattggaaggccgaggcaggaggattgcttgagtctgggagtttgagagtagcctgggcaacatagcaacacagtgaaacctcatctctactaaaaaaaaataaaataaaataaaaaaaaaaaatagctgggcatggtggtgtgcacctgtagtcccagctgctcaggaagctgaggtagaaggattgcttgaacctggaaagtcaaggctaaagtgagctgtggtcatgccactgcactccagcctaggtgacagagcaagaccctgtctcacacacacaaaaaggaaaaaaaaaaaaaaaaagctagcattatattagtaatgaaacaacaaaagaaaattctatttaaagttaagattaaaacaagacaaggtacctaccatcaccatcactatgtaataatatttggattctagactcatggttagtaaactacctgtaagccaagtgcctgcttttttcttttttcttttttttgagacagagtctccctctgtcacccaggttggagtgcagtggcatgatctcagctcactgcagcctccgcctcctgggttcaagcagttctcatgcctcagcctctggagtagctgatttttgtactgttagtagagacagggtctcactatgtttgagaggctggtcttgaaatcctgacaggtgatccacatgcctcggcctcccaaagtgctgagattacagatgtgagcccctgcactcggctgtgctttttaaataaagttttattggagcacagcattgcccagtcatttatgtattgtctgtggctgctttcatgccacaactgcagaaatgagtagttgtgacagaggttgtatgttataaagcctaaaatatttgctatccttttatggagaatgtttgcctatctctattctagacaatactaatagataaatgaaagaaattagaggtagaattattgaaaggaggcagcaaaattatcattattttcggaggatgcataggaaaaccaagatgatcaactgaatggaaaatagaaacaatacaactcgataagatggatggttacaaaataaacttcttaaaaatcattcattttctgatttacaaacaaacagttataatggaagaagagctcccatttagaaaagcacagaaaagaaatgcttatgagtctatatgatatgaataaattatggaatgaataaataagaatctcctgtactgaattccaaatactgcatgtagatgctccccttccgaggagatgggacataatgccctgcctcttaagtgtggactgtgtatagtgacttccttccaaaggtcacagtagggaaagtggggggaaagaataacgttacagtggagaaacctgacagactggactgctgcttctgcggggtgatcaaggttagcatcaacagtgatgtcatgttgatagcaggttccttgatgtgatgtgatgagaacgcactttatatctctattctttttcctaaaaacctataacccatgtctaactgaaaaatctcagacaaacctaaattgaaggacattctgtaaagtacttgaccattacaccttaaaactgtcaaggtcatcaaaatctaggaatgtctgagaaactgtctcaagcaagagaagcctaaggagacatgaagactaaatgttatgtggtattctggtaaaaactaaggaattcggagtgaactacagactttaataatgacatattaatattggttaattgtattagcattgtacattttgacaaatgtctcaacttttgtgggtttttttttttttttttggtttttggttttaacttttgtgtttctaaaactaaagtaaaatgtttatttaaattaaaaagcaccaaaatttgaatgtgaaacataaggtgtatagtttgtcctcagtaaatttccctggtcatgtacatgtaaatatatatttttggaaaggtttaaaaaagtcatctgaaaaaataaatgtgaggatgaatgggaaaaaattttgaagagtaatgatgaggggttctattatatttctatctaaaacatgttataaagatatattaatcagaatagtttgttgcttgagaagttaaattaagcccttgaaatgtaaaagaataaaactcaaaaataaagtcaaatacattcagatttttttatatgatgaaatgagcatttcaaatcaatgaagaaaagatggactgatcaataaatgttattgagacatccgattcacaatttggaaatttagctgcataccatatttctttcaccaaaataaattccacatcaaatattaaataaaaaaaagcacatcaaaccacagtaggaaacaaacatgagtaaataaatgcattcttgatatgtgggaaactttttagagtcagaaagtaaaattcaaaagctgtaaagagaaatagtgataaaacatgtttaataaaaacttcaaacttctaattgaaagaaatacaaaaagaaatacaacaaatgaaagggggtgtagacaaataaagggctaagtttcttattttatcaagtgttctaacaaatgttttaataaaaatctctctccccaaataaaaattaactcattagtaaagctggcaaatgaaactgccattctcatttgtttttttgtggggatagaaattgttgtgacttctttgagggccatttgcagtatttactgaagtttcaaaagtatgcctttttttttttttttggatacagagacttgctctgtcgcccaggctggaatgcaatagcactatctcggctcactgcaacctctgcctcccaggttcaagcgattctcctgcctcagcctccagagtagctgggattacaagcgcgcaccaccatgcctggctgatttttgtatttttagtaaagatggggtttcaccatgttggccaggctggtctagaactcctgtcctcaggtgatccaactgcctcagcctcccgaaatgctgggattacaggcatgagccactgtgcccagcctaaaagtatgctctctttgactcagcacttccactgctaggaatttcaccaaagtgtaggtggctaaataagcaagaatgtttacttcagcattgctggtaaaagcaaagctctggaaactcatgaggggccaggatatgtgcattctgctgcaccattcagtggaattctatgcagcctttaaaaagaatgaagctggccaggcgtggtggctcatgtctgtaatcccagcaccttgggaggctgaggcaggcggatcacctgaggtcaggagttcgagaccagcctggccaacatggtgaaacctcatctctactaaaagtacaaaaattagccaggtgtggggcacttgtaattccagctacttggaaggctgaggcaggagaatcgcttgaaggcaggagaatcgcttgaacccaggaggtggagcttgcagtgagccagatcgcgccattgcactccagcctgggcgacagaacaagactgtctcaaaaataaaaaataaaatgaaaaaaaaaaaaaggccgggtgcagtggctcatgcctgtaatcccagcactttgggaggccgaggcgggtggatcatgaggtcaggagatcgagaccatcctggctaacacagtgaaactgcgtctctactaaaaatacaaaaaattagcagggcgtggtggcaggcgcttgtagtcccagctactcaggaggctgaggcaggagaatggcgtgaactcgggaggtggagcttgcagtgagccgagatcacgccattgcactccagcctgggcgacagagcgagcctgggcactgtctcaaataaataaataaataaaaagacttaagtagaccaaatgtgggagaagctccttggtataatatcaactgaagaaacaaaatgcaatgtccatcatgcatttgtccttattaccttaaaatattttctggagcaattcgtaatacctttttaacactggttgccttggaggagaaaaagtccaagtggaggactgatgggaggagggaagataatttgcctcttcatttgctttttttttttttttttttttttgagagggagtcttgctctgttgcccaggctggagtgcagtggcgccatctcggctcactgcaagctccgcctcctgggttcacgccattctcctgcctcagcctccggagtagctgggactataggcgcccgccaccacgcccggctattttttttttttttttttagtagagacgaggtttcactgtgttacatttgctatttttttatattgacttttttttaaccgtgcaactgttagcttattaataattaaaattatgaaggccaggcacggtggctcacacttttattcccagcactttgggaagctaagatgggagaattacttgagcccaggagtttgagaccagcctgggcaacaaaatgagaccccatcactacaaaaaatttacaaattagccagacgtggcggtgtgcacctgtagtcccagctacttgggaggctgaggtgggaggattgcgtgaacccaggatgttgaagctgcagtgagccatgatcgcaccactgcacttcagcctaggtgtcagagtgggaccctatctaaaaaaaaacaaacaaaaacaaaaatataaaattctcagaacaaagaaattggaacaaagtacagacaacccttttcaataagcattacaaaatttttagacgtaggttgcttgagtcccaacttactgtctctataattagaattattgagttactgagttaaatctagccccaagcaggttaatgtgttacctgacccctcccccccagccaaatatatagattcaagtaaactttttgaaatactgaactatgagtctgtgagtcatagttcatggattcctgtggacttgaatgagatggaggggtctggggaacccaggttagaaaccacagttataatatgaagagcactgggcaggggggtcagaggatgaaggccagactgactgctggccgccgccaactagctagctatgtgagccaacctctcagcctgagttttcttgtctgtgaaatgagactgggggtaaaaggaagtggtaaaagacccttctagcaaccaaattctgtgatttatgaatattgtaacctgtaaactttcaatggcaccaaggtgattgtgaggaccacagtagcctgctaatgtaagcactattcttcaggtcacagtttcagggccaaaacaccatccttcccaggtcgtcaagtaattctcctcggtagatgatctgctgaggccggcgattattcagcccttcgggaggtgagtgcagagctgtttttctcaccatctttagccttctgggtattcctcatgcttccccctctctcaggagaatctcttgcctcctcctcatcttcttcttcctgatttatcactgcctctgccccatctgacattaggaaagtgtttcatcgtgctcgagtagaagatttcatgggaaacagactaccatctttggaacaggatccgatatgaataattctttgaaacatttttctctgcatgtctgtatcttagtcaactttcagtttcccctgcttgaggagagtggggcatgtagacaatccaaatgtcatctatatttggctttagagtgtgttttctacttagctttgagttctggatagatctgcgattctgggaactgactttaaacaaaatcacgaagctttgcagtgaagacacatctgactcacaagtaagttgaatgctttccaagggcccatttttttagaacttgctcaactctttcctgcaataatgctgtgcttggatcagcccactttctctcagaccctggcaaactggccattccaatattccttcctgttaaaaggtggttgccatttggctttttatttgtaattcatgcgaagttcaataagtaatatgaaacatcatttcagtaagtggttcggtgggagacattatcaaaacaattagaatgtgttactgtcaataagcaagaaatcaaaatttcataatcttctctgactcatgtggaattgacttatacttatggccctttcagcttttaatgaagaatggccaaaaagtatagagtattcaagtttgctcaaataagaatcgattgcttcttcctctgagcccccatagcaagaatgtattttttcaatgtagcggctttaatcacctaatagtatagtatagtacatgttttaaatgggaggatgggcactgtcttcattcatccttaagtccctgacacctagcccaagtttccacctatgatcggtgtttatctagtatttgttaaatgtgggatttctctcctgattgtcggattaacccttgagtccttaggactcctcgctgcttctcagtatctcacataccttttgctagccacaagagaaaaaacaaaaacaaaacacctcgcatcttcaacaaccttcacttaaaatgtgtataataacttttcacgtagaaaagtgctgagaaggctgggtgcagtggcacatgcctgtaatcccagcactttggaaggctgaggtgggtgggcacttgaggccaggagttcaagaccagcctggccaacatagcaaaaccccgtccttactaaaaatacagaaaattagccgggcgtcgtggagcacatctgtaatcttagctacttgggagactgaggatgcagtgagctgagatcgcgccactgcactccagcctgggtgacagagtgagactgtgtctcaaaaaaaaagaaaagaaaagaaaaagtgctaataaaataccttaatgtgcatatgaatgaattggggatcttgttaaaatgcagatttcaattcagcagttctgagaagaggctaagattcttcatttgtaataagagcccaggtgtctagaccaggaccactggtcctggtcacagaccacactttgagtatcaagaactctaagttgacttgtgtatattgttaattgactgagtgtttaagcagggaggaaaaacacggtttagctttccagtgagtatgtcatttaatatttcttacacacacagaaagggtgaggaagggttaacagggttctgtgtgaatgatgttcagcaggtgagaaaggaaactaataaagctggctggatcttgctttatgtgctgtgcctcagctcagcaaactgagctggagtggggttagggtgagcagggtcaactgctaaaacacagtttactgcgggggtgagacagcagctgttttaacatctcccccaataccacaccccctctgaggactagaagcataagaatgtattgtatccaaaagaaatggtcaggaatggtagtttagacctgcctgtctcaaataccaattgcctagttgagaatttacccaagacattagtactagtgattatgtcacttttcttctgcaaagatgtgttcatctgtctcatttgtcacaatttaggtacatacattttctggtcttcagtttcctagaattttcttagatagaaatatgctgtgtgtgtgtacttgtgggtgtgttcccctggggctctgtatctgtgtgtcatttgaaagaaaatttaaagctctttttaaaatcttttttttttttgccgggcaccgtggctcacacctgtaatcccagcactttgggaggccgaggtgggcagatcacctgaggttgggagtttgagaccagcctgatcaacatggagaaaccctgtctctactaaaaatacaaagttcactggtgtggtggtgcatgcctgtaatcccagttactcgggagactgaggcaggagaatctcttgaacccgaaagatttttttttttttgaagacagagtctcattctgtctcccaggctggagtgcagtggcccgatcttggctcattgtaacctctgccccccgggttcaagcacttctcctgcctcagcctcccgagtagctgggattacaggcacctgccaccacactcggctaatttttgtcttttttgtggagagacggggttttaccatgttggccaggctggtcttgaattcctgacctcaagtcatccacctacctcaacctcccaaagtgctgggattacaggcatgaggcaccatgcctggccttaaaaccttttcttgatagccttttgcatttcaggtttcttgaagtatctctgcttgtttgcttctgtttcaaagatcataacaggcagcaggccccattgtgggggaaagtggtagcaaatggatctgtgatagcaggtgtcatcctcatcatctctttacagtaatcgaattggttgaagatacatggaaatccaactagatacacttgtaaaaatatcacctgccagtgcagtggctcacacttataattccagtacattgggaggctgaggtgggaagattgcttgaggccaggagttcaagaccagcctgggcaatgtagcaagactccatctctaaaaaaaaaaaaaaaacagttttcaagtttgcctgggtgtggtggcatgcacctgtagtccttgcttcttggaggactgaggcaggaggattacttgagcccagcagttcaaggttacagtgagctaattagctgggtgtggtggtgggtacctgcaatcccagggaggctaagacaggagaattgcttgaactcaggagaaggaggttgcagtgagctgagattgctccattgcactccagcatgggcaacagagtgagactctgtctaaaaaaaaaaaaaaaaaaaagttcaaaaaatgtttaaaaagttacagtgagctatgattgtgccactgcattccagcttgggtaacagagcaagactctgtttcttaaaaaaaaaaaaaattactaaaacatttgtgattgccatttgatgactacataccgtaactactcaattttgccttcctttcatgtgaatagtgtcctttgctgcatctgcatttgagctgcccaagagcccaactaaattaatccctccagaagtaaaggagatgaaatcaaccaatctgaggaaagcctgaccaaggcattcatgtatcaaaaagatatggaatacctacccactgcatacatgatactagaaatcctacagcttccctgcacagtggctgtggttttcatttatatgaaactgaggccagagaggtaaagaacttggcctgaagtcacatggggcactgggtattatttgaagcagtttttttcaaaaaagtcacggagaaacattactcagagcctctccctcacaccctgcagatagagctctgaatctcggcatctgtgagttgtttcttttgggctttttaaaaagtcttccagaattgtggaatgggatagtttcagttaaaatatctgtttttgaaaatcatgaccaataataaaaatcaagaatgtcctattacatatttcatacctttaagaattttgttttgctctaattggtcttattggattaaatgatttctaaagtcttctctgggacttcacttttgtgtttcaagtttcttatccatctgaaagccatatatttgggttaaaccaaattattagcaataggtatctttgtagaatttctagtagtttggaaggagttgaatgtactagaatcatagcacgtatttcagctgctttattagcagtctagctaaggggagtttattgttccagttttagtcattataatacagccctgtttaatattgcatgatctgtgggttgccataaacttggtacaaattggagtgctgatataacatgaaatgaagcgccttgtctgaatgttgcttttgttttgcatttaacaaattagtatgttgacatttgtcactgatggatttcattatttgctgaaagggttttagggggtttgacagcatgaatggtttgtcttacagacttttgagaattgataaaagcatctttgttctttgtacaaaagcacaacagatatcgtattgatggacacacaaaaagggatggcttgtgtagctgcaacataaaataaaccaagaaaataattttcgagttgctacttactcttttatgtgatttcttcttctcatcctttttttcctgataaaagaatgagtttcgttcatctcaataacaagctcaagagcaatcaataatctttcagtaaaattaaaatattggcttctttatgctccacttacatatcgtttaaggaggattattttaaaacattataaacacagttatggttcagattgcattaaataactgttccacgtcctcagataacagaggtgagatgggggagcaggaaactaagagttccgtaaaataaggaaaaggactaaaattttgatttcaaattctagttttatcaaaatggtaaatatgcatgttcttctgtcatttttttttgttatatttagagggatagcctcatcattcaaatgtaccttcctgtacatatcatggagcccttattggaggttgctcacctcacgcttttgccccaatcttgttaaaatctgttataaagtatgctctgggaaacacatgcacacacactcacactcacagaggacttccagtaaaagccttgctagaaagctacaaacaatgaaatctatcaatgatcagatgataacacccatcactaacaactgccaacactcagactaaagcagtcaagacactgagggaaccatccatcatccctgtcatttctgcagggagtgcagaaggggctggggggagggggccggggccctgtagtggacagaagtgacagcagatcatgcagcagaatgcagatccaaacatgacctccagtatctactgtgaaaatttgtgggaatcaagacagggaaagaaacgaataacttaataaagaataaaaaagtaaagaattttgtttattggttgggcatggtagctcacacctataatcccaacactttgggaggctgaggtggcaggatcacttaagcccaggagttcaagaccagtctggtcaatatagtgagaccctgtctctggctgggcacagtagctcacacctgtaattccagcagtttgggaggccgaggtggatggatcacttgagcccaggagatcgagaccagcctgggcaacatagcgagactctgtctctacaaaaaaaaaaaaatgtaaaaattaactgggtgtggtgatgcatgcctgtagtcccagctactcaggaggctgacgcgggaagattgcctgagccaaggaggtcaaggcagcagtgagccactgtactccggcctgtgtgacagagtgagaccctgtctgaaataataataataataataataataataaaaaaacagaccccctctctataaatatagattttaataaaattaaccaggtctcagctactcagtcccagctactcaggatgctgaggtaggaggattgcttgagcccaggagttcaaggttacagtaaactacgattgtgccactgcactccaatctgggtaacagagtgagaccttgtctctaaaaacttaaaaaatatttttgtttattgaatgtctcttcctgctacactgtgacctccctaaggaccccagtccacatcagtttggtttgctaatgtatcccaagcccccaggacagagcatggcaatgtaggctctcagttaatatttgctgaatcaatgaatggtgcagcagcactgtccaccttctatgtcctgtttgcccaacccagtcttggacttaggtgtgtgttccctgaatggaatcacctggtgacccacagacacagagctgttccccccatgtgtacatccagctgatactagaaaggagaggtgggcccgagttttggctctgctgcatcactggcttgctgttccaggtcggaattttcctctttctgagcctttgtttctcacccgaagggaacaaaaggccaccaccctcacaaagctgttgagattcaatgaaaaagagaggaaagatggatatgaagggcccctagaaataaggacattactaatttcctaaggaaagtacagtcttatgagtgacatcaccgtattttaaaatcagacacattggtttcctgcagacacagggaagacccacacctgcaggcatgtgtggagcatgtgaacaactctgctctttgattttggcatgctgcttctcgggcttctctagaaaggagaaaactgaagaactgagagacccagaggctggtgtccagatcaagtgcagctgccatgtttcaaggagagccgtcttctgtgtgtacacagtgttggcctcagagaccagccaggagaaggctggctgggcacagagtcaagcatcaggacacagagtcatgcatcaggttgttttccgcggggaaaggtgtaaggaggaaagggctgcctgtttttttgcccctttacacacatgcatgtgtgcacacacatgcacaccctcccccacaccagtcttccccagagcctcttccaaagcaacatctccagcctcggggtatcaacattagagtgcagttctccttccaggcatctgggagcctcccttgcagcaacccctcttcagactagaattcgaggcatgtccctctcaacagctgaccaaggtgcaggcagctagctagctttgtgaaggcagcgtggcctacagggtgggctaccctgcaaatttaagggcaagattagtccccagtcttcgctgggcctctttcctcatttgctctctggaggtggaggttactctaagtgcccttcaaattcctttccagctctattctttgaactgctggtttcttcctttccaacttatggaaattattttcctcacttttcctgagaggggaagtataagacaccaggctgtctctgacaactgccaaagtggccgttttttaatggaaagtcagcttccttctcaggttgcttaacagagcagaagcttctcgagaacagagaagcctaatgtttccctctggttttttgacgtcagttgcctgtgggtgggttcccatccgctgccacctctccaaccacactaaattttattgcgcagattttaaaaacacaccttggtgtggcaggccaccgaaagaagcgatttagcccaggagccctgctgttaagctgtggcagagagagctttggtccagtctctgactgtgccaggatcccatcccacagagtaaatcctccatcctccccttgttggcccctcaccaataaaagcggaatgttcactttacactatctcctgggggatttgaagaatcaattctgaacactgacttgaaagcacttatccctctaagagtataagaagtggggaagggaaaagggagctaacatttgtgggatgtttgctgcgtgccaggtactgggctggctgcttgactttcattctttcctttaactctgctttgtaatcatcatacacaaaaccgtcaaatggtttaggctgctgagagtctaaagcttatcaagaagacagtgaccatgcagaggtagagaggggaaaccagacctcccataaacccccaggaagctaaatatctttggcatacttgacaccacccatgcaaagtttaaaaatctaattatgtccatttgcaatgcacagataaggggcactggaaatatattcaccaatacaaatatgttggtgctttcaaatgtcagaagagttcagccgagtgctgcaaatctcgtcactgataaataacagacatgttcatcttattccaatattttcctttctaacttaaaaataactttgtcatttctcctagtatgttttgaggtgattagtcttaaaatgtgtcataggtggtaaattcaggagaactgaacttggcctccaaaataagcaatgttccccatgacattatggaataaaaacacacacttgctttggttttgcctggtttgaggcttcgtaacgtgagcagcgttcacagtgagtccgtgaatggaaatcacgccacacaggagctgtgactcaggcctgttctccgaaggggtgaggtgatggctattaatatttaatttcatatactgtagtgtttgcagaagcaaacatgctgtagttaaggttacgcgcattgagcgtcagcataatccagtttttctttccgccaggcttttttcacacagatgtgttcaacccaaaggtgaatttttggagccttaaaaaaaaaaaaaaaaaaaaaaagaatgagaaaatttgaaaacaattaggtaaaccattatggttatacaactgtgaaaagatgacagcttttatacttagaaaatagtatgaaatgttttcttttctttgtttgttgttattttcctctcacatgaaactggtcaaccaaccaccaaaacaaagaaaaggaacgatgaggctgaaacttaagggtagccatttgtcagcagaagtaaaggccaagtattcccagagagaaggcatcgcagtcaactgctgtgacgtgtgtgacgtccatctcaaaagcctgtgtgaatgtaactacacagggtggcatacgctgatgtctgccctagatccccacaagcctctagcttggggtgagtcaccagtttcaggcaaggggtgtctgttggttctgaggtgactgggcctttgtaaaagagctttgaaggaaataccttgcagacttaaacggctgtcatgagtccgccatggcacacagcagctcccaccccatggatgaaggctgcagctcgctgggtcttgctttctcatctgagaatgggagggggtggggcctctaagagcccttctggatcgagtgtctggggattccagaaccagccccactccttcccaaggttcagcgctagcacatccatactccccagactgtctcccccatttcggttgcggcaagactgctgtgagccagagctatgcaggcgtttgaatcgcgggtccctgcctagatggacacttcttccccttaactagttttctccctggcagccctccgtccattctcacctttcctcctcacctctagtcctgcattagaagcagccggttctccttcccagagccctccctggcagattgtgaaccgactaggccatgcctcttcacctgtggagagtggctctgaagcagggtactctctcttaccctgggccctgcactccagtgcagaagcatccagcacctgtggcagactggtcatctgaaaccttgctacccgggtaggaccccagcttccttgtcctctggcttccgagcgaggactgggtctcgggcagccttgcagcacgcagcacatcaaccgcggatcttcttgggctccctcaagggtgggacctaatgctactccagtctccctgctgtgggcacgcctctgcctttgctgttgacttgaggatgtgcttttaacctattgcacctggcttcacactgagtgggcaaaggacagagggcccactggtcgagggtccagctctttcggaggacagcaggacgtcttttgccccagggccatcctctgcacttttatatgatgaggtgcagcagtgtttctaattctctgttgcttgagaagtatggacatttccctagatcttttggcagttcctaacacatctgcagagaaggatcttgggggaggggccagtctattaggatgagccatatgaaattgcccattttttgaagttggaaagggtcacttattgcattttatgtagttcaacttaaaggtcaaaaaggtggaggaatgtctgggcctcctcgtgatgttatgtttacctaataagcatcctggggttttgcctagggtttatgatacagtatctgtgtctatagcaaagagtattattgtagatactgtcattactacttaaggtattatcactactgctacttgagctcactttagaaacaattgatagagatagagggaagactgtctatcccctggaagaccccagtacctcagtcctgggccctggtctttccctttggaactagtggtttaaaatgagctctcctttacctccattcttgtcttccctgctttgaaacaggacacctctggccagtgggcttccttttggagataagagatgttgggtgatcaatggcctcagacaatgtagctgtcacagtttcatttttaaaatgtcatggtgataaaaacagccatttgctaataaaaagggtgggattcattgcctagtggcattcacatccatgctgtcattgtctaacccagatttctcagagcagccactggcttggtgtcgtagctgaatgatgtcacttcaagcatcacgtaattttccagctggctaggatggaaaaggggtttattattgtggcatgtttttcacagcgtctgaaaaaaagtgaagcagacagggatatatgacaggattggttctgtttttacaggtgtgtctgaagcatacaaggtacctttcacttgcaatagaaatgtgactctatggcaaaagaaattttttaaaaaaagcttttctcaagagattttaaatatataatacataattagtgttggaaattggcctcgaatacattaaactcaaaagactaggaggtgggctgcccagaccctggtctcagttctgtccctactgacagagctctaacttcatctttgcctcagtttctccatggaaaagatggacctcccagggtatttgtctgtttttaacttttcattgcagtgtaaaacagaaaagtatacatcttagcatacagcttgttggatacaaactgtagacatccctgtcactagcaccctgaccaagaaatgcacataaccagcactccagaagacccctgtgccccttccagtcaaccacacacacaaggacttccagcagcatagatttcagcccagtgagacctgtgtccgacttctgacctgacgagctgtaaaataataaatttgtgttgttttaggccaccgtacttgtggtggtttgttgcagctgccctaggaaaccaatgcactgatgctgctggcaagagggagagccaggagttgacccccagctctgtccccaaagaccgagttcttaaaaaccactagaatagatagtaccgctcttagctttgttaggtgtttggtcattggtgagggtatgaaggtaaaatgaaagtgcaagtgccagccagcgtgcagttaagttgggtactaggtagccagtgtctttgaggtactctgacttgcccagcccccgacccccatgctcagaatgtcccctgcctggaaagaaggaatgtgatatgttactaacacttcagtgtgagttgagtgcgttatctcttcctaaagtatttgcgttctaaaagatgacctaagtgatgactttctgctatttatgagaaagagggctacactacggtgccatggctgaccgtgtgagacccaattccttgtccatcttccactacagagtcagaaaacaccaaaaagcatctttcccatgctgccttaacagctagcagagactaaagagtaggaatctcggctatgggctccctgggaaaagttgctttcctgatgaaagggatcgttgttgctggcacagcgcgtttcttccatgttaaacacgaacatggtgcatgaaggtgtagtggtcaacccgtgagcatgaggggcaagcatgaggaaagaagtgcacacaggaaggatggagagtgggagtatagcaagtcctccagctcccgctgcactgccagtcactgcaccagccccagcaaggtcttgtcactccagtgatattgtttcaagaaaggaaaaacctctccagtgtgtgccagtgttcattgtattttttgttacttgcagctgaatacattccaaacagacccgggtgcctttcagatcacaaaaaggtaaccacctaggaatggggacatgggcaggcagaattctttagaatgaaaggaattcctgggatccttgcccacattttcaccacggtgaacacatgcaaagaatgatgagtcaagggaaccatccagagaaatgggattgagctgtagatatccaataaacctgatgcattccatttggggagaagaaatagaaggctcataattttaaatggaaaggttagttaaaatcaggagactttggagagactttggagagacttttatttgtttatttttgtttctggtgaggtttattacctttcagagggacatgctgttaagttgaatacctctgaggatgaccatctgtcacatattttccaggaccaccctgggaaataagaaggatattgtctccttatctcgacaagcgtgccatggtggtctatccatggagtcataatttgagattaggaaatatgctgttattcttaaaagttcaattatttatgaatccccaatagccaggtgatcccttatacttagtggcatttattgatgcagatgagtactttgaaaaattaagagagacatttactttttaagctaccactaagacggtctctgaccggataaagataacttgagcaggcgaatttgtttaacaaaggtggtgacatatattgtggcagctgaatgcccccttacagccaagggagaacaatcagtgaattcattcgtttaattcatgaattttccttctatttacactttaaacaaacatgccagttgtttgcttagttaacaagctctgccttcattataagccattagtggctagtaataactgaaactgtgtttggatttcacaaatacaataaacccaattaatttcacccttagtaatatggaatttgtctgatcaacctgagctaggcagaagtttgtgtctttgccctttgcatgaagggtttgctaaatcatcttatagccataaataggaattcttcataagaaaaactaaacaaaacagcttaaatcctaatgcttctaaggggccaggcagcaatataaattagtgaatgggttggatagagcatcctctaagaaacacttggtctacttttgatggagacatggatgtaagaaatatttcactttttaatcctgtgataagaaggaaaaaaaccacacacatgattataaatgacaaggaggctcagccaatggcagggagacgggagggagaagttgggaccacagcaaactggagagcccaagccctgtctgaaaggaccagctccgattcagctgcagttactacataagaatgcaggcctgtgatgagggactccaaagcaggttttgcctgcttctcggatttcaccaggatgaatcataacagggacctgataaaatcctatctttgaaatgctctgtaatgcttattattgttcttaggaaatgataaaatattgccctttggcattagacgtgtgtgtgtgtgtgtgtgtgtgtgtgtgtgtgtgtgtatgtacaggataaatatgtgcccacttctaaaaaagacctgggcctagtgtggccacatctttcaaatttttaatgtaatgtcaaaatctggatttctggataaaatcttcccatttataaactttggcaatgagtttttgctatttaagctgatgctgtgcagccaccacagtgcagatcagcagctctcaatgtggtctctggaccagccacattagcattacccgggaacttcacagaaatgcaggttcctaggccctacccaggcctactgaaacaaactctcttggggtgaggcccagagatctgttttaacaagcctttcaggtagggctgccagcttttagcaaatatttcatggaacatacaccaaaaaattattcgttgtttatctgaaattcaaatttgagtacgtgtgctgttttcttatctagcggacctacctcccggtgcttctgatacccgctggtgttgatcaagcaaaacatgtgtatgagccaggctgcttgtgtttgaatctgctttgacacatattaactctgggattttaggcaagtgacataatttctgtgtggcttggtttacttacatgtaaaataggcacgataataatttcttcctcatggggtggttgctggaattgaatgagttaacgaacataaaatacttagaactttgcctgggagaaaataaacaatatatgtgtttagtatcatcattttattttttcttttctttctgctctaatcatcaccgctcctgccaccacgcagccatcagggaatatgagaactcatcttccttcaattcttttttcctggatctaactttgatttagcagaattgattctaacgtgctattccccaaggccactctgttgcttgttcctacccagagttacccttcctttgaaatctggttgacagtatggcggtctggcagggaacccgctcttgcctccaccccgacgtcctgctgcctgaccagagttacccttgctttgaaatctagttgacagtgtggtggtctggcagggaacccacacttgcctccaccccaatgtcctgctgcctgaactctgtcagccggcagtgcctctgttgcgctcaggcctcttgttgtacagaccagccttgctacttcgtgtctgctttcaccagcccagcagggcaagtcaacagcttcctgaccctaccttggattttcagatttgcagagggcctgactggggcttggcttcttgctgtcagttggggaaacaatgaatgccttcctcaccaattgaattctgagtacactttaggaaatccccacaactttttccagacaaggaacatgggaagatttgatttgtggacccaaagagtgtatttcaaagcaaagcagtcaccaaactgtccttgctgagaatggctgcaagctgccccaacgtgtccctccataaagcagccctccaggcctccacaccgccacacgggacagacttgtgctcgctgtgaaaaccaccaggatgagctattacggctctcagttgtgccattttattgctgttctggaaatggagcaaaacacattattttattaaataaagattttccctgtatcacagtggaggctaattttattagctctttttatgggaacaaacatcatcgccctgattggggaggacggaggtgggggccgtggggaggtgagggagtggaatcacattttgtcatctgcgtgctccaatgaggctgccgacatgttttagttggttactcacattaattacttacttaccagaagagttccccagatcctgcagaaaatacacagctttcattcataagtaatttatagatgattcaaaagacatgttcagggccaggctcatgcctgtaatcccagcactttgggaggccgaggcgggcagaccatgaggtcaggaattcaagaccatcctggccaacatggtgaaactcccgtctctactaaaatacaaaaattaactgggcatggtggggcacacctgtagtcccaagctactcgggaggctgagaccagagaattgcttgaacccgggaggtggaggttgcagtaagcgccagtgcactccagcctgggcaacagagcgagactccctctcaaaaaaaaaaaaaaattaaataaataaataaataaataaataaagacatgttcagttacaataaatatttgttcatattgtgtgggtatgggtgtgtcccctgacaaccaaaatctatagtctccaaaatgtataactaaatgaacagaatgttcaaaatttgttcaaaaacaaattttttgttctcatctatgagattctggaatgtttaaggcagaacatgtactgtcacattgagagagggaaaggagtccaaatctagttgaaaaactgaataaaatactgtttctccctctgattctttagctttgaaacctgagactttcacatgcagcttttttgatgaccataaccggcagaacctgcccccaccccacccccaggctaaggcagagcagctgaggcaggtgaggccaactcctgagagtcagacagcagtgctgccctgttccgtatgcagggctgaggtctccacaacgttctctcgggatgtgttgccctggggtcagaagggatgtatccgctgctctgctggtcagtagctgagccttctgtatggtctgcagagctgccactgagccagaggtggtctctgtgtttcctagactcaaggtggtctccatgttttgtcgttgccatgctgtttttcctgctagcaataggccacagctaacgctaaagcaaatggtgaagctggctacagtgttttgtgtccccagcctccccttccgccctcatgcctctctcctccccagtgtcgtctgtgctgtgttttggagcctttccctggcccccatgagcacccaccttgaaccttgctaggatccaggtatctgtcatttacatctccatgtgacatgaaaccataagcctcctctgagagcacttagaagttaaaccagatcataaagctggagctcctagccttggcatcgttgtttgcttccctgacgtagctgcccactgccctatagtatcactgctacttccctaacctcagtttctctctccttcatcttgttagctgcctccccagcttgtcttctgcatccttccctttgttgtctgtccttcctattttctctgtctccctccttttgttacctatatctgctaccctcagcctgttggcctcttttgtaatgagcttccttcgtcttattttcttccctcatctttctatctgcttccttcatctccatctttatttccctcatctgctcccccagctcctttctctgcttctttccttgtctacttccctcatctttttatcggtttccccatctcattctctacggccctaattttgttatcttcttgcctcctgtagctctttgagtttgtgacctgctttaaaccatctctacttgaaaagaataccaggctttagcaaatataggtgagaggtggagatcagggagaggtagacttgtgtgtcaccctcctggggactgacctaagtacctttgtaagggcttgtctaacacatgcccctgtgacccactggggactcccagcgtaggacagggttatgaggaagtaggcattgctcttcaggggcatcaacagtggagtagtgatgcccccctatggcctctgtacccttatttcttaccttcctttcactaggaggaggcctgctcaccttgggccagttctggctatgatgtagattgagggaacagaggtctcaggacgtggttgatagcttcccattggtgcctcctgaagacagagctcctgggagagtagtgagcatgaagcccatgggcttgagctggcacagagggacgggagcccagaagccacaggtctaaacccagtgacactgggcagagtggatcagagtgaggctttagagtccagactgtgtgagctccagtcctggctctattgcttgccagctgtgtgaccttgggctagtcagtctgcctctctgtacccactttcctcacgtgtaaaatgagataatgaaattgaataatagtaacatcctgaggttgtggggtagagcaatgagatggcatgtgtaaaatacagtgcctggcacgtagcaaacactgagcagtcagtcttcagaaggagaagatgtttgggtacaagaataaggaatgtggccctggggctttcctcagtctctctgccgtagtcacatttgagtcaaaattcatttaggcaaatgagtggatgttttactattttttttttttttaattttaattttgttgttgttgttgagtcggagtctcgcactgttgcctgggctggagtgcaatggtgcaatctcggctcactgtaacctccgcctcccaggttcaagccattctcttgcttcagcctcctagtagctgggattacaggcacctgccagcacacctggctaattttttatatttttagtacagacagggtttcactatgttggccaggctggtcttgaactcctgaccttgtgatctgcccacctcagcctcccaaagtttttcagaatttttaagaaaacacttctaaccttaagcctttctttcaaactcagatccccttacacattgatcagacgtagcaagtttgcttcaagtttttggaactggtttccactttaggctactgaaggtcccatatccccagaagactatcccctcatctcctcagcctcccgtttaaagatacacactgcagtcgggtgggtgccagatgaggaaagcggaagatgctgattccctcccacgcagtctcagggccagagggaaggagggtcctgccaggctgtctgggccacccccccactttggcttcaggactacagaagcatctcctacgttaggctgcgtccaggagagagggactaagggatttcgtttagaagaaggggcaggggctgagagttcggcttgtaaatgtgtaggcgagagtgttgacatacatcacttcacacctgatgaaggaaagagaagacaggctatgaacctaagaggggtggagcgacagtttgtctccctttcagatggccccaggctactacgagtctacggtttcacttgtccagtttaaattagcaagtaatgaagtcacacaagcagaagctgctgctcatgattataagacccttagaactatctatcctgctggactttagagggcaatgagcctggttcccccctctctcgggtcttcctttgtctctatcatgggatattgggctgcacatgttgaaattgtgaaaagcgttgaatccataagaagtaccagcttgataaatgtaagtctgtatgatgcctcccaaggatctgtgtgaaaagtaaacttgcggccaggcgcagtgactcatgcctgtgatcctagcactttgggaggctgaggtgggcggatcacctgaggttgggagtttgagagggggcgggcggatcacctgaggctggagtttgagaccagcctgaccaatatgaagaaaccccatctctactaaaaatacaaaattagcagggcgtggtggcgcatgcctgtaatcccagctactcaggaggctgaggcaggagaatcgcttgaacctgggaggctgaggttgtggtgagctgagatcgtgccattgcactccagcctgggcaacaagagggaaactccgtctcaaaaaaaaaaatgtaaacttgctctccatgaggggaattggggtctgctcccgtaaaatgggaggggtggcctgggggctcttcttgtccttaagggcaatcaatttcccgtcctctgggttccttctacccctgcagcctgctggaacctgctgtggcagcagcatctagccagggccgccaagtgctgggtcgctccacccacagcaagatgggccgtgctggtcagggctccacggaaaaagcacaaataaatcaaacaccagctcctacttaagatctgatgaaattctccatttccgctccaaattgaattcctcccgaaggatgggagcagctcctgggagtaatgaaggcactccttcctcctctgctagaaacatgttttagattaacagacgcagtcttctaatctgggtgggtaggtagtgttcaggaacagccttgagaaagtgttttcagaccagacatgatatttttaatctcgaggggcaaggcggcagacatgcaatacgcttggcctctgtggaggaggcagccccagaggtggtctgctggggaagaatgacaacacgggagtgtggctgcaagccacccctgcctgccacctccttttcctccaccacttggagccaaaaagaatttatggtggggaatagaagcaagagggcttgtgttttttgagatttgaaatatcactttcctgcccatctcttatttgggaaaaataatcaactctgtgatttaaaaaaaaaaaaaaaagacaagaaagaaacgtttttaggatgaagatgtcattgaagtgattatcttccattctctgtaatgatgatgaatcgacagtctggcatttgtagaggcagttgacacagaccctttcaaggggaaaaaaagaaacagttttccagtgaggcttgtcagggggaagactgatcgccggcaggccggctcggaccatgagcacagttccaagaatgcagggatgaggaggagccgggctgggctgttgagtccaggctgaggtaggagtgcagtgttttacaggtccgttctgttttgtgggtggacatgggtagattacctgttgggaaagaaatacttaatattattccttgaagtgagctaaagagaattacttttcttcactcactgttgaagaaaagcaatctaaaaaaagaggttaaatctacttaacatgagacgttcagacatttagtgcccaagggagggaaggaaattctccttgaaagaatattctgttggtccttttatgtcaggattttgttaacagcctttgagaaaggttatcaaaaccttactccatgtttttggtttagtttttaaaagaagccttttccttcatagggaaatagccccagagtatccagtatgtcaaacccaaccttagagggccaaacgggccccggaggctttcgattcaggttcccagccggaaaattgcttttcagggagaaggtcatgttttccgcagatagtggggtcatttgtatggttaaacgcccttccttctgagccggcaggatgttcagacttggcctccctcagaggacagtaggaagtacatttacccccgactcagaagaaaggattgaagatgggaaggggaaatttaggtggaattctggcaacgctgggtcctgtcccaagcccaacaagatggactgaggccggggtcgtgtctccagaacattgaagggtggggagggaagtgtggtgcagacaacaaggactgctcaaggggaaaaaatgaaagggtgggagaaagaagtgccacccaccctccccacagctgcttttgtgcattccttcaggccctcgcagacttttatatttgcataaatgggccctggtgaggcttccacactgggacagaagagcaggcaggtccccggacagtggaggctttttcttcatgaatagtcttagagcgatttcgcagtcatccactcgtggaagcttcctggctggagtccgccctccagtctctgtaaggacgtgcgtgtctgtctttctggctgcagaccctgcccacgcaggcttgccctccagcctgtttataaggcctgaagttacttctgtcttgttttagcccaaagggtgaactgctgccagcagtatgtctggaatgttatttacttggtacatttctgtggctttttgtagcattgcacatgccagagccatttacttgaaaatgccaggttgcacagtttgtcttctcaacggggtgactttctcagttaggggagtttagttcctgtgtctctcagtttcttccttccttccttgtttttttttttcccctgagttagtgctctgaacaatactgttggtgcctgttgcatcgcacccctttatcctgagtgccccaactccacttgtaatttctggggtttctggtgtcctcttcagagcacctggcagatgctttttcatttgcatgcctgccctgttattacttcacatgaaagctgtctgttttggcagacatgactaccatgattgcagttgagctctctgagctgaatgggtgatgttgtgtaagggaactcgaggtggggttttctctaatggtggctgtgggagtggaagaaaaacctgcgagcagtcttggcttgtgccgagccgacatgatagcaaacaaatgacttttgaagggaggaaccggtgtgtacagtttcctaatttggaaggtttcacaactgtttttgttcaactgatggaggagagatttttttaagggcaaattcttcattaggaagactgtaaacaagtcctggaaaaaggataattgctgaaggaggaggcatggaagatatttgatgggcctctttcgtcagctccccttcttcccattccacctatgcagttttaatggtgatattttgggttttaacacaaggtatggaaaatgagattagataaatctccctgtctggtgccagtcctggggccatttgcacacctgggtgggataactccctgccttctttctgtcagcataattttgttctgtcatgtgagtctataagcacttgcagatatgatggaaaagcttggccttacacggtctcggcctttattcgggcctcctggaaacctcagccatccccggcacctgctcgtttgttaacatcatagccagctccccgtgcagaatggaacattttctgctccattcttcttggctttttctgtccttctgcatgacttctcaatttgtttgtaagctgctcagatttttggctgaagggtcttctttgatcactctcctgacagcttaggcttcacactgtcacacctgctcttcttttacagtccagatttcagagtaaatgcttccattgccttgtaatttttgttttgagtgtaaaactttggtgcaggttacttattacaggtaatagccgtttgatgatggagaaaactggttggcagaaacggccacctgaactacagccagaaacataaactgccactttatttatgtctgaaagcatctaagccgcaagcctatctgtcatgatctagcatgcacatgataataacaggcttgccaggctaggaaagctgccccatcggatggccatgaggacaggctctaacaagactctgtgcattttctcccccattatccacagcccacacatcatgttcctctctcagagcatcttgacaggagggaaccatctctgtgggacccgcctctgccatgaaattgcccatgcctggtttggcctagccatcggggcccgagactggacggaggagtggctgagtgaaggcttcgccactcacttggaggatgtgttttgggccacagcacagcaggtgggttaaagtgaccctaagtatttcactacccagagtcaaattccatttctggtcatttgctcacccaacagctatggactgagggcctactatgcactaggcacaaattttgctggggagatggctgcataaataagagagggaagcccctactccccacaggatttacaatctagagatgggagagagagtagacaagtgaatcagtaatgggtcaagtgttggagtactgtgaagagaaatgagacccatagaggggcagtgggtcctattttagaaggtagtaagagaaggcctctctgataaggagatatttgagcagagatgtgaagaaaaggtcatgctatagcatactcaagcacttctttgtggttgtgattgtggtgacttgtgtgtgtgcagtgtatgtgtgtgtgttttaaataaagagattaaaacataaatccagagtcatctcagatgtctgctcacaagtagtgaatgaagaatgaagcaggggcggtatagattagggaatggtgagaactgtggcaaactgacagcagctactcagctctaaccaattgtcatggtgaaggaaggagggctcaatataacctacactattagttttttaaggtaacttataattctggacttttatgtgaagtttactaatttaaaaaataccacgcaagacaaacatacccagaagccagacctggtgcacacgctcccagtttgcaacctctaccttaaagcattggccaccagttccaatgaggatgataagcaactaagctgcttcgtgcttactttcaagttcctatttttgttgttgttgttgttgttgagacggagtctagctctgtcgcccaggctggagtgcagtggcacgatcttggctcactgcaacctccacctcctgggttcaagcaattcttctgcctcagcctcctgagtagctaggatgacaggcacatgtcaccatgcccagctaatttttgtatttttagtagacgggggtttcgccatattggccagtctggtctcgaactcctgacctcgtgatccgcccaccttggcctcccaaagtgctgggattacaggcgtgagccaccgcgcccagcctcaagttcctaatgtttaggtcacttttttccccctgtcatctctgtcccttatacactggactatttggcattttccaaaattcccaagtttgtgcatacctgcatgatattgttcaaggtcctttgtctgttgaaatcttatttatttttcactaaccagctggaggtcaccttctctagctagcccaggctgattacccggctcacaattcaacactaccctcctacacactgtgggttcccacaatacttggtgcttacctttttaaacttattttattttttcttttccttctactgtgtcatttccttatcctcacacctggactatacctgctttaaattggagctgggtcttgcttttcataccctggccgtggacccagcagtgtgcacatcagtgtcccctgccacatggagtcctgtgaggagaggccacatgatagatacagaaaaggctctggggtctgagtcagacagacttccagtcctggctctgccattcgttggctctgtgagtataggtaggttaggtagcctccccaagcctccgtttcctcatttgtagaatggatgtaagaatgccaaagcttgcagggtgaatgggatcaggtgtgaatgagcttagcacagtgcctgacacgtggagaatgtacaagaaatacctgttcccttcctctttgtgtttccctccgtcttacacacaggcattcagcaggggtttaatatgaacgtgcctctatcaccatctcttccctggagtgcctcccttctgagactctcagattcgcgctggtcctggcagttgtggtgcattccaggcatctgatcatggaacctccagtttttatctcctgcatctccaaagagtgctcctccttacccttccctttgcctagacttctaggaggccactccttagtctgctggcttggtcctgcctcttgactgataagtttacatagagaagtaaacactaaatattgtcagaattccgaggtaggagaggacaggtctgggcgggcctggaaagcctttgtggaggcggtggcttctgttgtgagcctaaagggacagcaggagctgagcttgccctgttgctcttttcccttaacatgataggagtcagccccctcatcatccttggaggtacatgcagtaactcttcgagatgtgaaaacatgaatatccctgaggcaaaattgccattctagattccagcacaaagtttgaaacatttccagagcaagtccgccaggctgacctctcccttcaagtgcgagactgggctgttgctggccctggcgagtgcctgcctcagaccgtccagggagtgggggagtgccctgtggggcaggggtgggtgtgccacctcccaggtgctcctggccagcaggccccacccgggagcagggcatgaggatacagggtgacaggggtcaccggggtcactttgctgcctgggagactgtgctctgcagcactgagcagtagaaagcatggtggggccgggggtgggttgcgggggacatgtgaaatctcaacaaggtgatggagaccaccttccactcagagaggcatccgcagggatttgtgaatcaagtcagtcgcaaggttggatggtgtaacttgtcatcaacctggagaaagtctaaatgccttcacagacatattagtctgcttggactgccataataaataccagagactgggtgaattaaacaacagacgtttattcctcacagttctggaggctggaagtccaagaccaaggtgccagcagggttggtttctggtgaggcccctcactcttcctggcttgcaggtggccacgagctgctttttctctgcgttctcatatggcctttcctctgtgcatgcagagagaaagtacgctctgttggctcttcctcttcttataagaacaccagccctgtaggattagggccccactcatgacttacttaaccttaatgacctccttgaaagccttatctccaaatacagtcacaccggggtaaggccttcaacacatatattttgtggagacacagtttagtccataacagcaggcacatggggtctgaggatcgtctggcctctgccagcttccctgcaccttgctccctcccagaatggtagtctgctccaggcctgaccatatgccttgccattctctaagcacatcacacacttcctggcccgacgtgccttgcaagtgctcttcccgaaatccctcctccccggccgactcctccttccctgaggatcagtgctgtcaccaccacctcctcaggaagccctggtgggcaagggggcatctgggttctcccttcacctctcccgtcacctgctctctgatgttagtgttcctgcccatctctccctcccctggctgctgccccaggccctgtctgtaatgtccccatggcctagcagagactcagtaaatatctgttgaacgaattatcaggaaagtttgatttccagaaacacccgtggatagacgtcttccctccccagtgggtgctctgctgccttccctcacagaggtcggggccgtgtggcccagtgagcacaccatgggacggcagctggttctgactcagtagggcagagtgtgatggcctcccctcccccagagtgagtccaggcagcacttctagttatgtgcacacagaatcatctgggttgcattagcaggccccgctggaaacagtccttaacaaaattgagggctggggaaaatcggaggtgaacggtggggccttccccatcctgtgcagaaagacaaagcaggaaaagaggacagatcaaagtggaaatggtcccaagggaagcccactctctccagaccaggtgtgtgtcggtgggatgggtgggttccagaacaaggcgacctccgccaaacagcaggcccagctccacggccagcagcacaagcgagcgtgcacggttggttttttgttttaggcactaagaggctccagtggcctttaggtttctgatggaagcaaggtgagagcaggggcaggctatcttgtcccccattgaaacaaagtgagccattgcaccaggaccacaacagtgactgtgttttgtgcatgtgtgtctgtgtgtctgtggctgagcagctggccccctatgaggcccgggagcagcaggagctgagggcttgtctgcgctggcgtcgcctccaggacgagatgcaatgctcccccgaggagatgcaggtgttaaggtaaagctgcatggtgatccacagccctctcattcccctccttctttccttcaagacacctccctgccaactgatgacatctgctgtgtttcctttttaaattaagttggggtgggcttcttgtcccccagatgtgatggttatgttctaagtctttcagggcatgcgtttcgatttgccttccgtcattttcctggtgactgtttaggaaaaaactagcatgaggccatttccgggggtcagatccttcgtttgaagttctaacagtcactttacgtggtggctgcggatgtggcgagggttggggtttggcagcctggcagacagtaaacctataaagccaaaggggaaaaaaatctttaggaaaatattgattcctaagtgtttagtggtcacagatgtatgtgtcaatgggcccttttgtttccatcgtagcccagcaggaagcctctgctgctcccctgtgcagcaggattccatggccagctcctgagttttgtttgtagactgtggcttgtggcatgtgcaggattatttcatgccatttttccacgtttgtccctctctgctttgctccttttctttgtgaaatgtttatctgaaacctggtacctaggctccgggagcactgtggttgctatggcaacaggaggttccatcacctcccctcctcttccactagagtcagatgttggtaatctgccatcaaacaggtggggagggatggccatccaggaactgctcctctcctcgcctgttcttagatggccgccctgaaggcccatctactttcccaggcagaggcctgccttggatggttctgctgttgttgtttgtttttaaatatacacccccacttcgcctgactgtgactgaagcctaacgcaaatgcaccccagggagggagctggctgggacttttgtgcagcactgcagaatgttggggtatggcaagctgcacccttcccacagcaaagttccctgcgcttgcacgctaaggcggactcccaagttgactcatccattgtttcggaaaggagatctagcggagggaagtggagcgggccaggagccaggagacctgtgttcccgccccaaagccattgttccagcatcttttctcttggccaatgctgattgatccaggcaggacagctactcctatggccaaagtgaacatggcccctgctctcacagagcttccacttagcagggacatggctacaggtaccggccggtcacaggtggtgcgcagcactgtgagcagactgctcggtgatgtccatactaactggagggcggcgcataaggaggtggggaatttctctctgaaaatgagctgccttgtgcatagcctgcctgaggtgggaaaggccttcatgtgccttagggacagaaagaagggcagtgtggctggaaaagggactgagggcaggggccaagagaggcaggcaggagccaggtcacacgagtctttccccaagttcttcagaagctgctccaggaccttcagcaggaaggtggtatgatctgctcagtatttggacggtgctgctctgctgctgtgtggagagcaccacaggcagccgacggaaagccaggagaacggttgcagccttgcagtagtccatgcaagaggccctggagtgcctgtgacagatgcaagacgcagacctatttgaaatgtgttttggctgtggaacgggcaggtctttggttgattgaatgtggagaagaggaaaatgagtgtatccagaatgactttgaggtttttgagttggacagttgggtagatggtgatcccatttgtgtgatggtaaagacatgaggaggagcttggaaggaaaatgaagtttccagctttgcatgtgttaagtttgtgatgaccaatagatattcaatattatgaactttggagattacaattcaggagctcactggagagactggaacattcagcctataaaaccctttaaatcttgaacacagtgaaatcctcagggagagaggaaagtgagagaagaggtcaggaggaagagggggagccaacagaggactctggggaaaccattatgtgtttccccagagaaaaccagggcactaggggccatggaagccagaaaagaagctgaggcaagcaggtgggagtggctgatgttggaagctgcctgggggatgaagaggggcgaaagagagagaagtgggactacatgggtgatggagaaggaagtcaggctgaagtggacaggagcatggatgggaagtcaggaagcggggctggtaactgtaggctctgtgagagggggtgtgttggcccaggaagcgagactgggaaggtagcagagggacatgagggccagagaggtttgctttcaggtagggcgcccaggagcatgcttacctgcgagctgcctcactgtgcaaatcccttcacctcttaaaggctcagtccctccacctaagaggtcatttccattacgtctcttagtccctttgatccctttggttttgcataaccatagtccttcagtggggtaggggcatctcagtaaatgtgagttttggtgaactgtgtttccaacttgtaagcaagttagactgcaccctgggaagtcagttcacacatgaggagggcctcatctctggcttccctggagcctgagtcaaccaagcttctgatggccaagatcttttcctttgtgtgtggagttgggagaacaatctagtatttttagacctttgtactagacagttttttatggcatttgcttttctttgtcttcgtattcagaaattttgtttgcctaaatttaggctaaccatgaattgactgcatttgaaaggcttattgcacatcaataaggaaaatattgttatcagatgtacttacaatgaggaggaaatgtttccgaacctgccctgaattatatagtctaggtttcgtttactcccatcccctagaattctcccttaaatggacacagagaacctggaagttattgaaagtaaaaggaagaaccagacttgtaaaaatttgttctcagattttgttttcaatgagaccttgggaaagaagtcccttaaaaacaatcagatgctatcttgttctttctttcaagatgccccatggtcttgaaatgatgggccataacaacgtaaaaatctcgctttatgtcttgataggtttccacatgttggcggatgcagtggaagcttctcttgagatctttgccacactgttcaacatgtttgaccactctgtcctaaaaacgctttcttcttaaagcactttctcctcctggcttctgtgtgtcttactctccttgagttccctctgcctctgtggccagtccttcctcacctctcttgctggcaggttaacagtctccacttcaatagcccaaggctcagaaagactgagtaatgcgtctaacctcctctagctgataaagaaccaaggctcagaaagactgaataacgtgtctaacctcctctagctgataaagaagagaacagggatttaaacccagggacggaaactcttctcggttccctataccatattcctgtcttcagggaactgagagcatttagttgcattaaaacaaataaaaaaacaaacaaacaaaaaacctgcaggtatcttgggctctggaaggacatacaggtcagggtgaaaagtatgcttggtccaagcatcttttttcttttaacacatgaagtatgtgtcttattattttaaaagacattgagaaaaaggaacattcaacattctcttggttatagatactggagtattaacaaagtgaaaagagaaaaactaaaattttgtttggctctgacttactagttttagtaatttataagaacagctttccatttgtgcctttcatacatccactgagtcatgaggtttcatcaaatgtttctttttttcttttctttctttctttcttttttttttttttttaagacagagtcttgctctgtcgcccaggctggagtgcagtggcatgatctctgctcactgcaacctctgcctcctggattcaagtgattctcccacctcagtctcccaagtagctggaactgtaggcatgtgccactatgcccggctaatttttgtatttttagtagagacagggtttcaccatgttggccaggctggtctcaaactcctaacctcaagtgatctgcctgcttcggcctcccaaagtgctgggattataggcgtgaaccactgcgcccagcccagatgtttcttagattgactttgctgtgtttcctttgtatccgatgtgtctgagattgacttccttgtaagtcattcgttaacaggtttcttgtattttcctagccttctcagccttcattggctggagagcctgtaatgtggctacaggcttctgaggcaagacgatttgctcagtttcaaaatgttaggggtcacatgccatttttcatttgttaattattgaagatgtctttcccacagataagaccccaaggactctcccagactcttcatctcctctctggccctgggcagaactcttccccaggcaaagtctgatttcagtgttcctttctgtcctgccactgttcagctctctcctgtcatctatcccctgcctacaaggtcccctcctgactcgtgcagcagtggtggctcttgcctgagatgcatggcagcttccgaaaggctcgccatgcctcctgtctccagggtgcagctggattccggcagcttctgcctaagtgctttcagttagcacactctgacaggccccagggatggaagagctaaggtggcagggtcagaagaaatctgttgtttttttattgtttgtgatttattatgacttctctttttttctggattcattgttaaattcaagctcctgctgaggaaaacgttaaaatgtatcgctttaaggaggtgcaacaggcaggagtctatggaactcttaatcttagctgctgcctccactttgatacaatgctagataaatgcgagcatctttccctaaccttcctcctgaatgcctcatcccttgatcacaaaaacatcccttaataatagggggaaaaccccaagtatgtaaccctatccatagccaaaataaagtctgcatgccacaagtgttgtgaatttgtatgatgcctactgtacattccacttaaaataggaagcctttttttatttttatttattttttttaatttttttttttgagacagagtgtcgctctgtctcccaggctggagtgcagtggcgcaatctcagctcactgcaagctccgcctcccatgttcacgccattctcctgcctcagcctcccaagtagctgggactacaggtgcccgccaccacaccacggctaattttttgtgtttttagtagagacggggtttcactgtgttagccaggatggtcttgatctcctgaccttgtgatccgcctgcctcggcctcccaaagtgctgggattacaggcgtgagccactgcgcccagccatataccatcttatttttaaattgaaagcttacaggcttcaaggaagagtctgataaggagagaggaaaatctcagtttcatctgctttggtggcagaagctccaaaacggaaatgtcctggggcccctgcccagtgcaccagctacctgaggccctcctccaccaggacctggctctgtcgtcacccacggtcctctgtcctccaccctccctcccttccctctccctctccctctaactgctgactatgctcacacttctcccatctttttttttttttttttttgagacagagtctggctctattgcccaggctggagttcagtggcgcgatttcggctcactgcaacctctgactctggagctcaggtgatcctgccgcctcagcctcccaagtagctgggaccacaggcacgagccaccacacccagcctctcctatccttaataatctctcctttaaactgctgcaccctcatctaattatcaaaacacttcttgtctccattcccacagctcttaagaacttccagtcctctggaatctgctttctgctctcaccagtacaggaaaactgttttttccttggctcattgtgccctgacagtcaccagattatggaagcaaattttatttttaatcttttgagactcttctgctttgtttggtactgttgacagctcttctggaagtttttgtcactggcttttgtggcagtccctcacctgattcttcttgccctctgtcattcctcctccatctccttcgaggtctgccctttgcctgcctgtgtcttcagagctgatcttcctcggggcctccacactcggctgcgtgtcctcccagagtggtctcatctaaacccccatcttaggtgggagtctccaggtgcagaccctgatgcaaggggtatgggaaagagatttattaggaattgttctgatacgggttggctgtgtgtccccgcccaaatctcatgttgaattgtaatccccagtgttggaggtggggcctggcgggaggtgactggatcacagaggtggtttgtcatggtttaacaccatccccccttggtgctgtggtcacaatagtgagtgagttctcatgagctctggttatttaaaagtgtgtggcaccttcctccaccaactgtctccctcccgccccagccatgtaagatgtcctgcttcccctttgccttctgccataattgtaagtttcctgaggcctccgagcaggtgacagcatcatgcttcctgtacaacctgcagaaccgtgagccaattaaacctcttttatttataaattacccagtcttgtgtatttctttatggcaattcaggaacagactaatatatgttcccaggaggtggaaagggaagggaaatggaagtgaggaggccaagccagggtgccgtgacatcaggccaggtcatgcagggttactctggaagaagcatgggtcaccctcagttgttcgcatcaggcagtggacccccagggtgcatgtacccctgcacttgtctcattggttggaaaaatgtacagtcccaggtgcttccagctccatgtgttcacaggaaagacaggctcaggcaaccccagggccaccctctgacgaagagtcgcagagagcatgccaagggctggtgtgcacacgggtggggtgtgggcatggccggccatacccccttttaagccaaaggctcccaagtctccaccagcagccccactctctctaaagatcaagcgtgaatgcttaactccccgttgacatctctcctggttaccccacagtcatctcttactgatcatcccctctaccctgcttcatctgctcccctcccatagtgttgtactcatcgctggtggcacaggtccacccacaacagggtaggagactgggagctccagctcctgcctctccttcactccttccctgggagccattgctaacaactgccaatttcatctcctaaggatttcctcaattcaactcctcttctccacccctaataccactgtctctctcttcaccacttgcttgtagcagtccaacagccccaaagtgttttctattttctacttctggtcttgcccttccttgctgccaccagagagctctccttaaaacacctcatggttctgccacctccttgctaaaactctccaaaagcttcccctcacctgcaggaaaatcttcaagccccttagtgtggcatgcaagtccctgcacatcacctctgtcccccatctcatctcttgtcgttctttgctttaccctctccctccaggtagctcagagacccctcctgtggtagtcagctcgggctgccataataagttactaaaggccaacataaatttatcttcccacagtctggaggccaggagtcccagatcaagatgttgacagatttggtttcttctgagccctcactccttggcttgcagtcactgagcagaaaaaacaaactgtttttcatctgctctcactccacaaccatcaacacagaagacttctgtggccaaatgtgtaggaggtttccccacacaccaagcaagcaataacttctgtagtggacaccagctgggtgtcctctaattcagtttaattctgacactgtccagagcatcagatcccacagggtgagggctcagtcccacaagactgccttccacctccgacaccagtcacacgccccaggttgtctaccctgtgtttttgaccaaccaactataaattggggttcccatggctggcacgttgggtttattaatttgctagagcagctgacagaactcagggaaacactcacatttactcctttattataaagatattacaagggatacaggtgaagagatgcatagggtgaggtatgagggaaggggtgtgaggcttccctgccctctccagatgtgcccctttccctgcgttcagctatccagaagctctcctaactttggggggtttatggaggcttcgttatacagacatgattcgtcaaaccattggcctttggtggtcaacttgacctttacccccgtcccctccccggagattggggggcggggctgaaagtcccaaccctctaatgctgccttggtctttccagtgaccagctcctcctgaagctacctaggggctgctagccacccatcaactcattagcatacaaaggcgtaattgtgaagatccagaggattttagaaattatatgccaggaaacgaggacaaaaaccaaatatacactccacagtgtgacagccatcttctcgctgtgtcctcaagcggccttttctctgcgtgtgcatgtccctcgtgtccctctgtatgtcttaatctgctcttcctaaaggacactagtcacattggaataggcccaccctgacagcctcattttaatttaaccaccccttgaagccctcaactgccctatctccaaagacagtcatattctgaggtacagggggatatggttccaacatatacatttgggggaacccagttcagtcatagctcctaccatctgcctgctctttcttacctccatgccttttaaagatgttgtctctatttagaatatccttgccttgctgcataattccatatcattatgactcatcattatgactcagcacagattgcattgccttcccagaaactctcagaccctatcctaatgtaagctgctgtccctcctctgtactcctaggctctcttctctgtctctctctgatcttactacatgatttggtcattctttttatgtttaccacattaaattgccaatatttgaccatttttgccctacaagaacaatttcttttttcttttttgagatggaatctcgctctgtcacccaggctggagtgcagtggcgtggtctcggctcactgcaacctccacctccctgggttcaagcgattctcctgcctcagcctcccgagtagctgggactacaggcacatgccaccacacccagataattttttgtatttttagtggagacaggatttcactgtgttagccagaatggtctcgatttcctgaccttgtgatccacctgccttggcctcccaaagtgctgggattacaggcgtgagcgaccgcgcccggccaaaaacaatttcatatggtccaaccaaatacatatctcgcttctgaccctcagacttttgtccctagggattacgtcttgtttctcagtgcaccacagtgcttggcactgagagggtgctccgtgagtgttgaaaaaatgaatctcatagacatgatgtctgtccctgaggttctttatatgttatttggagagctgaaatactggtcccaagatagataggtaatcctaggctacatcctcagagttctaagaactgagagtttactgttgacagatttagttagaaagggctacagggggatgtgaggcttgagctgggatagtaagaaaggataccactgagatgggtgaagaggcagagggagaggaattcaaggagcaaagcctggtaggcataaaaaggaatggattgtggatgtggacattaacatgagaatggacttgctggagaggacagccacgaaaagaaccagtgagactgaaggtgggccaggcaaggctaggctaagtcatggagctcctcggatgccaaattgaagaactcgtatgtgatcctctgggtaatggtgaggtattttatgttccaagaatgacataatgaaagtagagttctaggaagattacccagcgtttgggataacatatgatcaaagagaaagagtctagagaacagatggaatcaggtggctgtgtgaggaacagaggcataagttcggaagaccttggttggcctaaagatctgactgaattgttcatttgcagctatcaaaaatggattgaaagaaggcttctaggccgggcgcggtggctcacacctgtaatcccagcactttgggaggccgaggccggcagatcacaaggtcaggagttcaagaccagcctgcccaatatggtgaaaccacatctctactaaaaatacaaaaattagctgagcatggtggcaggcgcctgtagtcccacctacttgggaggctgaggcaggagaatcacttgaacctgggaggtggaggttgcagtgagccgagatcatgccactgcactccagccttggtaacagagtgagacttcgtgtcagaaaaaaaaaaaaaaaagaaggcttctaataatacaatgtaaagccatccccattgtatataaggattgacccattaaaagaaaggttaaattcgggggttctgtgaagtttgtgagtctttgaaaagagggaaagacaacagcccatgttcctccttggccaaggtctggttgatcctgcctcgtgttagggaggcatcatctgaggatatggattgagcttcactccagagctcctccgcccttggtcttgacccaggatggtaggatggggtttatgagaatggctgcctggatgagttctgactctactacaggttcagaatttctaatatgaaaatctgaacaaaacttcctgggcaacaacatgaccactaatggaaaatttcatacctgatctcatgtgatggtggctcccagtcaaaactttgtttcatatacaaaattatttaaaataatgtataaaattaccttcaggctatgtgtataaaaggtactcagtatcctcggggcattggttccaggactgcccccataccaaaatctcaggatgcatagtcagccttgtggaactgaggaaacagaaagctggtcctttgtatctgggggttctacatccctggagtactatattttcagtctgaggttggttgaatctgcagctgattgaatccaagcatggagaacctgaggattgggaggaccaactatatatgaaacataaataaatttgtattttgacttgggtcccatccccaagatatttcatttgtatgtagatattccaaaatccaaaaatatcggaagtctgaaacacttctggttccaaatattttggataaaggatactcaagctttacacacatttgctgtgtggccttgagagagttactcaaccacacttagctttagtccccttagctgtaaaacagggatgattaacacaatagtttctaccttataggtggatgtgaggaataaatacaatgaatacatgcaatccatttagaacatgtatgttaagttgaatcacaggcaattgctgttttggtggatctaaaatgaatattgtcagggccaggtgcggtggctcatgcctgtaatctcagcactttgagaggccgaggcgggcagatcacttgaggtcaggagttcgagatcagcctggccaacatggtgaaaccccatctccactaaatataaaaattagcctggcatggtggcatgcctataatcctagctactcagaaggctgaggcacgagaatttcttgaacctgagaggcagaggctgaagtgagctcagactgcactccagcctggacagcaaagtgagactccatctcaataaataaataaataaataataaaataaaataaaatagaatgaatattggcaatttcctacagttcaggtaaatacttaacacgtttgatgctatcatctatgtcctctggcacttggaaaaggtttgtccaacaagtggcagagggcacagggacacagcccccactgcccctcctggcttattctgatttcctcagcctggctcgtcccctcatgtccgcatggctctggagctgggcccttccctttccctgctgccacccttccctggggaccacacaaggcatctgctcctgtctcttgaccaaccagaacatggaaacacctccctcccttcctgacaagtataattggctggaatgttcaacaagttaattttactaattaagagaatgttaaaaaaaaaagtgcaagaatgcctggttacaaatgtagagcacaggcataaaaggaaagagtctgaaagttcaacagagatgctcaagcaaatcgctagaggtaagaattgaatgagcagcacttctaagactacccttctggaacctacatctagtccagcccctctgaagggcaacccttgggtcccctctggctcttctctgtaaagctcctctggcctctgttcaaaatctcaccactgtccagagtggaaaaaagttcttgcctttatggcttccgagagttcctacctgatcattggcctgtgcctctcctaaggtctcaactgtatgtcttagaattcctgccctacacccctctatccctcaggcacgtgggattcccctacccactcctgtctgtctagtgtttttatttgaaccacatacactaacaagcgacctgtgaagagtgtttctacctgttcttgatgggaggatgctatacctatgccagcattttctgaaaaactttagagctctcagctagccagaaatggactctgccctttcctgtttcaaaggtcagctccaccagcctgagctgcccactcagtttgtttcctgttagagggacaccctcagctctcagctcttttaaacagcaaagatgacagacatgtcctgaataattgaactcaaataaccttccctctttatttttccagaccatttcctggttagtcagcactcaggtctttctaagggggagagaattctccatagacccctaattacatatttacagtacttggtgtttcatttttgcaataacatctagtagggtcctttttctttatatagaaaaacatgaaaaagcaagacatttcataatcactggttagttaactttggttaatttttttcaaagcacatagtaagaaaattcaagcagtttagaaaagtataaaattccatttactaccactgtagtcccttacccaaagataattactgctactgttttcttgtgaatcttgggaaagtaaattttgtaagtatacatgcatacttccatattgctgctccgtgtagcactgattcattataatgctatttgactataaaatatttcgtacaaaattattcatgtacatatgccagtccataataattcactcttattttgcccatcctaaggatatcttatgcactcagccagtaggaagaatcactatgtacattacatgttcagctaatgagcgttagtttcccattcagaaaaactctcatccagtgagtgctttctcatgtaacgccaaattcactttgttccacagagtatttgcttacttcctgtgcccctttttcctaccatttagtttgtgttttggccaacagttttgatctagaatggatgacaaaaactatatgggtattctgctggacctgccacaaagacacgaaagaagaacatcctgctagatgttacaaatctgctttacaggagttcttgcccctttcaagtcaatggttgaggacagaaggaataagaaacagggactgtactattcaacattgtactggaggttatagccagggcagttaggcaaaaaagtgaactacaaggcatccagattggaaaggaagaagtaaaactgtctccatttgtagacataatcttatgtggagtaaatcctaagtaatcctccaaaaaaataattagagctaataaacaagttcagtaaagtttcgagatataggatcaacatacaaaagttagctgtatttccatacactagctaagaataatctgaaagttaaattaggaaaaattcatttacatcgcttgaacccgggaggcagaggttgcagtgagttgaggttgtgccattgcactccagcctaggggacacagtgagagtctgtctcaaaaaaaaaaaaaaaaaaaaaaatcatttacagtagcatcaaagataataaggtactgattcaaaacggatcaaaaacccaaatataaaagctaaaattatacaacaaacagaaaaaatgtagatgtaaatcttcatgatcttgcattaggcaatagtttcttacatactagacactgaaagcataagcaactgaagggaaaaagaatcagtaaattggactgcatcaaaattaaaaacttttgtgcgacagaggactccatcaagaaaataaaaagacaacctacagaatgggaggtaatatttgcaaatcatatatctgttaagggacttgtattcagaatatataaagaacacttacaactcaacaataaagacaaatgacccaattaaaaaatggtcagtctggaccgggcatggtggctcacgcctgtaatcccagcactttgggaggctgaggtgggcagatcacttaaggtcaggagttcaagaccagcctggccaacatggtgaaaccccgtctctactgaaaacacaaaaattatccaggtgtggtgacatgcacctgtaatcccagctactcaggaggctgaggcaggagaattgcttgaatctgggagatggaggttgcagtgagctgagatcgtgcccctgcactccagcctaggcgacagagtgggactccatctcaaataaaaaaaaaaaagaaaaaagaaaaaaaaaggatcaatctggctgggcacagtggctcatgcctgtaatcccagcactttgggacgctgaggcgggcagatcacttgaggtcagcaattcaagaccagcctggccaacatggtgaaaccccatctctgctaaacatacaaacaattagcagggtgtggtggcacgcacctgtaatcccagctactcgggaggctgaggcaggagaatcacttgaacccgaggggcagaggttgcagtgagctgagattgtaccactgcactccagcctgggcaacagagtgagactccatctcaaaaaaaaaaaaaaaaaaaaaaaaaaaacaggtcaatctaagttgacatttctccaaagaaaatatgcagatggccaatgagcacataagatactcaacattattggctatcaggaaatacaaatcaaaaccacagtgagataccacttcatacctactaggatggctacaatgaaaaagacagataataaaaatcagtgaggacttggaaaaattggaacccttgttcactgttggtaaaatggtgcagctgctgtggaaaacagcctggtggttcctcaaaagcttaagcatagagtgaccatataaccctgcaattccattcctagctaaataaccaaaagaaatgaagaaatcatatgcaaatgttcataacagtattattcatcatagcccaaaatggaaacaacccaaatgtccatcaacagatgaatggataatcaaaatgtgttatatccatacagtggaatattaatcagccataaaaaggaacggagtactgatacttgctgcagcaagggtgaaccttgaaaacattatgctcagcggaaaaagctggacacaaaaggccacatactgtatcatgtgatttatgtgaactgtccacaataggcaaatccatagagacaaaaagtagattttttatttttatttttttattttgagacagggtcttactctgtccccgaggctggagtgccatggcacgatcatggctcactgcagccttaacctaccaggctcaaacaatcctcccaccttgatctcccaaagtaagaagtagattaatggtcagggcctgggtggaggtgggaaggagattggggagtgactgccagtgtgtatttggtttctttttagggtgattaacatgttctaaagttgattacattctaaagtttattgcacatcatcaacttatgtgcaactcataaggttgcacaaccttatgagtacactaaaaaccactatatgtgaattacatctcaattttttaaaaaagagagagattgatggaaatcatttaatgttctctactgtctcataatacccctgtagcctggtggggttgatcaacaatcatctggaggagacatggaaaaagaaattagggcaggaggcgactggtgacctccgaggtttggatgagacccacggggccatttccagcgttggatggatggaagacatctccatagggtctgtgatataacaaccccgtggaatgataattcactcccaagaaagcatccctcaagcacaagtgtatacacacaagattgtgtgttttatccatgccatgctatacctcccattgtcctcttaataatagaatcctggctagtgttctgtcatcaacacagtgaattatttgtttttttttaactgctgtgagtattcccagatatgaatgttccgttactaaccatcaaacatttgttaaccattgggcgtcatcatggtcatttctagttttttgctttcataaacaatgctatggtgaatggtctcacacttactgttagatgcactgcatgtgaaatagaagacccaaagagcacactgttgctggcaaggctgagaagagagctcctctgctgaggactcgtcctcttgtgcatcctggtatgtactgggctgaaaaccaggcaagccctccacccctgccgctgccgcccccatgcctagggccgtgctgtcctccactgaggagggaaaagtccttctccagctcccacgggccatctgctcctcgttgagtcatcagatgaggcgatccttcccattacctcagcacacagcactgcacatgctgttggtgttcaaaacgggcttcgagcctcctcttgtaaaatgaagccaatgtttgtctcatttgcctctttccagaagaagtcgtgattttttttttaatgcaatacagaaaaagttttccatttttattctttctacttttgcttccagtaattttcaggttctctgtattcctgtgttctgaatgtgtatggcacaccagcagcctgagttatggctgagtcactatgatcaccttaaccctgatagatgaacccagcttatgaggagacctgtctcagcacattgcacagctctaccccgccccaaacagaacactgtgaaaagtacagtcaaggccttgtactgcctggatcctatactcaaaaagttaattctatctcgcaatatatatttaatacaattcagttaagcttcctctaaataattcatttagtttagtttttttgaaatgaaaaccacacttgatgctgatttagcaaggccaaagctatgtagcaaacctcttgactctactgaatggatgaataatgttttccttcacatgctttagcttaaatatattccgggctgtacagtctcttaaaattgtagatattagagtcagaaaggaccttaaaagtgattttgcctaaccttccctgtgcctgacagatggccactcagcttctacctgagcagttccaggatccaggtctcattgcactagcaaacagcagatttcctgtgctcagcttctacctgagcagttccaggatccaggtctcattgcactaacaaacagcagatttcctgtaggaagagcctgatccttagaatggcccttctcagatttggctggaatctgcctcctgtaacatctgcgcagtcctcttagctcttatctccagaattgcacagaatgcgccttgctcccaccaaaacaatctacgtatctgaaggctcttctttcttttcctgaccaataggtcacttttttgggtgaatttagcatatataccgcatgcctgggagaacgttcgctttcttgggcttggtccttggttgttctctttgttgacagtggtcttctccaaatgtgacaactgaactgaacacagcctgctttgaggcgccacccatgaagcatggagtggaactgttattgcacccctggatctggatcatccagaaaggaaggacaagtgttcatccagtgggattcactcagatatatatatataccatgtttcttttttgttattcttttttttttttttcgagatagagtctcgctctgtcgcccaggctggagtgcagtggcgcgatctcggctcactgcaagctccgcctcctgggttcacgccattctcctgcctcagcctcccgagtagctgggactacaggcgcctgccaccacgcccggctaatttttttttttgtatttttattagagacggggtttcactgtgttagccaggatggtctcaatcacctgacctcgtgatccacccgcctcggcctcccaaagtgctgggattacaggcgtgatccaccgcacccggccttttgttattcttttaagagatgggtctttctctgtcgcccaggctagaatgcagtggcgcaatcaaagttcactgcagccttgaactcctgggctcagtgatccacccacctcagcctcctgagtagctgggactacaggcgagcactaccacatctcgctttgttgcccaggctggtctcgagctcctggcctcaagggatcctctgccttggcctcctgaaatgctgagattacaggcttgggcccctgcacccagccccatatttcatttttacattcagtataatacaccttgtcatggcagttctaccattccaagtcccatgcatttttcctccttaataacattctttgagtgcttttaatatgccaaacactgtcctaagcattctatatacattatctcatttgatcccaaaatggccttgtgagagaagtgctggtaccatagtaccattttcctccccatttgatagaggaggaagcaggtgcatggagatattaagcagtcagccttatctgcacagcgagtaagcagcagcactggggtgaaagcagaggcgcatctgaccccagagcccagctcctaactgctcctctccacatcacctcccccagtgggattcccattacatttgcattcctcctgttgatccagcccacccttgtgcttactatgttggaagccacagcagtcacctcctgctacatgttgagtttacagaaaattaaatatactaaatatttttcataggcaaacagttaattttttaaaaactctttctctctattagatattttcttcttattcattggaccctcagttcagcctgcggttgctgttcttgactgtggatgctgtcagtcaaccaggtagactcccaactatagctcataggcaaatctgttaagccagtaaatcaccattccttaggcacagacctaaggatctccatccaggttatagcaaataattaatcaacacccttggggctctgttttttagccttgtataaagccgtgaaacaactaccatatgctcaccgttgcatgctctccaccacatccattctactagctgccttgcagaagtcaagatgccccactgaatttctggaattggccctcaggatcccattctaactcttgtagttcatcattttctcttttaagtgctcacaaactgttcaataacgtcatcacaaattttgccccgccccccatctcttatctttgcaaatcggaatagctgtctacctccttcagcttctttctcattgtctgtgtgaattgatcctccccgcagagatctgtgatcacatatcacaggtggaagctttcagagctatagcctgtccctcacctggacttggaatgggaactcctttaaagggtgaaggagccctgtctaccagtaccaagcagcagttcccacatagcagggcttattctaccatgagtagcttgaaaatcattctccttggcaggaaagttgaatcaaaatgggagttgagtcattctgttctttctgccacctcttggcacctggtcttccttatgctcccaacttcacctccaaagccctttttgttgtcctgggccttctccactagcccatcctgaagttttgccttcttggcagtcattttacagcctcccagctctctttatgtagcgtgggtttttcctttctccagcatcccgttcaactattgtctgtgttctctgaaaaccacccttagcagaaactgcctgtgcagtcacatgggtgtcttggctctccgtttttctctgtctcttttgagaatgtgtctagatcatcgcttgctgtgttgaatgggacaatatagcactcagaccattgcattgattggtttcttattttttctccatgtggtgttttgcttctcagaggaatttctgatacatgggcaatcaagacctgaggacattttggttttgtgttgatactcattgcttttctgagtttcatctttcattttcccaccctgattattaaaatgtgtggagtttgtttgcattttccacagttctgctaactacagagtttctccttatcaccttctttagcagccgacccgggacgctgagacttcttatgggtacccaccactgggtcctttcactctcaggaggacagaataaaccttgtttattttcccgtggctcctcagagggatcctccttctgtcttaaatcatcttagcaattgcctttttcaacaccagaggaatatctttctgtgtctgctgcaggctgatggtcccagtggggaagcccttcctgctgggtagctgttaaatccattttgaaaagcatacagacagtcacacctgccaaataccagcggtgttgatacaatacaaatttattagttaaaggtttattcacaaccttttggtagcactgcaaatgctagtcagtggcaaatgttcattattcacagtttatagataggaaaattgtcaccgaaaacaaacagtggatagagaattcctgtgctttcatcattctgccttcattttttacccagaggtgtcttcgtggagcggtgtagaccaaggggatgagtgtgtaaggaagatgcccagacctagcttagtaggactttatgtggctcttgaaatttgttgtttcttttatttattttctgatgatgatgagtcaaggagcaagcttaaagaccagcccttaaagggtttgcattcaaaatcagcagtctcaccaagggagagtataggctacatttgtgtgtggtgtcattaaaaccttttcattttggaataggtttagactcccaagaaattactgtagtagtagagtgagttcctgtgtcccctcccccagctttcccccatgacagcatctcacatgcgtaactatggtgccatgtcttcttaatgtctttgcctgtcagaggaaggtttagttgatgctactggaggctcagtcagaacatagtcggaacacagaacgcagataatagccacatttacattgagctactgaatgccaggaggagctctggctgagtgctctggtgccactcagctctgggagctgccccagtgactcttactgtcaccttttcacagatgagggagccggactgcatggggcttatgttcaagatcacatggcagtggagagacttgggtccaagccctcacccagtggtcatgctccttcccctgcaggtctcacctgtgcatctggggctcagatgggcactgttggccagtctctacacaagggtcagatttcacttcctccattgttgcagggtgagtgaggtcctgctctcaaagctgtcaaacctggtggggcagctgcgactaacagaaacactgagatgttgaaatgatcattaattcccttctgtctcatttctgggatgcttagtccctggctcaggcgtggcagcagcaggtttatagttgaagaatctcttgtggctctcatgctgactgctgggagtgtgagaggaagagtgctgctggagggcccgcctgggtgggggcagagcagcaggtgggtattcagacccagctgacatgccagaggacagttcagaggcattttctcaaatcccacccttggggttatcctgcaggattggacctttcttcaggaggcccgattcgaaatcaaatcattatgtatcaaatatcactgccacctgcccactctttaaatatccacattgcctctgtggttgtggtggaaaaggaaggcgtggggaagggaaagggcacgtcaatctcagttgttgcatttggtgccaagtacaacagaaaccaagggcatttgagctcagatgaccttggtaacttgatctctcacattccatgtattccagccaaagaaataaacaccagagtgtaatgtctaagagatactgaacacttttgcttttatggaatgcttccacatgacctgagcctcactgcagactttacaggtgaggaagctgagcttcagggagggtaagcaattcctctaaggttctccacttagtacttggcacagccaagatggggacctggatcttgggggggccccagagtgtagcaaggactttggtgttctgtggacctgggttcttaacctcgactctgccactaaccagttttgtggtcttctctaggactcactttctttaacttttaaatgggcataaacaggatgtggcctcatcaggatcttatgagggaagagggtgtgatgcataataagaagagcttggctgagtacctggcacagaggataaccaggaaacgttagctgttagtactagtccagttagaaacgaatctggctacaattattgcagcaataaagcaatggttgacttaaacaaatggtagttatctttcacacacaatacaaagtcagaaggcaggcatccccaggctggccaggagcagcatgatgatagtaaaggctgtttgccttccttcagtccattctgctctccacagaatcctggtttgctgcctcatggttgcaagatggccatcactgctccatccaccaggcttgtggggaagaggtgcggtagcagtcacattttccccctttataaggaaagcaaaagctttcccagaaccccacccagcatggaatcacagcagacatctgcttttttcattttggcctggactaagtgccacagctgcaagagacacttagaaaatgagcattagcttttcagattcagtcatacaagtggcaaggaagaaggcaaatgagaatgggagtagaccgaccagttggatttgccacagcccttcctgcctctcacactgtcattttaaaaaaaattttgcattggtcctcaggtgcatagggcttagttcatcctagtcgtgtgccagtggcacatgagtggcaaagccccttttctagactgatggcctttcctgctcgcaagtgtatgctgtttcatgtacgtgcatcgcttaagtttttaaatgaaacataacatagatacattaaagtgcacaagtctttgctagatggctcaaaggatttttatgatttatccccatgaaagtacattcagatcaatctatagaacagtcccagcatctcagaaaccttcctgtttctctgctgtctgtcaacactccctcccaaggtgaccattattctgatctctatccccataggtcagttttgcctgttcttggatttcattgacatggacttgtacatgtgtgtgtgcacttcgtggacctgacttctttggctgacctgtgagagtcatctgtgttactgtgtgtggttgtagttcatctgctttctccggtactttgtctctctacgcagacctggtattagtagcattgtgagaaccagagtagcacagagatggaagtttcctgtttccattcatagagtgtcatttcctcctagaaaccaccccctctgatttcttgcaaagcttgcctgtgcactgccctctccagcagcaagctgctatcaaaggaatctcttggggacttgtatattggctttgaatgctgtcagcaggaagaattttcttgagcacttcttcatttggagaggatggaagaagagagttagagagggatgctttcgggaaggacatttttaggcaaaggaaaaaacagcaactgaaggcgtcattgggaactggaacctggaagccagccttctgagcagagatttacatcattcttctgtgttcctccccttcgagcagtctcaattcagggctcaagggcaaaaaagacgcacggcaactctgcctgtcttagggctgggcaacctagtttgagttcagactgactcttgagaagtctcccttcccccagacagtgggtgatgggctttccttatcaaagctagtgtggctttcttacaaaaacattgcatggcaggacaaacctgagagcagtgaaaaaagctgattcttttcaggggagtcttaaatgaagatgaaatggattagttattcttacaagtgtgggcatgtaggtaagtcagggatcgagtagaaaaatgaaaagtatgcagttagctctgatggttttcatcatcatctttcctttaggtatctgctgattctgtgccttgtgtctgctgggataatgtcccagagtattcagctaagacttaatcagggatcctgtttgctaaaatggaatattttattaagtttattaggtaatttctgtatccctggcccttgctaggggctttgcaatgtattatttcagttattctctgcaggatcagggaaggtgggtaggattattcccattttacaagtgagtaaatgaaggttagtaagtaacaggtagtaagaagtaaggctgctagtctaaactaggtctcatattccaaaggctgcataccttctgcaccaccacactaccttttaaaataaccccttgcttttctgatgcaccaaccctctcgtggttccttgccttccttcacctcaacactcctcagtgttgatccagtgagtggccggttttagaacagccgaaagctgtaaatacctcctcacttattttgattcagctgttgaagctatactgtaacactgcacaaatctttactagatggcccaaaggatctgttacattttatttaaaatatttaaaattttaaagccaaatagcacagtggaaaagatcttcatggagaataaggagtcgctggtttcagtcctaatgtcactacaaatcaaaacaaggcataaagctgggcgtggtggctcacacctgtaatcccaacgctttgggaggctgaggtggacggatggcttgagctcaggagttcgagaccagcctggccaacatggcgaaaccccatctctacagaaaaaaacaaaaattagctgggtacggtggcaggcttctgtaatcccagctacttgggaggctgaagcagaaggatcatttgagctcaggaggcagaggttgcagtgagccaagatcgcaccactgcgctccagcctgggtgatgggagtgaaaccctgactcgaaggaaaaaaaagactttgagtggaccgtgactatccagtccaatcttttggcttccctgggccacattggaagaagaagaattgtcttgggccatgtgtaaaataagctaacactaacgacagctgataagctaaggaaaaaatcgcaaaaaaatctcgtaatgttttaagaagtttatgaatttgtgttgggctgcattcaaagtcatcttgggccacatgtggcccatggatgggctgtgggttggacaaacttactgtagaactaatgtctgtgtgcctcagtttaccttgtgtgaaatgaggaagttgaagtatgtgattcttgatgttcccacctgttctaaaaacatgagcttctatgacctttttttgtaattctaatatgggtggaaagtacaaatatttattaaaggagccttaattactaagtgcaaatccagagaagtggataacattgaggctttcaaaattttttgaaagagatataagttctttacttttccaagtaaagcttcattttccattgcatttcccagtctgtcatcaaaaaagggtatacgttcttagataatttatagtagagcttagaacccttgagggtctggcagactttaattttggataaattgatgtaaaatatttgccaatagccaacttcaggttcccaacccaaatataaatcccgtagacgagtatgtaatacaaactgttctaaattatacctggtactgttgaatagaatcaggatgatattgagcaactctgaaaataacaaataagatgctattatgacctaattacttaagaatgtgctatacttaaataaattgttactaaatcgttttagacccagtaaagacaaaactggccacacaagtgactcgggagcatctgttatcaagcatggacttaatccggagaagatcttcatgcaggtgcattatttaaaggtaagcacatgtcagttgcagaagccagtgattgtggtgcagcactttttaggccacacaattaaacaatgatgattagtaacaagactgaggtgaaaatactgtaatgatatctgactggccagatatctgagcgttcagtaattaaagcacttcatgcccaaaaaaggagaccaagttaggaaagactgaatgaacaaaggctgaaatattccctgccctgtacctctgttctccctgcctgaggagcagaactctcactttgctgtcaggttccaactgaaagacatgggtgagaaggaagtgttttctgtcgtgaaggcctttcctggtagggggagtagagaagaactgggtctctcttctcttttcatctgcgatggacaaccagccttcatgtgaaccaagtccaaacaaaaatgatgacaacattaacaaaggagttgagaactaattaatttccaggccacgccttcctggtgaaaatggaaagggcagccagggacaggtaggacggcacattctagatgcacaagtgcactatgggttaggtagggctgactatataaccatttttttatgaactcatggtaggcctctttttctctctcttttttctttcttctagggctacttccttcttcggtttcttgccaaaagacttggagatgaaacctatttttcatttttaagaaaatttgtgcacacatttcatggacagctgattctttcccaggtaacttatgggtcctcatgagtccatgatgtatgactggagggggtatggcacatgaagattagattatgccagtattaaagagtagggaaaaggtttcccatttaatgcagtgggaaaaataggaagttaatgaaatggacacaaagaaagggttgcttcagggaaggtgatctctctgtagttttgaaataaactataacccaaagctgtctcgtacacagtgatagttaaagacaaaaataaaacaatcctgccgttctctttacctggacttatctttggaagactgcctccttcttaccttctagttttcagtttgaacgccacaggctccaagtcacccggctaaacagatctgcatccaggctcacgtgtcccacccctttgccctttccattgccttcattgtcattgccattgtctgtaattatgttttcatcatggggctatttgtttcttttcgctgtcctccactctacgtatatgcccaacaaggccagaccattctatttcaccagtacttagcacatgattggcacacagtaggtactccataaatatttgatcaatagattaataaccagatacactgaaatatgcagacagcctggccacaaaactatcagagagagaccctgtcagctcgtatgggcatggggccaagcagcacatagcaaggaagttaacaaggagtggcaggctctgaaaaatgacactcataactaatagaaaataggtgatgcatccttagcatagattggactaatggacctttttcatatttgataattgtgctcatatacagctgtgagtctcattatctccagtgttagatgtaaaggatgtgcacgtataatttgaacacagatggaagaatcacatgagcgtaacaagaccggatggctgttcctctatgttctttttatttttgtactgggtgtggggaaaatcctccctaagcatatatttggaaaagcaattcgaaaactggttcagaagtcttacatgcttggttgactgattagtacaaattcctactgcttgaagccacttctcaccaagagactgcagtgttaaataagtgcattgtatttaccatgacttcggaggttttgattttcacttcccatggaactcttactgctctcttaaccaaactgttcagttcttcgtttgcttctctcttttttgttgtttttttgttgttggagacagattctcctctgtcgcctaggctggagtgcagtggtgcgatcgcggctcactgcaacctccacctcccagattcaagtgattctcccgcctcagcctcccgagtagctgggattacaggcgcttgccacgacaccctgctaatttttgtatttttagtagagatggggtttcaccatgttggccaggctggtcttgaacttctgacttcaggtgatctgcccaccttggcctcctaaagtcctgggattacaggtgtgagccaccacacccagcccgtttatctcttttgaaaagcttcattgtttcttcatagcaactttattgagataaaattcacataccataaagttaaccctttgaaagtctacaagtcagtggtttttggtatatttacaagattgttcaaccgtcatcattatctaattttagtacatattcaccaaacccagaagaaatcattagcagtcatttccccatttttactcccccagccctacataaccactaatccgctttctgtctctatggatttgccttttctggacatttcatataaaagaatcatatgctttgagaacttttgtgtctagctttattaacgtaatgttttcaaggttcatatagcatgtatcagtacttcattcttttttattttaatgttcatttaattgtaataaaatatacaaaaaaaatttaccattttagccatttttaagttcacaggtcagtggcattaagtacattcacatttttgtgcgatcattaccaccatccatctcccataccattaatatttcatcatgataaccctccattctttcctcccccagccccagcaaccgccattctactttctgtctctgtgagtttgactcttctaggtacctcatgtaagtggaaccacacagtatttgtccttttgtatgtggcttacttcacttagcataatgtcttcagaggtcatccatgttgcagcatgtaccagaatttcttcccttcttaaagctgaatgctccattgcatgtatatatcacattttgtttacctgttaattctttcatgaacatttgcatttttttcatcttttggccattgtgaataatactgctgtgaccattagtgaataaaatatctgttcaagtccctgctttcagttattttcagtatatacccagaagtggaattgctgggttatacaataattctatgtttagcttgttgaagaattgccatactgtttccatattggctgtgccattttacattcccaccagaaatgcacaaggcttccagttttttcacgcacttgccaacacttaatgccctctggatttttttattattgccatcctagtgggtgtgaaattatagctcatgatggttttgatttgcattctgtgatggctaatgattttgagcactttttatgtgattatgggccatttcttctttggagaaatgtttattcagattatttgctgattttaaaatttcgattgtcttttattattgagttttaagactactttatttggatataagtcccttatcagagatatgattttcaaatattttgttttattttatgttttgtgtttttactctcttgatggtgtcctttagagcacaaaagtttttaattttgatgaagtccaatgtatctattttctctttggtttattatgctttaagtgtcataactaagaaactgttgcttcattaaaggtcacaaagattcactcctatgttttttttttaagagttttattgcattagctcttatatttagtcctctaatctgttttgaattaatgtttttgttttttttgaaatggagtctcgctctgtcacccaggctggagtgcagtggcgcggtctcggctcactgcaagctccgcctcctgggttcacaccattctcctccctcagcctcccgagtagctgggactacaggtgcccgccaccacacctggctaattttttgtatttttagtagagacagggtttcaccatgttagccaggatggtcttgatctcctgatctcgtgatccacccacctcagcctcccaaaatgctgggattacaggtgtgatgaattaatttttatatatgttgtgacgattacagtccaacttaatttttttttgcatgtgaatatccagttgtcccataaaccatttgttaaaaagactgttctttccctccattgaattgccttggtacccttgccaaaaattagttgatcattaatgtaagcattcacttctggactcccaatttgattccattaatcattatttctattcttgtgctagtatcatattgtcttgattactgtagctttgtattaactttggaaattattgcttttccacctggcatatactcattataaaaaattataagcaatgcagaaaaatacaaagaatgtgaaacattactcaaaatcccaccacccagaaatacctataattaatattgtgtgagtgacactccagaaatcatactatttatccctcaatgtttatatgttatacatgatatatatacatgtatctgtgtatgtatgtatatatggcatatgtgtgtatacagacattgatgtcactggacagaaataattttataaaaataggattatattatatgtgcattttaatgaagtgttttaaattttcttttacttgaatttaatgaatgaaaaagcaactaaagtggagataacttcccaaacttaagataaatgtaagaaagattattttctaaaagaattttttatggttaagaaacattattataaaagaattaagaggttgaaattattttttccctttacctatatattccatttgtagaaaacatcagtttattcactactgtaaaagatgaggaattggccgggcacggtggctcacgcctgtaatcccagcactttgggaggctgaggcgggtggatcatgaggtcaggagttcgagaccagcctggctaacatggtgaaatcccatctctactaaaaatacaaaaattagccaggcattggtggtgagtgcctgtaatcccaactactcaggaggctgaggcaggagaatagcttgaacccaggaggcgggggttgcagtgaggcgagatcacgccactgcactccagcctgggacagaacgagactccatctcagggaaaaaaaaaaaaaagatgaggaattaaatagttatgtactttaactactttccccttaattctaaatttttcttaattattatttttatatattaagatttatttcatttacaaaattgactataaccataattttcacagttgtgtaatcttggcttgttaaaggatttcagtatttaccaccagttattttaccttttttcatgaatattttattttgattcagctctttgctggctgaatttcattatcaaatttgtgttcgttgcagactcacaggctctatttctgagttcttactgcgtaagaatgcttgtgggccgggtgcggtggctcacgcctgtaatcccagcacttggggaggccaaagtgggcagatcacgaggtcaggagatcgagaccatcttggctaacacggtgaaaccccgtctctactaaaaatacaaaaaattagccgggcgcggtggggggcgcctgtagtcccagctactcgggaggctgaggcaggagaatggcgtgaacccgggaggcggagcttgcagtgagccgagattgcgcgccactgcactccggcctgggcgacagagcgagaatctgtctcaaaaaaaaaaaaaaaagaatgcttgcctgttttctttatatttgaattataaactgactggatataatattcttgggtcacattttcatgccctcaaaactttttagacatggctcagctgctttctggcattaaatcctgctgtggaaacttctgcagtcatcctgcttttccccctttctgcctcttagatgacagaagaattctttccttatctttgaagtttagtaattttatcaggaaatggcttggtgtctatggttttctatcttttttccccctggaaaaatagtgtgcatttttatttttagtcctagattctattctttcctctttcaataagtatgtcttcattgtatttttgaattcgtttttcccccttgcagggttctggatttcaaggttaccagttttccttgtgttatgtcatccttgtcctctatacctgttattttccaattgcgtttatctttttcttcttcatgacctgtattaatccgaagcaacccctttattgttagtgttattttccttaatgtctgttcttttccttgacgtttctattagtgctcttgtactggtccttaatttattacctttgccatgaaatctctatgttcttttcattttgttgttttgtcaacttatctttgagctttcattttaccaaatttatgtttttattttttctgtagctgttaatttattttatagtgtaaagtattcatggagaattttcttctattccttggattatgttttcttcaaggcgggattccttatcttttatgtgttatgctgctttctttctatgtgagttgttgttgtgttagtttgcatggttgccatacgtttctttttgctcattctcagcttgggtagcactctcctgacctttcgtttattctcatatgtattggaacattatctttgattccttttccaacttgtgctatgcctgtttttctctccctctgagctacagtttgaaacttggatgttatgtgtacaggggaggaggagagaagctccactggagttgtatacagcctttgttgggaaaatgtggctgtgctgctcttgaaaacttgttaaatgtcccctgccaagattcttgtgacctaatatgggtgcagctttttcccactgtgttaatattaattaattccctctcaattaatattgttcctccaatttaggtgacagccctagaacatgagcagttcaccgaagagagtcatcctcagttgtttatttcccacgttttactcatctcttgccagcaaacacttccagcccctccacaggcaaaaaagaagacagacaaagatattcctattttttcccaaatgtgtggatatttgtgagaatttgccgggtttgtgcagttcaccagtactgctactgctaagcatgaggctgggggtcggtgcagagggagagttagaagctgtgtttgaatcttagatttcttccttagttgcatcttcttgaagtttatgccatgaggctgtccttgtttgaatgctgctggttacatttttaattactttaatggtttgtgtttttgtgtaaattgctagttagttattgatgatgaaggtctatgatccagtttctttactcagaagtccctaaagttcttccttttccagtttacatcttaatcctttcccttccaaatgccctccctgtccagcatttcaatattatcatcttttttttttttttttttttgagacgaagtctcactctgtcacccaggctggagtgcagtggcgtgatctcggctcactgcaagctctgccttgtgggttcacgccattctcccgccattctcctgcctcagcctcccgagtagctgggactacaggcacccgccaccacgcctggctaaatttttgtattttttagtagaaatggggtttcaccgtgttaaccaggatggtctcgacctcctgacctcatgatccgcccacctcagcctcccaaagtgctgggattacaggcgtgagccaccgcatccagccaatattatcatctttgtagcccccactaaaagccctctcttgagtgtaacaataacttcttcctgacaatttcatttcttctcagtttttatcttgccaatcctgtccttccttcaatattttgttttgcctctactacctcccaccccttccccatgaacatgataattattcataaaatactcgacagaaattgctagccccatgtaatagtcaagccagtgtcagtttatccagtagaatctacatgtacctgctttctgttgaatactttcaccaggactaaaaaatagttaccaaattagccatgtgccaaaatcagtgttagtttttcaaaaatgtgtagtgtttaatttagtgttgttaggtgttaatcaaaacaagctgtatgcgatggacctgattggcatatagattattaggacagtaggaaatgaaaaaaaaattctaaaggaatgtattttctgattggagtgtgggcttgtaaccatcgccaagggtccagatagaatttcatccccttcatagatttaaataaatctattgttttatcaatagattttggggagtgggggtgggctttggttttaatttgttttcaggcacactgcagaggtgacaagctggggcccctactatttgttgctagctaactttgtcaaatttttctagaatcagctatgaaaaaagtcttccttgtccaaataagatttataatttgctttcacaaaactgccaatacactgtaggaaagaaagaagacagacgaaagaattgaaaagaggtggtgcaggaaggaataatcataagagacatttttctttttattttcttgtgctgtagaaagtggaaaaagcttctgtcataagtccactttagaggtatatgccaatttatgaaaagaaacaggaaaactagtgtttcatggttaaagatggaatctatgacaggagtaagaagggccagtgggttaattccattgatagatggtacagagactgcctggatgagaccagctatcttgaatgggatggaacacagaacagaagaatatcgaacgctatagaaagacattcccatagcctgtgggaatgcagccccatgtcttagagatgcccaaggtgttaggattttgcgatcccctgggcctgccatccccagcatcgctggcagcctccagctcactgctctgttgcctgcaggcctgagctctgaggtaggaagaggcaggtgctccaggatcacagcccactgggaggcaggacaaccatcttccttcaacatgaagcagggtttccggggcctcctgcgcttaccctgaactcaacacccaattctggatacttgtgctctgcaatcctgtacagaaggatccaattgtaactggaaaatgcaaaagggcagaattaaggttaactctgaatttcctgcttctcatgcaattaaattccccccgttgccattgagttaatgtaatttccccccatataattgagcataaattaccaggcaaatataggataaattagtataggctacaaggagataatgaagtaaacttagtaaaaagttatcattacaagtacttggacttttttttttttttttttttttgagacggagtctctcactgtcgcccaggctggagtgcaatggcgcgatctcggctcactgcaacctccgcctcccaggttcatgcaattctcctgcctcagcctcccaagtagctggtattacaggtgcccaccaacccacccagctaattttttgtatttttagtagagacggggtttcactatgttggccaggctggtctcgaactccttaccttgtgatctgcccgccttggcctcccaaagttctgggattacaggcgtgagacaccacacccggcccctacaaggacttggatttttaagaatcaaaaatcctatccacaagccagtgagaaattaatctacaaagttatctattaagatactaaatttataaaataatatattagattgtgataaatgtctaattcaacttttttgcaaaataatttttaagtaataaaaatgataactaagaacctcacgcacaaataattctttgcattctaaatactgctcgtttcctttggtatttttctctgtatatccactgcaggtgcaaggaacgacttcagttgtgaggcatcagtcagtttggggttgtccccccgctcccattttctttgcgtggtccatttttttaaacattagttttattactgtttgtattgttatttcacgtcaaacagcaataaacaagtaaagtctcagaaggagaacagacattacaagaaataaatatttcattaatgcttttaatagggagactttgtctccggaagaaatggactgtgaccacccatgaacatgtagaaatcagacagccagcttcactagtgtagtggtagctgtatttctgtgtgatgatagaagaagaacaccttgtcatacaaatggtttgcagatttctatccctctgtaattctagctgttctgtaacgtgaagatctgtgctactgcttccatctcacagttaaatgggtctcatcagagtcctgtgtgaagtctgtatctgcagacttggttctattgggaggcctcagtctgcagttaaatgggtgtcatcagagtcctgtgtgaagtctgtgtctgcagacttggttctattgggaggcttcggtctgcagttcactgggtgtcatcagagtcctgtgtagagtctgtatttgcagacttggttctattgggaggcttcggtctgcagttcgctgggtgtcatcagagtcctgtgtagagtctgtatttgcagacttggttctattgggaggcttcggtctgcagttaactgggtgtcatcagagtcctgtgtagagtctgtatttgcagacttggttctattgggaggcttcggtctgcagttcactgggtgtcatcagagtcttgtgtagagtctgtatttgcagacttggttctattgggaggcttcagtctgcagttaactgggtgtcatcagagtcctgtgtagagtctgtatttgcagacttggttctattgggaggcttcggtctgcagttcactgggtgtcatcagagtcttgtgcagagtctgtatttgcagacttggttctattgggatgcttcggtctgcagttcactgggtgtcatcagagtcctgtgcagagtctgtatttgcagacttggttctattgggaggcttcggtctgcagttcactgggtgtcatcagagtcctgtgtagagtctgtatttgcagacttggttctactggtaggcttcagtctgcagttaaatgggtgtcatcagagtcttgtgtggagtctgtatttgcagacttggttctattgggagggcttagtctggagtgactcttgtctgtcatgtttgggcagacccattttaaaagattattttctatttattaaaataaaaacttcaagtatagatcttacttgttactcattatcatcaagttccaagaaagttaaatattgttcttgtttgtttcatgttctgtatttatccaaagtatacaaagtatatcttattaaatcttcagatgaggaaaggttgacactaggattacacacttagcaaataaaaatacagaacagaaaaatcagtaaaattcaaatttcagtttaatagcgaataattttttaatgtagttatgcccccaattttactgggcatctcttcttatttgacaaccctagttaagaacaaatcaagattccagaatgaaatgggctggaaaagggggtcacaatattcacagtacaaattaaatataaacgaacattcatattcgaattttttaggtctttatgcttttgtggtatgttttaagagtaaataagagatatttactaaaacctttattgatgaaattatgtaatgtttgggacttggttctatataacacaggaagagggaaagtggatagggcgggatgggctgtgcattgatgggtatgtgaaagttttgtctacttttgattgtgcttgaaattttccatagtaaaggaaaataaaatgtgcgtgtgtgtatgtgtgtgtaagccatgcctttaggtttaaaaaacttatcatctaaacatctcaaatgtccagtgaccgaggacttgtacaagggcatgagaagaggctacagatggaggcaggggcttgtgagccatgcttggagttgtggacatctttgttccttgatggcatatttatcatcttgatatttatctttaccatttggtagagcaacgcaagagagttgcagttagttcctagactctaggagtacaggaatctctagggaaggttcaggaattggaggcgatgggggagtagagagggataatgctttacttgatggccagccttttgaaaatggctaaacacaaaacaaaatagactgttggattaggtcagaataataaacattccactttttaatgtgttcttggtttttacaaaacagatctctttcaatgattcgattgaaaccctgggaaattaataagttgagtctatagtcttttaagtcagcataggtctagcttctcaagcaggtgagctgtcagtagctgggagcactcagcctctggcatggttccaggcagagttatttattgatggacatctttaatgatttgctttttttaatcccaggatttccttcaaatgctactggagaacattccagaagaaaaaaggtaaggaccaatttaggaattttggaattaagagcccagttttaatgttaaaaatgacattgccattggttggcttgtcacagcctagaaagctcagtctttctgtctaatagaggcaaggacctagttctgccagtgggagtacaggatcatcagccaacctttgggatgagccccagtggatattgggagccagtgtgcacgactgaagatccccaaagtcaggagccccaaaagtgatatgggaggcaagccaagcgcaatctgtggcctttgctgctgcggaaagaatggaagagaggaaggttagaaaactcagggtagctctagttaatgtggcttaatgcaaggaaatactgtttaattaaaagaaaaaatgtagtatagtagtaagagcttgggatgtaaaatcaggctctcctagatttttaaacccagctctgccacttcttttgtttgttttttgagatggagtgtcactctgtcacccaggatggagtgtggtggcaagatctcggttcactgcaaactccacctcccaggttcaggtgattctcctgcctcagcctcccaagtagctgggactacaggcatccacgatgcctaatttttgtatttttagtagagtcagggtttcaccatgttggccaggctggtcttgaactcctcagctcaggtgatccgcccgcctcagcctcccaaagtgctgggattacaggggtgtgccaccacaccccactaatttttgtatttttagtagagttggggtttcgccatgttggccaggctggtctcaaactcctgacctcaagtgatccacccgccttggcctcccaaagtgctgggattgccacttcttaactgtgacatttggagcaagtcacataatccccccaaattttagttttttaacctatcagggttttagagaggattaaaggagctagcatacgttttaaaagtagctgttcaattaatgattggtgtagataaattataatcctctgtgtatcaggcactggatccaggatctagatacagaaatcatttaactcttactacagtgctgttcagcatcatcatgatagtgattattataagccaacactgaagttgagcacatacagacactcatttaatcctcaaaacaacactatttggtccatgatgtttttatcccgataataccaacaagaggaccaagatactgagaggctgagtaagctgcccaggatctcacagctgtatgcagcaggctgggattttagcccaagcagtctggctctagaacctatgctcttatctactttgttacaaatggggaaactgagactccaagatcactcagcaagcaaaacagcatagatggaattaggcccatctggatctggcccgtgttttttcagtacactgctcagcaccagctcactgccctggaaggagggagattctcatttttggaggtatccagttttaggctggctgaccaccgacagggtttgcagaggggtcttagaaccaatgtttggggttaaaatacgctcattccaaccctctcctaatttcctatcttgatttaggcgttaaaaagtgaataccctgaaacataatttcttttttttttttttttgaggagtcttactctgtcacccaggctggagtgcagtggcacgatcttggctcactgcaagctccacctggattcaagccattcttctgcctcagcctcccgagtagctgggactataggcgcccgccaccacgcccggctaattttttgtatttttagtagagatggggtttcaccgtgttagccaggatggtctcgatctcctgacctcgtgatctgcccgcctcggcctcccaaagtgctgggattacaggcgtgggccactgcgcctggccaacataatttctaatagcaaaattggtattcaaacattaaacggaggcatcttgagaaattaaacattttttgaagaagagttaacattgcttgcctcatttctgacccacagttttagctatgtttttatgcatggaacagatttccaagtgtggaaatgaattctttgacacagacatagacttagattcatgcagggccagtaacctccatgttgatgagactgtcttataggcagtgtgaattgggtgtctccagggtacagtgtcagggcttatgctaccagactaggtggaggagatgacatgcagattcaggagaggatccagggctcatgaggacgtggaggttttgttctaagcattgggtttttgtttggctttttctgtgtaaacttctctttcaccttccattcagaatggctccaaattctttcttcaatagtggaagtattattgttagtcaggtttttcaatacttaatagtggtctgtatttgtgggtgcatgtggtattttggtgcatgcataccatgtggaattatcagaccagggcagccgggacatcagtcaccccagacatccaccccttctttatgttgggaacatttcacttcctctcttccagcaattttgaacaatgcaacaaactactgttagctttaaacacccaactgtgctatcaaacagtagatcttacttcactaatgtgtttttatgcccactatacacacacattaagcaagccaggcatcataaaggattaacatacacatatttgatacatttctttgtttctaccttttcatgttcattccttttgatgctgaagaaatcttatgcagggagattgcgtggggccttagaaattggccaagatttccaaggccccacgcagtctccctggataaaactttgtctaagtgtttcaggaggctgctcaaaggaaatgtggcttgttttgggaggtctgaaatgttttcagatttgctgtcttgaaaaaaaaaaaacagacatatgggatttcttcatgcaaaaatcccatcacatgtggctgttaagatcaagaagacagtttacctgcaggatatattttttccttttcttcgtacctaccccggaataacttttcaggtcctctcacagaatgaagcagtttccttaggaactaaaaccgagaaaaaaagaaaattaatagaaatggtgtattactttcttagactgttaccaaagtctgtttctgagtggtgactatgcattctttcaaaagaacttcttagggcataaatatagtaattttcactgaagcaataaagtgcatttttagttttggaggtctctcttttaatcctcttcctaataaggttatggagttcatttggatggcccctgagccctctggctctgggggaacctggattttatcattgtgaatatttattgaggctgcacactgagcccacaaagagacttttgttgttgtaattgtggaacttaagagcagtgtccctgtcttaatggtggcccccaatcaccaatcacatgccttttgataggatacctctcccggttaggatcgtgttttgtctagcaggcttaagcttctttttaaaaaaatctccttaaaagctaaggagatttcatttttacaatgaatcgatttcagcaggtataccagaatatattttgaaattcaaaatctttttgcctgctaactaatctcagaatctagttcagctattaaaacagactgtttaccctattagttatgcgacatattgtaccaattttatctaggtctccaaaggccccacacctaccccccggagcctctaatctttggcctctgttgcaaactgatccttgggcacatctgttaggcacgtgaactgttctgatgaggcaaggtttttcagattagaccagtctgtcagtgttcaggggccggcactctctaggccttactgcctttgcattgttctcttgctttgatttactcaacattctctattgagcatctcccataccaggctttgggctggacactggggaacctagaggaataaatcccatgagtagccctaggaggctcctagccgactactgaagacaaaacagaaacaagtcattatgactccatgtaggaagtgctctgctgaggttcagagtcctggggacacagagagggtccatcagtcccagctctgagccttcaggcacctgtacctctaacgggcttaaggaaggcagtgccgtcaacagattggaaagacacctgccgagggcagtgtggccgagggcagtgtggcagagagatgggggcggagaggactggaagccaggaaaacaattagaaaccaatagagcggttcagtcaagagacctggagaggtggagctatggcagggacggtgaccgtggtggtgggtttgagagtaaataacggccaaggcatactttagagttgccacagaaaagacttggttgactggttgtgaaagttgagtccgacctttctttcttagccactaagtcacactctgaagtagcagtggaaatgcaggagggcaggtgtttggggagtctgaatggggcagagggagtgaaagggacgagcgttggaaggcagaaagatgctgtcaggtaaaactaaaagggctcagaagaaaacccagacaatcctgagcagcagtctctcctggtgaaagagccccgtggaacgccttatgccagtgtccttgctgcctggtgttccagtgttagtaacagctgccacttctttccttgcccatcagttactgtgtttgtgtgtgcatgttcctgtgtttgttttaatctaatactgttcctcccccacggagctacacagtacttgttttataagtgtgacctcagcaatctttattatctacccaagcacaaatgaatgttttgatcaagaaaataaatcagctgggcaccgtggctcatgcctgtaatcccagcactttgggaggccaaggtgggcagatcacttttagcttaggagttggagaccagcctggccaacatggtaaaatcccatctctaccaaaaatacaaaaaattagcctgcatggtggtacgtgtctgtagtctcagctactcgggaggctgaggtgggaggatggcttgagtccaggcgtttgaggctgcaatgagctgagattgcaccactgcacgccagcctgggagacagagtgagaccctgtctcaaaaaaaaaaggaagaaaataagtaactctgcacagctttgagatccacccacatgtagagagggaatttaaacatgtaaactaaatgtaaacatcgacacagatgtaaattgaattccagaaaagggcattttccattccagaccctgagctctgcagtttctgctgccttacctctatctggctgcacttcccaattctttaagtctgtcatttagttcatgtgaaaattgctggggctgtgtgcttcccttcagaggcactgacagactgtgatctttaggatctcaagagctgaagacaggagccaaaagtgatgaagacatttctcttgatcaagcaacatgttgataggcacaagtagcagatccatcctataatccccattcttgtcatcccaccttggaaatcaactgagcgagcaaatacaggcatgggcaacaccgtcttcacacaagcctgttgatttattttaacttcgtaaagagatgaacaattggttactttctggctttacacacagcttgtttttctaaccagtatcatgccaggtggtcagcatattctctcccctgccgtgttaactaagtgtgaccaaatttatagctccgaggaactggagaccattgacactcagagtcgccctataggatgtgggggtgcaccagggaacagccagccagagggcaaagccacctgctgttcctcatacccaggaggcccagggctaaggcctgggtttcagtactgaggcggaaagtccgcgctcactagtacggatacgcaggactcgcagtcatgggtctgtgtacttttagctctctgtataaaatcaatttccatagtgatcagacatgcagaagagtaatttcctgtaagttctaggtcctggctaagtggaaatgcttctgcttgtctgttgcgattatttaagccacatgacctcagagggaaaaaattcaccgttggcttggattctgaatatcttgatttgaaaaagtcagcttttagtttaaccactgtataaatccaatcccagacctaaaaattcacctgcagtgtcatttcaataattatgctccaaacagcagaacctgcacacatgtcatctttcttcctgagacctacatcctgtttcttccctgagctacctgcatgctatgttctttctgcaacatattagtccatttctttgctgaaaattaaacattgtcctatggtgtcccatgattccttgggagataaggccactcatagtaccttaaaaatttttgttagcagctggaattaatgctttcatctttctctcataatttaacatcttattccacattaacaatccccaaatagggcatgatgcagtgtgatgtcgacactgatactggaagtttagaaatctggatttttttcctttgctgacttgggtcagagtcctcctatgctcctgtgctaagaagccacacaacagtggacactcacttcacagggatattatgagaaatgagtaatggttataagatgcttcgaacctttccaaagaaaagtgatctgaaaacacacgttctcttcattcacggagagggccttttgcctctggatgcagctcactgacgagctctcctgctcccacacttttgcccctcccaagggtctcctgatctcttcagaaatgtaaccgaagggttgacaaacagggcaaccacgcaggagccaggctgtcttcagcaggagccaggctgtcttcagcaggagagattagtgagagggggaagtcggcatggtttggagcaggcacaggcccaccccttctgccagcttgtcagttccatagtagaaacccatgtgtcatgaagcctgagtttagcacggaaagaaaagctggggtttcatagccacgcaccaaaggttcaaatcccagctcttcaagtaccatctgtgtggccttggatacatttctcaatttcttggaacctgtatttgtttgtctgtaagattaagacagtaatattggtcatttggctgggtgtggtggttcatgcctgtaatcccagcactttgggaggctgggatcatttgaggccaggagtttaagaccagtttgggcaatatagtgagaccccgtctctataaaaaatttcaaaaattagtcgggcgtggtggcacatgcctgtagtcccggttactcggaaggctgagatgggaggatcgtttcatccctggaggaggaggaggttgttgcagtgagctgagattgaaccactgcactccaggctgagtgacaaagtgggactctgtctctaataataataataataataagtaataataataatattggtcttgcacagttattgtcaagtatagatgatactctgtctattgtgtctggcacacagtaggtgttcaataagcagtagcttctagttttatgccttttcttggcagtggatagaggactttttatttgtttcacttttagtgccacggtagaatagtgtctgtgtgtgcaagtactaactatgttaaagcagaatttgccaatgaactaaccctctgagttggccgaagactgtggcacaggcaaattgtatgcagccacatgcttcctacggaaagtcatcctgcagagattcctggggcccactatctgcacagtgtctcccaaccctgcagctggactgcttcagtgctgccctgcagatccgtcccctgcacgccacatccatgtgggccgctctcgttgcctcctgcagaaacattctgcaagttctggtgtggtctccctgcctccagcctcttctccgctttttcttccttgactcagttctctgccgtgtccctctgcaattttgctccagagcctccttgacaaaggcagggcccggtagcagggactgcagagtccccgcaggacccgctgttttctttctcagctcattctggaggccagccccactgagctgaacggagtctgcacactactgcactggcattcctgctcctgctatctttgccccgatgtgcttttcttccatttctattggctttgccccaccaggacccagtcatgcatggccttcttaggaagcctctcctgatgcacctcctcttgtcctgttttacctatcccacctgcagcagtggttcttcaacacctagaggaccatcatctctacaggcgctggtagcattctgcctggtgtctattacacatccctaatccacagtcactccctgggttttcccatcccagccttccacagaacctttgcccagcagccatccagcgaatgtttgccacatagagaatgttgcctgtttttcagtcttctctggtgaagactttggacctcacttaataacattccagggctcaactccccagcccccactccatgccacccctagagaagcatctgtaagtgaaaattccccaaaggaaatttatgtccgtgtcttcatattcactcccccatgctgatacacaacagctgttcactgtcttttgtaaaatcactcaaaaatagcaattaagtcgctcctcggacttctcttctctgggatatttaacctcagttccctttacctcccttgtgggctcttccccttttgatcgtcactattgctctctctaagtcctttccaaattctgcatcttcctcttaaatatcttatgggaaaggtggagacttgttttcagttcagaagacagcctctttttttttttttttttctttttgggggtttgagacagggtctcactttgtccccaggctggagtgtagtggtgtgatccaggctcactgcaacctctgcctcccaggctcaagccattctcccacctcagcctcccaaatagctgggactatatgcacatgccaccatgcccagctaatttttttatttttagtagagacagggttttgccatgttgcctaggctggtcttgaactcctggcctcaagtgatcctcctgcctcagcctcccaaagcactggaattacaggcgtgagccactgtgcctggcccagaagtcagcctcttgctctggctttcctgaggatcgcttgaaggatgggtgaaaggagctttgggctcagggttctgggcacagaaacgtccctctctggctggaaaggaagccagtgaaggacactttcctacctgtgcacaagtaagcttgaagttgctttattttctcatgaaatgtgtgaagatggaggtaagacagattttataaagtgcattgaaagcaaggctgcccagtggaaggcctattcttggtgggtatgaacgcactgtccccaccttatctgctgctggacatgcccctggagaggatagttcatttggtggaggggtcaggttcctgcctgcaacccggagcagccctgggctttcagagcttgtggaggcttctgcagtactctatgtcacctgccctgatttagaggcacaggcctgttttcttctcggatcttcttcattggtgtttctctctagctggtcagttagccccactgctctggcaaattgctactgcccattaagggaatctccagcctctctcccaggtaaataaagcttaaaaaagaacaatgacctcatagaaggtgctctgagagcttcctcctctcttcaagtctcccctgcctccaccacacacacacggatacacatgcacacatccatgcatgcgcacactcccacactctcatagcttacagggggacttggccatttgcgctgaagctgatgctatgaaaatgaccactaagaagcagtggaaggcccagcgatggtggcacaggcctttctgtgaggtctgcccggtaattccactgagtctgggaccctggaggacctagagaggtagtcccctccccttctcttgcctgctaatcacacagagggccatcatctttcatatgaactcaaagccctttttctgcataagccctctttccctccatgaactttttctgttttgaaatagcaattgcctttttaagcagcctttcattttgcccttggctagggaggacgaggggcaccagtgagcgaccaatagggggaaagaaaggaagagaaaatcagtcagtccccttttcctccagccctcccaaagccaacccctccttccctccctacctcactacttccccgtctgcaacaccacccacccacagggtcgcagaggggtgcacttggccttccagctccttaacagtgtgtgtaacactgtatcttttcataacttctagaattccaaaagggagggagagagcaggtatatagttacatacttttacatatgatgtagtgtataatacattaaaatttaaaagaggcagagcttaacaacttggaagtatcttggtggaaaggtgaatattatctttaaaaggaatgattttaatgagtctacaattaaatgtgcgttcattcattcaaaaaaaaaatgaggatcctctttcataccagggatcagatctcagatggtttcaatccaacgaggagacagtaactaagtctagtagtcgaacaaatagtcacaaactcgggtggaggctgtgaggcagagaacagggcgtgtgacagatgttatggcactggggaggccttgcttcagtctgggaggaggtcaagaaaggcctctctgtaagcagagatcctgggtatgagcaagagttacctggaagaggttgaggggatgggtgtgctttaagctgcattagccaaggaagacaaaaggacacagccggagatctggtgatcctaaatatactgaagacttagtgattttaaggagtactcaagtcagcggggcatgaaagcaaaataatttcagctgactttagattggacatatcaagcaatgataacacctcaaataaagcagaacggggcccggttgaaaggagacagtggaagtggtcctcattccttgcacctgagcctctctgtggtctgatagtgatttgtattatttttgcttgttgtagtccatctttcctataaagtgcagatttcgtgttgacgcactcaatgccatgatgttcagatttcactttgtttcactactctccaggaagcagccatgcctgatgtgtgcgatgaatatgccttatcctcccgaaactggctttcccaaccaaatagttcctttcaaagcactgaaagcacccatgatgctgtgcctgggtccttagatttcatcgtgcatgttgctgtgggtgaagaggagcggtctcatgtgactgggctcccttccacacttcaacccaggggagcgctgccctttctgtaaagcacgggcacttctggaagatcgatgctgtgatgtacccagttagagagaaccagtctgtgtaataagcgctctgtaactttttaatcctttactttttgttgttttatttctaaaggcttgagctgtctgttgaaaacatctaccaagactggcttgagagttccggaataccaaaggtaactcaagataaccactttggtagaatccatggagagtagtaaagcttgctgcttagcacatcaatcatgacagtgatttcttaatatatgtgtaggaaagtaattatcttactgagtgcaagtatctgtaagtcagaacactagtctctcccgcatttccccccctcattgtggggtgtgcctctggccactttcaagtgaccgtggtatacgtggaattgatggtagctcctgaactccctgctaaatgagaccctgcaagacgtggggtagattttgggtggaaccaccagccaacagttccatgccccgtggggcaggtggtgggggggcaggtggcaggggagcaggttgagggggagcagtcagcctccagctctgctctttggatgcggcccaacacaggagttggtttgctgccgccgtcgtctgtcctgccccatggtccctgtcccttgtttccctgacacgcctgtggctccctcgtctcctggttctgcattgggctcctgtctcaggccggccttctcacctggctgacccatttccattcatttctctgtcttagggacctgggctcatcccagctggagattgttgttctctccctccctttcagtctatgggcaactctaagggagaaaccttttcctggccagccctagctctgtggaaatcacctggcctggagctcctctccccgtccactctcctctggccctgtgcctcccagagaccattggacagcccaggccccttcgccaaatcaaatgctggccatggcaagcctaggccctgggaagtctgagggtgggatcccagatgcgcggtcagaggaccctgcaggctgggagctctctcagtctggggcagcccccagagcggctgcaggctgggcctgacccagggtcatgggccttggcatctgggggcggtcccgtgtggtgaggcaggccctgtagcctgctggtttctggtttcatggctggttacatgagcttccccttaggagggtctcaatgtcagtgaatgtctgtgaaccatgaaatgaagggacaggaggggctgttctccattaccttttcatccccctcctcacatctttgtccattttcaccacaggggaaatgtcagccatcagcaaccataagctcattcctaaaaaaggacagtttgccttcagttcaggaatgtgtgtcacctgttacaaattatttctttggtccagtccttctgggaggaaaaaagaaaaaacatcccgagttttacaaataaaacagaccaggggtaggacaaggcagtgcgtggttgggggcagcgcctttcactcacgtgtgtgacaatgagggcccgtgagctctgagacggtgacttccaaaccagactactcactgaggacaaacatccaggaaaaacaagttaaggtttgtctaggtgtgaataaccaacccttttccttcatgtttcagatgggagtgcaggtggtgggggacatttgctgaagtttgccttgtgatcctaagccaggctgttacaaggctcccagacattcttagtgtggcctggaagctgggagctccagtaactggctcccaaatttcctggcctggaacaagaaggctgctgtttgcagccattagcccctagggagggggaaagaaagagaccttaatccagtgcccagaagcaggcgcactccacttaggctgtggtgctggggctggctctctcactgccgggggctctgtaatttcccctgcagaggaggaggctttagctgccagcaggaggcttttggttttcattaaaagagggaggggtctgtggcagggagagatttgcctctgagctatacattttttccaaaggtctagttgcattagtgacagcttatagtgtagacaagaatctctgctataaactgaagaaacctgctgtcaaaacagccaggtgcaatgaggccaaccggctataaattgtgtttaagacccaactggtatttccttgggtgcttcactgttcagtaaaaacaacagggtcagacagaaaagaccctgatttagcgcatgattggtgggtgatcagatggtgtctttgcgtctcttctacccatttcggccatgatttctgcggctgctgctgatttatctactctcagcccctttcccactccttgagagttccttgccgtttccacttcactgaaaggctctacaaggacctgggaccctccggttgcaggaggcttgtggtgaatgggacaccttgttctttgtccccatcattataatataaagttactaggatgcttgccctggaatgacaaccagggccctgaaattgctctgatgctctttgttctcgtaaaaatttctgtctaccagcaattgaagtcattcatgacaaaagagtcatgttctactggtggagttttcattccacaggttacagaggctttttgtcttctctcaggaagacttgccttgtggttggcctcgattttcctttttggctacgttgaatggaaatcatttttaaaaagtggaaatagcttcagtaaaagtgagcatgagccctgaagaagcaaaagaaattggatcctaacctctttaaagaatatcccaactctataacctctggccttacaaagagatttaaaattgattgtaccatcagtactatagattatttccttttatgactttttttttggttatagaagaagtacacatttactttgggatataaaaaagtctaagaaaataaaaatgacccagagacaattttttatgtacatcctttcactcattgttctgggtatataaatacatattttacgttttcctttctctccctctttaaaagtaaaaataacatgccctccgtagcaaattcaaacaatagcaaaatagaaaatgtgaaactcctcgctgccctcagtcatacctccagagatcacctgcacctgagagcagcccgctgtgtgtccgcccacacagtttctgtgctgaacagcatgtaggcgcacattcttttgaaataaaattggagtcttatcttccaaactaagttattcatttaaggatatacactgagtagtttcccacatcccttaatataattcaagagcaatacttttttttttttttttttttggagacagggtctcactgtgtcacccaggctggagtgcagtggtatgatcatggctcactgcagcctacacctcccgggctgcagtgaaagggcaatacttttaaagagctgcaccgcttcctgatgaataataccataatcaaacttattcggggcctaccccacactattagaatagtatattattgtacagttattctcagaaagttgcacattccgctaatttgacagctctataaatagattttggattttttttcatgtccaaacaaaggtttccctcggccccatagccatatattctagtcttcttttaaaacatttatatgcaaatacactagaaataaatacactagaaataaatttctgcatccagcctttcttctacactccttattttagttgctacagaactgcgcttttgttttgttttgttttgtttttgtttttgttttttttgagacagagtctcgctttgtcacccaggctggagtgcagtggcacgattttggctcactgcaacctccacctcccaggttcaagtgattcttctgcctcagcctccctagcagccaggactacaggcgggcacgcatgcctgctaatttttgtatttttagtagagacggggtttcaccatattggccaggctggtctcgaactcctgacctcatgatccgcctgccttggcctcccgaagtgctgggattacagatgcgagccagccagtttctacagaactctgactcctccctttctttgatttcctccctaaattgccaagtcctgaggcccttctgtacacacttaccaaatgtctaattttctttcctagcacctctgccatttataaattatatttcgcttggactggtgcaatagcaaactggtcttttagctctctcctttttgattcattgttcacatcaatgccaagtaaatcttcccacaacccagctcagacccactcttctcaccagagacttttcccccatggacaatggatttagaacaaactccttggcctgctatttgaggctaccagcagactggtcaaagtcacccttttcaactttatttcctggcattctggagattcgcccgctcacgactgtcggtgcacaggtatttgcaagcttttccatcagcctgcctttgtgcatgccctttgctccttggcatgctttcctctccctctctttagcatacatcacaacctgccttacatgtttctctctgtatctgtcccatgccgtcccctcccctcccccctcccccggaaacaagggttatgtctataagcctcatcctgtagtacctgttgtggtgcttatctcttttgggccttgcatatattaacagtagatgctcaggagctcaccgtccaatgcactagctacatgtggttggtaagcacttgaaatatatcgaaagcacctgaggagctaattttttttttttttttgagacggaatctcgctctgttacccaggatggagtgcaatggcatgatctcggctcactgcaagctccacctcccaggttcacgccattctcctgcctcaggctcccaagtagctgggatacaggcgcccgccaccacgcctggctaattttttgtattttttaatagagacggggtttcaccgtgttaggatggtctcgatctcctgacctcgtgatctgtctgcctcagcctctcaaagtgctgggattacaggcctgagccaccgcacctagccggagctgattttttaatttagtcgtaattaaatttaaatttaaaatctcataatttagttattgtttgaaataccttgggtatgtgaatgagtctgctttttcaactcggactgttatgaaatataaatagagaccaaacatttctgatgaaaatttaacacccaaattgagatggactgtgagaacacatcagatttaggagacttagtacaaaaatggaggtaaatatttcatcaatgtttttaaaaatattggttacatgttgaaatgataatattttggatacattgcaactcaatgtatatacccaataaaatatattaaaattaatcctacctgttacttctttttaaatgtagcaactagcaaattttaaaagacacatgtggcttgcgtatattcctgttgaatagagctgttctaaagctattagttggattaaaatctgagtgcataatgccttaaagtcacccacagaatagatatgagtgaaatcgtctgtatttttgtcaaatgcggggtaaagatagagctggttaatccatagacacccttcaatttgctgtgacagcatggatgatgagaatccacaggtacggggcgggagtgctgggttcacagtagacattcagagggcatgaactagcagccttgcattagctgtgggtttcaactcctggtagaccagtttcctgaggtgtgaaccacaagcacaccgcctcaggtgaacctcacgtgtcttctgtacctcagtctcctctttggaggaagtgctcagccgccagttcctggcaaaatcatcacagcagcggcagtgaggaggagagagaagatgggaaatgagccgacaataatgtgtcccagaaataggcagaaagcaacttgggttcccagactttctcctgaatcccagaatttagaacaacaggttattttgtcatcttgggaaaatgccacttctttccgagcaaacacctgcaagttgccagaggctgcatgagcacatgatagaaaactgaagtcttgtagggaaaatgctgcaatcacagaattgagaatacttgataagacagtatgcaggaggctttatgtcactgtagtcacgatgtgcttttagcacagagaaatccagctggttttataggggaatgactagtagacttcttatagcacatattatgcagtattatcaatataattttaaggcctattaagatactcaatctcagtggtgtctagaagaattctacatttaatggtcagtcaagaaaactgaaactgattattttgcaaatttcagagaaagtatatttttcaaattatatgaactacgatatgtttgcttcttttatatctataatagcagttgccataatgtggtatactatttgggctgctaataattttgctgtcatttttgtccagtagttaaacttgtattttctaagtgactaaacatcttgtcaaggatccttaaagacatgtggaataggttctgcggcctcacttgaggcagcacccaaaatgcctgagtcatcacagtcacttccgttcatccaagcacctggccccctccataggctcttcaaattgctctactgctcagcagaatcacaagacagggagagggtttattaaaatcttttcatttttagcttaatttcctttatttttggcatctaaggctttgtgctcaaatgagtttgctggggttgccataactaagtaccacagactgggtggcttaaacaacagagatttttttcctcacagttctggaggctggaggtccaagaccaaggtgccaacagcgttggtttctggtgaggcctctctcctcggcttgtagacggccaccttctcatcatgtcctcatgtagtctttgctctgtatgcgtgcacatgtctgtccttacctgctctttttataaggacaccagttatattgggttagggcccaccaatatgacctaattttaccttaatttcctccctaaaggccgtaactccaataatacagttgcattgtgagttgtactggggtttaggaattgaatatatgaatttggtgggacacaatttagccattcctatttaccttattcacagtacgtctctcactagttccgcattctaatgaatcccttcagaatggccaataaaaattactcagcgcaacctcactgcattttattcccctatggatgaatatgctttgggtacatgttttggtcccaaatgatgttagtatctagtgagtgcacaagaattaaaaatcatgtcttcatggcatgcgagagaaataaatgtgggaagggtccattcccccagaaagtggtaatagctgaaggtctgtgctgcgtgttgtgtaacattggggcatctgatttgacactgtccaaatatattgacctctttacagcacaagccatcacaatgaaatgagaaacattttcctctggtgcccccaaatgaaagctgtgtgcttccttcatttctgtctttcaaaacctgatttccagaacgagtttgaatctcattcacagtagtctaagactagacttcaagtgaataacaagaattaaaaatgtttcctctctcttgaagatttcctttgtaagtgtcagagcttagagcttaggcttctacggtagaactttcaagcatccagaccagatggatgatatttgcaagaggaagcttcttccaggatctgaaatcagacctctgagtccagtcctttcctatccttcttcccatgagtagatcccacacataggttcttgatgagagactgtggatgattcaaagatgagagaaatacaggctttgccttcaagatgcttaataattcaataggaaaaatagatacataaataactgacgtaaggcagaaagcaataagtagtggaaagcttagtgttcagaagaaaggccattttgatttgtggaagcagagacagtgtaagtaccatttgaagccaatcttgaaggacaggcaggtagagcatgggcaggtggagattgtggagaaggcccttacgggcagggagtgtgacataaccaaggtgtgctgctgggaaactcagtgtgcctgtttgaacagcatcaggcagagtcaaatctcagtgctgggaagctgattaactagtgtcacaaccatgatgaaggttcagcgggtagcatcccagccccagtgaaatcaaggtggcgtcctcagctggaagggtgggggcaagaatccttcccattcagcctccttctcattctcaggtccctcccagcccctgcaacaatctaaccaaggttgttctgctcctgaataatagagggatgaatgcattttaaatactgataaaatatactgggtgaacgcattttgattgtgatttggggttgtaatcttttccctttctgtttttcttgttggggacatgtttaattcttgcttgttttacatagagggcaggatctgtgagggggaatggttagtggggcaggacccagccagattacacagggacttgaatgtgatgctagagagttcctgcagattgagtagccactgatgcttgtgcaaggagtgacaggacttgagcagcatgtttagataaacatggtcaggtgggtcagcagccttgcctggaaagacagctccccgggtaaaaagccatgcttttcccctctgtgcagggaagaggtagtctagtggagggtgtggaacagctagactgactttagctccttggtttctgactgaactttcaggtccagaagctcttcatttacatggatacttctaaaaacagcattaagtatctagataaccaatggtgtctgtctatccagagaggacatgcagtgggctgaggaacgcctatatccatgggaatgagtaggaagccacaagaaacaagcacagatcaatgtgatgcagctgatgcacccaaatcctactcacgacggggaaggacgttgggaagtcggcagggagagtcgattgcccacagctttcacaatctcggattagacgtacattttttcagtgagcacagaggaaggcatatgaggatggctttctcattagggataaagggcatttgagacatttttcctgtaaaaagaataagaattctgaactggctcagatgcaaacagacacattgaaagtatgacaccgtagagagaaagctaatatttgctaggtatatgaaggataacccagtcctgccttcgaacatcgaaggataaccagaaggaaaaggaagcagaggccactagcatttaaaaaatgcagctaatggagacagttggtagtggcccatgtacgtgtgggttttaataataggatcaagctgggttcttgctggaagtctagctctgcaggcttgagttgaaggcgctcagggagacctggtcatcagaatcatgtaggaggcggattaaaactgcagatcccggagccagcccaaacctgctactgagtcagcatctccataggtacggctggaactggtcaacataatccgtaattatctcatattctgaaatatattctatcaaaataagtttcttttcctttctttttttttttttttagacaaagtctcggtctgtcgcccaggctgaagtgcagtggcgcaatcttgactcactgcaatctccgcctcctgggttcaagcaattctcctgcctcagcgggggcaaactctcaggtagctgggattacaggtgcacgacaccacactcagctaatttttttattttttgtttgtttgtttgtttgttttgagacagagtcttgctctgtcacccaggctggagtgcagtggcatgatctctgctcactgcaagctctgcctcccgggttcatgccattctcccacctcagcctcccgagtagctgagactacaggtgcccgccacctcatctggctaattattttgtatttttagtagagacggggtttcactgtgttagcgaggatggtcttgatctcctgacctcgagatccgcccaccttggcctcccaaagtgctaggattacaggtgtgggccaccgcgcccagctaatttttgtatttttagtagagacgggctttcaccatgttggccaggatggtctcgatctcctaacctcgtgatttgccttccttggcctcccaaggtgctgggattacaggcatgagccactgtgcctggccaagaagcttcttttctaagtacaacctaaacccttagaatccttcatttttatacccttcctgagtaacccaaacttttttttttttttttttttgagacagagtcttgctctcttgcccaggctggagtgcagtggcgtgatctcagctcactgcaacctccacctccacgaatcaagagattctcctgcctcagcctcctgagtagctgggattacagacactagccaccatactcggctaatttttgtatttttatagcgacagggtttcaccatattggccaggctggtctcaaactcctgaccttgtgatccgcccgcctcggcctcccaaagtgctgggattacaggcatgagccactgcgcccggccaagtaacccaaacatttggctttgtggtttagtttattagttcaagcagtttgccaaacattgcgctgggtggtttgcatataaagccgaaagggcacagaccctgcccatgagctcatggtttgtggaagcatctgcaaaccaacctttgcccaacaggtctccaccccagagtttgagacctgcgaagaactgtagaggttgatgtcttgtgtttgccatgttccgctgggaggctaaatctgtaagaaaacaaatacgcttggagggaggagactgcccttaagccccactcaatcacaagtcagctggcccattgtgcaaaggagccagcatgactgtcctcaaggtgtagtctggtgagccatatttggacacatgggcagtacctgtctttcaggctttcaagtattggcccacagaaagagtcactgaaggaaggactactgcatccctaataatgagcggacctgtaataggatttcactgcagtgctgccttattttgtagagaaacctttttagaaagaaagagcaatgcaaactcaaagaactaggacaaagatagcagctctagagtgtaaaccttgtatcaatagaaaaacaactgattctgctttttaagaaaaactgcccccattttctcttttattaggctaaagacatactctggtagactcttcgtcaaaagcagattatttaatttaattaattaattaattaattaattaatttctgaggtggagtttcactgtcgcccaggctggagtgcactggcgtgatctcggctcactgcaacctcctcctcctcctaggttcaagccattctcctgcctcagcctcccaagtagctggactacaggtctgtgccaccatgcctggctaattttttgtatttttagtagagacagggtttcaccatgttggccaggctggtctcgaactcctgacctcaggtgatcctcctgcctcagccccccaaagtgctgggattataggcatgagccaccgcgcctggccaaaagcagattattttatattgacattgcactcttcccacacctggaaggtaaagcccggcaaagcagtagttgagtgagttgtgcacatggctgcatacacaagcatgaccccttggctgtttgacatcgcacagcatcatggcacatgctgatagaagatcaacacccagggctttttaggctgctgcccccactgtggccctgcacaatgctcacagtggcttgtcccagctcttgcagccagagcaccctgctgaccgggaaagccatcaggagcacctggctacttttacagtcagggctttttttccttctcttttgtggaagccattatgtggtaccaaataggtatacatttaatacctgcatggtatttctcctgtgtggcctctgctgcttcatggttaaatattagttttttctggtattgtgcaactttgagcttgctgtagaatcacaggctacagatgagtcttagagtgcagtgcgtcttcttcttactgggggagcggagccccaggagaagtgtagtatctgcccaagctcgcagcactagttagtggcagagctatggcttgagtacaggattctaagtcttcagcccatcagactaaagcattttgtaatttgggtcccatctttgccttagtttctacgaagacctatgagtagataataaaggagtatggcagagggccctgagaagtgatgatttttcattaatgactcctctttttcttgaagctgtttgttcctattctttcacagatgcaggatatggacctcactttccagagcttttcacaaatatgtgtcatggatatacatgcccctcttccactagatatttctaaacggtagccctatgtatctagatggaatattttgcataggaaatactgggctccattgcatcaaaaagctggtatattttttggtgtgagtgaatgtgattgtatatagagattagtttaggtctttgcatttggaaagatacagccattcctcacttgagatggaaactaaattacataataccaggccacccaaacaaacaaacgaatgggaaaaagtaaatggttaaacaaaaagtgtatcttgatgtacatttttcatatcctcttatttgctttcacaagcacacttccaaccagagtccctgtcttttgccctgaagctgacccagagcagaagactgtcagagagcacaaaggtggtggccagccaacaagtgtctcacaggtcagggtaactgtcaatgattgttgaactgcacagatcccagtgtgtgtttaaaaaggccagcgttcttgtcacacatctctggatggcagctgtctacttttcactggtgcttggtaaggagtctgttgcaatcattcagcaaaagaccctgttcttccaggtcagtcctccagcttgggcctttacgaccccagtattttctgcttctgatcctgtcgagttacagccaccaccgtcacactgtaagtgggctccaaacagtttggtgcataacatgcaagacagcgttactttaaagttaatcagcaagattggaggctgggtagaggaggaaagtcggtttgttatgtccaaatccatgtttttttcacagagttctttattatgaagttttgttcagcaaggctagtcctatagtggatgaagacgtcagtgaatccattaaataccagctttggagtcagctctaccacctcgaagccgtgtagcagtgggcgagccacttgccctctctgaggctcactgcctctttgggggtaaggggagctggcctgggtgaaggcactctgggctgcgtccggtgccgtgctgaggcctgcaatgcaggtgtacctggtcgcatctgagaggagaaaagttgggatttactttcatgtgtctttccttctgtccttggaacctgtagaattgccctcagacttaaaagttgcccttagcttggactggtattgggagagttttttaaatatactttgtcctgtatggtgttttacaaagttacactatctgggaaccctgtttcttcatttcttttcttttccagtggaaaattgctatttgagagatgattgagagaactgagtaataatcaatctacaaaagcatttatgctgcctgaccactgaagaataggcatttgcttctagttgaaatcaattattcatagagattaacctgtttgatcaggagatgaaaaaatttttgctggcctttttagtcttaaaattcctacgggtcagtagtaactgcaggtcagttttaccttagacagggacaattattatttctaagatacattttgagacatagagataaaatatttatgcccgttgcctaaataaccttgggggaaaagtccagtgagtccagtttgccttttggaggaggggaagccattgttgcccaatgctctagaaagagcacttcgtgttttatgctgctttttatctcaatcattcaagtatttgctgcttttaaaaaaacaaacagaaccagtaatgaaatgtgtgtgagaaattgctacagtgatcgctgcatattttatagcaaaacgttgcagtatttcttatattgagaaagtagaacctatttggggttgaaatgatcaaacccagatgctttcctaaaattatatttttggtgcatttatatgtctgttacaaagtgtgctacatgctaaaaatattttcctttgtaggccgaggggagtttcaaaccgcactgagagacgtagatcagatggttttccgtaagagtgttaccagcatcctggttgttattagccttgactttgcaatatgacattatttatgccagaagacttcacaattcagttcttctttaatttcaccaactttattggcatgaacatgcatggaagggaggccaaagtcaatacatcagaatttgggactcagactccagggcaacaagcaataatgggattcggctggagataacccctccattcctggggtctgtttccctgggacgcagaagctgcctcccacgtcaggcagcgtctcttgccttttgtccaagcgcttcctcttgtttttctctggtgtctcccttcttctcccgagccacgcatgctgccacttttcacattccatgcagccaggtagagacacacttctccttaagatgcttctggattctgtttattgcaaaggcagttgctctacaattctctctggttattcctcctcaaattgtatttcctagtcactgtcattggttttataattgagagacatctgcctgggttttgcataaatgcctctagtcaattaagctgcaaatgggtaaatctaagaatatgtagattgtctaactctctatagaattgtagtttttaacttaatccttcccttccctccttcccctcacctccctgcctccagttgactagagtatcctattttacatttagaacatccagaatgagcagaaaaggctatatactaagtgcattatacataatagctatttatttctcctagtcacaactccgtaagacagacattgttattatacccattttacagatgaagaaactgaaaaccaaatctgtctgacttaaaagccttcatccttaattattatactggttttaaatgcatgtagctctggttaggattatagctatttttgcatctagcacctgaccatggtggtatcttcagagagcaatgtagaaatatcagatttcaggctgggcatggtggctcatgcctgtaatcccagcactttgggaggccgaggtgggtggatcacctgaggtcaggagttcgagaacagcctgaccaacatggtgaaacctcgtctctactaaaaatacaaaattagccgggtgtggtggtgtacacctgtaatcccagctactcgggaggctgaggcaagagaattgtttgaacgcaggaggtggaggttgcaatgacctgagatcatgccactgcactctatcccgggcaacagagtgaaactccatctcaaaaacagaaaaaaagaagtatcaaatttcactttgtgatattcttgtaataacagtcagcttactgttttgaatgagacaggaccagaaatggaattatctcctttataataagacacatgagaaacagaacttggtttctcatgtccattggttgtcattggaagggatacacacttgtttgtagtagctcagatgtgttgtgtctttgcaggctccgtacaagggcattgagcctgtgtgcttgtcaggccaggctttttattatgacgtcacaactcagttattttgatacctttgaaaatttacttaggttcaaaataccagatagacttttgtttctgaggggaaagaggaagggatttgcatttactggtctattttgtgccttttaccatgtgcaccatctcattttatcctcaccacagcattatctctgtttcatagctcagagaggttgtgtgacatgcacgtccaaggccacagagcttcttggtggcaatgacagagagtgcctagtctaaattcccagctgtggatttcctatgacaccatggctttgtactgaaacagttaagtcacatttacagggtgacatgtaaaaacagcaacagcatatttggttgtcccttatcatgatttccagtatccttgaaactcagagatcaaggcagtgatggtaagaaatgctcccatagaaggcaaaacaggccataatatttacataataaattgaaacccataattataaaagcattcagaaactcctagaagatagatttaataagattctaacatacctaatataaatctgaatataaattaactgggtggtaggttcttaaatcctgcatattaggaggtgtctaataaagctctaatgttctttgtggttcttttccaactatcatactggtgagcacaaaagctgtgttatgtacagaatggctgggtttatccctagtagaaagaagttatgtttggtatctaaagaacaatgagagtttgctgcttggctgatcagtgctggatcaagttcacattccccggctcccactctccacctccacatgcagggggtggaagcagaacacagggaggggaggacaggtcctttttcacggagagacgtgagcctgggctttccttatatggacacagctcggcctgtgtagcattaaacactgatttcatccaccgctggagaaaacatcctacaaaaagtgaagagattagcagccaattaattctggcccttcccattgttttcctggaacacctccttgtatggcactgaatgtttggtgaacaaacattctggaaaatagctttctctcatatcttatttatatttggaacagccactccaccccccacatgtggtggattttacttgcctctgtgtgtgtgtgtgtgtgtgtgtgtgtgtgtgtgtgtgtgtgagagagagattttacttcttcatcaagggatggatgaatcaggcccattcctcttgttgcaagttgtgacttcattggttttcttttggaggatatataacaagccacacagtctgagtgccaagctttttaaaactcgacctgccagggccacagactcccatcacgtcccctccttcagaggcactgtggagcatccacatgtccatgtgcccacacttccagataccacacctgctctatcttaggaaataacgggaaagtacctagacatggttgtttgcttttcaagctggtgaaatatcaacatctgatatttttgtgtttttcagtagtaactaatccctttttgtaaggcattttgtcagaataattttcctatagcagcaatatatgtgtgtgtgttttctaaacaatagagcccatgtggttagagcacagtgctcaagactggaggaagtcagcatgggttgcttcctgaatggaacaataccttttgcacacagcaaagggtcttttccattggtgcacactgtcccctaattctagccagcaatcttccaaatgcagatgttcatttcaagggaatggatggcagccctcagcataattagaacatcatctacagatgatgagttggaaataccaccttcatgtttacagtattgcaggtcagcactaagattgggttcctaaagataaggatgtatgcacttttcgctaaggacccagaactgtattagctttagagaaaaaaagtcagatatctgcccattgttgcctcccttctgggtagaatgttgaaatcttccacttctttttagttctttttgtgtgtgtgcttaactcatcttgcccaaaattttatcccttggtgtaagctgcaggaagtgactcctggtttggaccaccagcccatcctgcccaacattgtgtctgccatctgccaaattggacttactgtagtaaagcatagtgagtggctatcatctgtggcattgactttgaaatttagatgtctcccaagcatctggaattttttccatagtaacctatttgagatggggcatcattaaaattatctaaggcagtggttctcaatgctacctgcacattggaatcctgaggggtggaggtgcttcagaaatgactgatgtctgggtcccactctcagagatgtgaacctaagtggtcacctgggcattgagatttgtaaaacaccttctggtgactctaataagcactcgagagtagaaaccactgatctaaaggcacccttacatcattttatatttcacctgtgaaattttgttttttttgagacagagtcttgctctattacccaggctggagtgcggtggcacaacagtggctcactggagcctcaaactccagggctcaagcgatacttctgcctcagcctcctgagtacctgggactagaggcatacgccaccgtgcccagctaattttttattttcattttttgtagagatgggatctcactatgttgcccaggctggtcttgaactcctggcctcaagtgatcctcccacctcagcctcccgaagtgctagcattacaggcatgagccaccacacacagctgaaaactctttaaggttataatgtccatgaatatcaagccctgtaaataactgcagttgtaacaggcattgaagggaatataataatgtctgctttttagaatgtatttttcagtagacttttatggtatggaattatattttccagcctatgttgtcatctggggttgatctaatccatataatgaacaaatatgttaaagtgagacagtcacactagatgttccgtaagtactcacgctggagtagaaagagtattccatttccaaccaggagacctaggggccaagcgatatgaaatcccctgagactcagtttttccatctttcagatgggactgtgtgaggaacgagcagaacagtctgtatatggaagcactttgtaaagccttcagttctgtaggtaattgccactcttcttctctctagcagtctaaggtcctgtgctctctggtaggggtgcttcaatactttttttgtcttaaagtcacttccctccagcttctggtaatgttgtattgcttcttaattctagtcatttagaagttgataaataacaactgcttcttgttctaagcaaattacatgtcatttgatcagaactttatgaggaaggaggcttagaggggccacacagctactaggcaagccggctgtgtgctccttataccttgctgtattactgcgttgtcacaggagtttcctgaggacagggacaacgtcttactcatctttgcattcacgaaatctagtgctctgtttcacagtaggcatttaatatgtcttttatgtgaataacctgtccatatgttcaacttacattattctctccataatctaagcccctttcttctggttttgataccaagaagtaaaatatttggttggttagcctttttgtaatagtcctgtatagtattatgtttatttgatgatgtctgtatagtattatatctgcgtagtattatatattttgacagttcttttcatagaattttataagtagagttataagttaagaacagtcatacatccttaactcctgtactttacttctaaacgttgttaatggagataaatcttagaaccataagattttcccagatcctcccttctcccatccaaagagaaaaaggaaattaaaaaaaaacaaaaaaccccaaaaaacccagaatactttattgagttatcctcttccctgtccaaaatggagtgaaggcagcttccaaaacagataaatataacatgatagaaataaaacaagaaaaatgaagcaacatgaaaataatggtagaaaaaaaaggatggggccaggaattaaattagcacataatatgcacaccctgaagttcctatgcctggttaaacagggtcacagaactccaagctttctagaagagggaaaagggataaattgcaatattcaagaagtaaaaacaaaaaagctgcctaagtccgactattcctgatgctgataccaggaagaagattgtcctatggctcctcacagaaaattactatctaatggaataaacaaccctctaaatccatccttccggtaaacattgtgatggattttatggggctgtttcttataatgcacctcaataaatgttgatggcttcttaccagaacttaatgcgataacaggactttcacagagtgcccataagaccaagtccagggccagctttaaaagtggtctggcttattccaagaagggattttagagtatccagactacaagtttaggtacagaagaatctgtgaacatcctgacaattggggtgtgtgtgtgtgtgtgcatgcatgtgtgtgtgctgtaggtgtatttttttctaaggagctgatagcaccattagccttcattagaatctcagagggggtcaagaaatggaagaactaagcattgtacatgttccctcagttgatctctgtaaacgtttttagcagcagtgagctcaggttatggttactgagagaaagaaggtctgttagctggttcactgcagaaccatagcctcagcaatccactacgccaagcatgaaactgacttccttttttgaaaattatgctttgtaaggacttccactaagaggtccgtttggcagggccaaaatcctcctaaaaaaaaacaatgacaacaacaactaggtgtttatttaagagagagacaaaatgggcaaataaaaataatacaaataacaggtaaaaacaaaccagctgatcaagtccaactattcctgatgctgacgccagggagaagactgtcctgtggctcctcatagaaaattactatctaatgtaataaacaaccctctaaacatcctttatgtagcatcttttatattttttggattaatttataatttttctaaaatcatccaaaaatattacataaaggatgttacatttaaaaataatagatggccggtcacggtggctcacgtctgtaatctcagcactttgggaggccaaggtgggtggatcacctgagatcagaagtttgagaccagcctggccaacatggtgaaaccctgtctctactaaaagtataaaaattagctggacgtggtggcaggcgcctgtaatcccagctactggggaggctgaggcaggagaatcgcttgagcctgggaggcagaggttgcagtgagccaagattgcaccattgcactccagcctaggtgacaagagcaagacattgtctcaaaataaataaataaataaaccaaatttaaagatataaatatttgataattttgctcctaatccctctgttatttttgaaacttaatccaaccttgattttatttctagacgtgtgtagattcctacttttaaattcaccctgaacgtatgttggcaatagaacgcttctgaaaccagtggaagcttctggaactctcgaccttgtttggtattgaaagatctttcggtttcttttagtggatagttttccctccgctgtgcctgagggaatgtaatttgccatctgtggctgtttgggaacattgaagagccccttgcttgccctgtggccttcctggtgcctaggaaggctggctcctcttccttcctctgtcctgtgccccctccatgaagtagaagcaggaagagaaaacacacccgtaacaatgtgaagttggtctcactgtatttttccagtgataggaggaatttcttctttgtctaagaaaaggaagaaaactgaaaaaggctttccctccaaaagtaatctccaatcaatcacgaggttaaataattttaaagcaatggtattttcctcagcctcggacgttgtcttcagctattatgaactgctttgacaaaaaaagtttcttagaacaacttcctttcaaaacatgcgtatctactggatgaggcatttttaaagatacaattcagatagaaaacatctgttttaagagacagctttaaagtgcttttactacattctcaaagacagtaattagaatacctgtcccccactatagaattccagtttttaaaaaagcggtcttccagtttctctacaccctaccttcattggcatcagcctgtgaagaaggggagattcaggtagacaacaggagaaatgtgttcaggctggattgaacacaatagaaaagtattttttccgtgtcatgcaatatgtaaatctttcattctagattaaattcagcttgtagcaccatgctggaatataattttagtgattcatatgtgacagaattaggaacctttctcatttcaattttttaaaatttatcgttatttacttattaatatttttttgaggcaggatctcactctgttgcccaggctggagtgcagtggtgccatcatggctcaccgtagcctctgcctcccgggctcaagtgatcctcccacctcaccctcccagatagctggtaccgcaggctaacaccaccatgcctggctgattttttttttttttgtagagacaggggtcttgctatgttgcccaggatggtgttgaactcttaggctcaagagatcctcccaccccggcctcccaaagtgcggggattacaggtgtgagccaccgtgcacagcctgtttataaagttaccctggcaatataactaatatcccatggtctcccttttgtaaaaatgtaaaattctagcctctttacaaattaagcattttagtggtgaaacaaacaggaggtaattagaaagatattcattttaagacttctcccccttgaaattttaggtgtccttcatttgttcctttatccttccattcactatataacatatttattgaatttctagtatatgccaggcaatgtttctggtggactgaacaaaaatcaagaacaaaagatacgggatctctttcttcttggggcataaaatccagctggggagagagacgttcagtacatttttaaaagagctataataactgaacatcacagagtgagccctaatgtaaatttgactttagtgaataataatgtatcaatattggttcctcagttataataaatatactaatgcaatatgttaaatatggggaagctggtgagtgggtacaaatatgggaactctgctttctgctcagtttttctataaacttaaaactgctctaagaatcactctaaaggaaataaacagaatgttattagaaagtatagtggagtgacataatttggactggggagtaaggaaagacctttctgcaaaagcgctgcttaaacccagaactagaggataagtgggctaccacgcaaagaagagatggaaaagcattctcagtgaagcaaagtggtatcatttgaattacctttggacgtaccattctggcttctctgtggaggatggattctgggatggcaattgggaggagagttgggggacaaaggacaaacgagacaagaggcaattaggatgggtcacagcttttgcttcctacttagcaaaatcctagaagagcagagtgacagtaggctgtttcctttgttcagctcatgccggaaaccgttaggttatccatgatctgggtgctaggaagaaaggagactgtgtcagtagcagagcaagacagggtttccaggtctcagtttctaagatctttccagtggttcaatgggatttatagaattaagaatgtgtgtgtgtgtgtgtgtgtgtgcgcgcgcgcgcgcgtgtgtgactgcaaccagttaaaaactgcaaagggaaaaaacttttcaaataactagtacccagctgttaacaacagctttcatataagtctgtaagatttaatttgcaatagttgtctttattcctgttactggactattggaatttattttggattttgtttcttccaagactgtatgttgaaaaactgtatttaagcagagcactgttttagtacatcaatattgaatggctcatatcacagtttctggggatcgtgaactcccaaggaaaaaaattctagtgggtaaaaggaagtgcctgccaagatagatttctattgattgtggaactcttattagcagcataaaaggttgaagagtttaaagttctctttccctttaaaattaagcagctcagaataatccacttcaccatttataattatttacctgcctatgtgcaagatttccaaaccattaactatttatatatatttcctttacagtaaaaaattgtatatgatggctgtacagtctatactaaaagatataataacacattgaaaaatctctagcaaatgagcacacatttcgtagcacttagctattataataatgacgcaaaatggttaacacgtctatttatattgctctctagatttcaacttttttgtattcctggaaacagtaagaatccctcatttgagcagacttgttgtttgttttaggaaatagacatacatcatccgtgtaattttaagtagtccagttatgaatatggaatgaagggataaattcctgatgtctccattaagctcctctgtgtaaaatactccatggcaaagttgctgctatttaaagtagtgagtttgatcttggctttgatctaaaccttttgatcttgaaagaaggatggagtagcaataaagagagggcaagacagattttctttaaagaaatgtgataaagttaaagggatggtcaagacccagcaagcaacaggacaacccgactctccgccccggcccgccctcaccggcaggcgggttccagcaactgctgatgcggatgagaaggcctttggcgggtggaggaaaatcttggggtatcgcacatttttataaagtaagtgtaaactttctccctaattatgaaaacagattgaccccttctttttaaattctacccagtggttctgggggtccacggcagtctgagggctgcgggtccacactcgcgggagcgcggggctgggtttctctgcgccctggcctcgccccccgggaggtcacctgccgctgcccggagccccgaggggccactgggaaacgtctactcgagggcgtagaacccggtcccggagaaaactccactaggaaagttactttccctgcgcgaaagccaccgggaccaggtttccgactccaggagcgcgctacgctggctacgggcggggttccttccccgccaccgctccctccagcctgcggcgggcggcgcgggcccctctcgctgccgggaagccgctcgcagggcgcggagccgggggaggggtggcgggggcaaggtgcgcgggggcgcggggcggccggagcccggggaggggtggcgggggcaaggtgcgcgggggcgcggggcggccggagcccgggagcgggagcacgccgttcgtggggagaacaatacaatgccggcgcgggcgggagggcgacctgcgggaggcggcgcggccgctatacctttaaggcaggccccgcccccgctcggtgcccgcccgcccgcccgcgccgccgcccaggccccgcgcccgccgcccgcgccgcgcctgaggtgatgcggaccccgggcgggcgcagggcgcgggctccggcgccgccgctgcgtcctccccggccgcgggcgaggtacggggcgggcacgccgagttagcgggcgcggggcagggaggccggggccgctcccgcggtaaacttgactgtgtcctcttcccccgcagccgctgcagagggagcgtcgcgccggggcggagtgcgggcttgcgcggcaagtgcgcgccgaggtgagtgcgggcggcgcggtccctgcgccccggtggcgccggcgcgagaccgcggctggcgagaggccctggctctgcgctgcggcgcgcgggtgcggggactacccgccaggctccggctcgggcgcggggagcggccgtgacgaaggtcgcggcccctgcggtgaggcgcccggcgagttccgcgggcgggcgcgggtggcctcccgaggtgcggggaagaccaggtcgcgaggccgggggtctctgctttctcgcgctgggggatggccgtcaggaccctgtcgccttctttgaaatgctgtggtttttgaacctcaggtcacgaaatggattggagtgaaccggagaccccgaaaacggaagcgcagggagaaggaagaggtgtttgaaaaggtaggggttcccgagacggtactcggtgcaggtcttggtaaatccgcttctgccccgtgaggacctggtcatgacaatagagtagtgtttaatttaaaaagtttttgttataataaaccatagatttaatatatggggaaattctacagaaatattggtcgataaggctaatgatcatttatatagtctcattaggagagagtagcccatgaaatttgtttcatgctcattaaatacagcaatcggacttaagtgggttccattattattttagatcagcagtgtttattatctcagtgttaaggtacctctgaaaaatgaaaagtgttccgaataaatcgcccacagtattaggtttccatgctgtactttctctcacctagactttaaattggagtcatctaagaaatagagagagaagaagaaagaagtggattacttttaaaacactaggaggaattttatttactgtaaagcagatgagaaatttgtttgcccaagtttagaatttcagtatgttactttgcagaagtttggactgcctgtcttttgattttgtattaaaacttgatttgtcattgtaatatcatgaaataaggtaagtagcccgttgttttctaagtgacttgcggaaaactcgtaaaagtgaataattttttgacaaatattacagcagataggtttttttgttgcttttgcttaattacatttcactgttttttgattcttgataccagcaagggattaaaatagcggtgtgtttttctgctgctagaatgtatgatgaatcactcttgattctgaagccaaattcttgctgatagcattgctgccaatttctgtgctatgttgccttagtatgggcattgcagcgtccgagaatgtgcacaaagcacatcagaataaaggtgatcccagagctgcagagtgcacgtcaggataccagagggcagcttctgagagagctggaaaaggaaccagcctgcgaatatagttgtttgtagctggactttcagtgtgcatgaaaagggggaccccaccccttttctttttccacagagggtcatatatgtcacttcagttgaagaataatagaaaaagttgtgatttggaacagacttgagttttctgaccatacctcagcatggtatggtaagttgtgtttaatggtttaggtgtttttttaaatgtttgtgaggtgatgaatgagatcataaaatacccaaagaaggaaaagaattatggcttgcttggtattttttaaaaaatgtgtcgttgctgttaattttttttttttttttttgagacggagtcttgctctgtcacccaggctggagtgcagtggcgtgatctcggctcattgaagcctcggcctcccaggttcaagctattcttctgcctcagcctcccgaatagctggaactacaggcacatggcaccacaccctgctaatttttgtatttttagtagagacggggtttcactgtgttagccaggatggtctcgatctcctgacttcgtgatctgcccgcctcggtgtcccaaagtgctgggattacaggcgtgagccactgcaccctgccagctgttaatttttaagccaaaaataagattaccaaaatgcacaatgtgctgtagaaaggaaggggaagccattatctttgtggattactagatgttgtcactaccaaaatctaacctagaagtaaccgtatttgtgacacccatgacctgactactgggtctcctgagaatcggggtggggagaaagtgggggggggactgattattttaccttgcaggagaatgaagttctttgcccaaccgtttcctcttgatacaagctcttgcgttaaaacttagggggaagatttgcctctcactttttttcttggaaaatgtgggcagcaattttaaagagaacatgaaaatggagtaggttgaaaccaacattcagaacttcctttcatggattgaaacttaaagctgaggaggtttgagggtggaggtgaggaagggctagaagatagcaaatttcagagtcatatcagagaatatgaactgtcagtgtttccaatgtttctcttggctctgcacagcacttccaagcccttttgctcactgttttgcttctgccacacctaggagaagattcagagcttgctgaggcaaaacatgcgatatttccaagggccttccccctattctgaaatagaaattgagctttgtgatcatgtgtattcattccaaggtctatgtgttaaccttttgctaggatttgaacctgttattagtaggagccgacgcagttcacttgctgttgagtctaataagttatttttaaaaacgtttgccatgtcacaagtagaagcagattattcaatttctcttttttcctgcatccactatatttttcttctgtgttaaaataaagctatggtattttctgattttattcattttgtattagtgtaaaataaaatgaatcttagtcatttctggtagatgccgctttgaaatgtagccattgcttttgattgtctactttgttttccttgcctccgttcatcccctccacattgcccttgcctccagccccgaagggtctgtctacacctgcaggcttctctcaggattcagcctagatgagtaaattcggtgaagtcatctgtactaactctgctgggggtcacaacctttttcctccgataggagggggcagcttttttcctgccgtgtggaaagcagaacctctgacctgcccgggaaaggaaaacagtgctctagtgagaggacggactctgaccacgggcgctgagcaaggagctacacggtagaacggcatcttccagggatgtttgttttccccttaaagaaaatctcgaaggtgctgagtagtaggcacagtctgatgtaacctgaaatactagttgagtttttcagtgaactcacaaggggaagcaaaacaaactcaccctgtgctcagctgtgggttaaaataacgaatagtgaaataaagtaaattggggactgagatgtaccatgcagataaagtgatgtaaagtgctctgccggcctttccccgccttctgcttccagtcatcccacccaccagagaattgtgccatctttctgtgttgtcctaacaggcttcatttcttatctctctgaagatgcatcattctgtctcatgcgtcttttcatattttctctgacatttatttccattttattttagtttcatattttagcccttgttctcctggtatgactgaattcttttatattttgtttttcgtttaaaatgacaaaactcacctcttctacttctggtcctcaggtatttttttcttctattctgatactcttttttattatttcaagttcctttcatttagtttgaataatttttgcaacagaaaaacaaggaaagtatgaataactaacgaagaacaattaggatgattggatcagccagctgtgcaaaggacaggatgaacggttgtgattgcaacagtggattttatgtgtgtttttaaactaatagatttcactaaatggctattggttttggaagaggaatgcacttttttttctttttttttaccttcgttagctgattcaaagataaaattgtgtgccatcacagattaaggaatgtttttataaatatatacatataatataaagatttagtaactcttttatcaatattctaaggattagaatgtatagtagaatagtcttttatgaaataatatacttatggaaaatatatgactggtatatgattcctttagaggaagaaaatttcaattttcagattcaaaggaagcacccttcctagtctatatatatagtaagcggagaactagttttacagtgctcatttcaggtcttcagtaagtgtgtatgatgatgtcagaagtattcattggctcactttcaaatcattgaaaattcagccatgctaaggttggctattacgtgtattagcgtttccaagcgagtggtcttggctggggtgagattgtcagctgtctgttaggattagtcacaacaaacatggtgcaaatggtttccaacaacagcgcacttcaatgttaccttcataattcttttctgccagaacccaaaaaacaatactcttgagctactcagtgttccaattgttaaaaatttcctgaaattttccttcatgtattcaaagtgaaacataaagatctagaaggatggttgtgaaaagtatagactttatagtatctagtgggcattttcattgagcccaaatgataaattctgttttccaagtcttttaagtgaaaaaaaaaaagattttccttgttataatatattcctaaattctagagtattttcactctacttctatttcatttgttccttgtacatacttgactctgaaccaaaatcagtgataatcttagtttgaataataattcagatttaaaaaattgtatataaaatccaatttggtttatgcattttttagcgtttattgttccttttaaattttatatattgtaagagaatacttttattacagtactaatattattcaaaatgataaaggtaggtacaaattttaaactatttaacaaagtactgctgtgtttgtcttttgttacaaaggtatattttatgttcagtttatgatctctgaaaatgaatattaagactaataaaaattatttggctctttcttggacccaaaacaacagatggtgactgtggtaggcttgactccagagccatcagcacacaaagcttagcaaaatggcacagaatgaacctatggagtgctgagctgagggtcccttcactttgtaggaactaccccgctttcagcaaatagtaggcttaggcagccactcttatgccactgaggcaacattgcagttgagtgctttcccaggcgttggtgcccttgcctctttttgagagtgccattgctctgtgagaattcataactagtctacatttatatagccgtaatctcttacaatagcttcattgatacttgatttccatagaaaagctttatggattctagtgagtcacggctcttgaagcaccagcctacccgttttccctcccttcatcccttcctccctaactgtgagtggctttgtatcctgtgttgtactgattgtgcctttggatggcaacttacttgagtgatggggggaggcagaataatttattaaaagtaattacaaagaaaccaaacaaaaggagtaattacagtgctgttaatacgcaattcgttactttattgctgaaatatttggaactcatttgagattcttggtcctatttgtgggtctctgattttcccttgtaaatccctaataaataatgtattaaagtttctgtacccaggtctcattttagatgaggtttcacaaagtcttagctttgtttgctatatatttttttaagctggaccaaggaataattgctgataaaaggtatttttggtagcctcaggaaggaaatctgatctgtataatttactgttaaatttttatctgttgtatagatttacttatttttcctaatttccctagccattgatttttttttttttttttttttttgatacgaagtctcactctgtcccccaggctggagtgcagtgacctccacctcgcgggttccagcgattcttctgcctcagcctcccgagtagctgggactacaggcacgtgccaccacgccccatgcccggctaattttttttgtttttagtagagatggggtttcaccgtgttagccaggatggtctctatctcctgacctcgtgatccgcccacctcggcctcccaaagtgctgggattacagacatgagccaccgcgcacagctgatgtatttttttaagactgccgttttgctgggcatggtaactcacgcctgtaatccaagcactttgggagactgaggcaggaggatcacttcacaccaggagttcgagacagcttgggcaacatagagagaccccatcactacaaaacataaaggaagtaaaaattaggtatgatggtacatggctgtagtcccagccactcaggaggttgaggcagtagaatcgcttgagttaatgagttagaggttatagtgagctgtaatcctgccactacacaccagcctgggtgacagtgcaagacccaaactcaaaaacaaaaacaaaaaaaatctatagtttaaaaaaaagttccaagatttctgtgtacaaaattccttcccgtttttaactagcataataaggaaagttaaagtatcatcatccacttacccacatacacttattcacatattttaaaaagaatctttgaatggaactattcatatcataatagctaacatttcccatgtgtcaagcactgttctaaatccattacatgtatcagatcatgtaaatgtacaattaaagtagtatcacaaccagcaatatgacattaggatgttgtagagtgcatcaaacactttttgaaaggggtgaggtgtaaagaagtcaaacaattgctataaaaaagaatgctttgggcaatatttgaaaattctctttagtgcaggttattgacaatcctagaccaccagcataaagcacacatatctaatttaggaaaatcccagccgggatgtatttgaaaacatttggaagtgtgctgataattacactactattgattttagcaagtttgatgccagcagccatcaactcttctatgccataagagatgaaagccatttttatataaaatgttagagttcggctggaaaagggaggcaggcagagaaaaatttcgtggctttttagttacttttataggcagtattagtttcattcttgtgacagaatgctttacttggcagtcattctcatcgacattttaaggagctgctgttttgtgcctgggtctcatatggcactaataaggtgcatttttttctgtagcacgtactgatgtctgtgtgggctcaggcctgccattgtttccattcatcttgtattggaggaggctgacagcagcgtgtatcgagtctagccaacatatatttccttctggaaatatatgttcagggtctgtgcccacagaagagttaaactcaagcttttaatctccaacacttagaaaaaggcctggccacatgcagcctcaataagtatttgttgaatgaattaaatgaatgaatcccacaaatggcatttattttataaactcatacctggctattgcattaaaaatttttttttcgctattcaggtttttatttattttgttttttttttttaacgttagaggttttcatcaaagtatatttggtagagttttcctgttttttttttgggggggggggcagggcgattatctcttatcttttctataaagagagcttggattcctaaagaccttatactggtcccaactgtaccacctaatcatgtgtcccttgagtttgtcacgtgacctttgctttcctctgaaaatccttttactcagtaggccaattaaacccatttataataattaataaaatcaatatgtttgacttcaagtttttcccttagttttatgattttttaaaagtattatccttttttggcatttaggaaggcatctatttttgttttaatggttactttgatgtaatactttttttttctgctcttgtgtattgattcccgctgtgagtgataaatcagtcatttaccttttcttccccctcctctctttattttccatcatataacttgaaatattatccttttttttttttttacttcctgtaaatacctgtaagacagtcggccggaggattgtattttcaatataatctcctcattattcccttcttgatggttggactgtgtctacaatgtcagagcatataggcattacatactatgctgtaccctttataaaatcacttaagttttaattctgtggtttatatttaatgttcatcatctgcttttagattgatgtcttttcagtcaattctgaagcttgttttctagtagaattctcaggaagagcttagaacagctatagtcctggttttttgcatgttttaagtttgtgctgtttatacctgaaggtcatgtcagctaaataagaaatccttggttcatattttttaatttaattatctaaagtctgttactccattgtcatcctacataaagtctcatgctggtctcatttctttcccttggggagtgacctggtcatttttcctggacacccagattttttctatacattccaataattttagtttaatatgtctcattgtgggttacttttcctggttgtcacttggcttttgagctttattttccttgtctgtaaaatgagaataacttttttgttttgcttgctcacagtagatatgaagccaaataaggtattatatatgaagtgctttaaatgtattattttactatcttgttatcctttaaagtttcttgttattaggaactttgaaatttagacagcctgagcaacatggcaaaaccttatctctaccaaatacaaaaattgtctggtcatggtggctcacgcctgtaatcccagtactttgggaggccagggtggatggatggcttgagtctaggagttcaagactagcctgggcaacatagcgagatcccatctctagaaaaaaaaaagaacacaaaaattagctggacgtggtggtacatgtctgtggtcccagctcctccagggctgaggtggagtgtcccttgagcctgggaggcgaatgttgctataagcctagatcgtgccactgccttccagcctgggtgacagagcaagaccctgtttcaaaaaaaaaaaagagaaaagaaacttaagagtacttcattttatgagtgtatggacttgagttgatgttctgtctgtgaaaagtaaatagtggctacccagtgagtcttctatgtcccgacagtaaataacctttccctgattccatgtggtaagcaggatctctgcatctactcatggaggactactactggattgaaggaagtggcgctttctgaagtacctcatctagaaaactccatttccatttatcttctcacactcttgcctgtcatgttagttccccactcagaactctgggtttacatgatttcagtttatatgtgcatagagaaacactggaaaaaattaaagtagtctatttttcagataatgaggattgctgaaaacctaagtcagcctgaacaaccagtacattttcttgaatttattgtacataagtcccccacgtaagaggctgctggaaaataccaaagagacatgagaaatgtcatttctggccatggggagatcaaacacacagcatatcaaagatcacttacaaagcatcctgtgataaataaatccacagcagcataacacaaactaaagacatgagtatatgatgcatttttacccgaggctaccctgggctagagtttccatgcctggtctttgttttgataaagcaacactttacacatgtaggctggaaattatggtgggaaattggataattgaattaactgagtccattttagtgcttttacctggtttgtaagcacagataggggtttgattgatgtatatgtaaatagtgttagtgtctttatttgaatatatgcttttaaaaattcatctatgttttgcaagtaaagctggaacctattatagaagtcctgctgacacctgtgaatcaagacgatttggaaacccaaggccagaaatgtaatactgttgattattctgtgcataacacatttcttattaaattctatatttattcaaacaatttacaatttttatttgatgttcacaacgtacaaaaccctgagtcaggagtagagaatactgagatgaatagaatagtttatagttagaagtagaaaactatataggataggagaatttatagatagatgtagaaaactattataggatagaagacaattgaatcacacctgtatcagaggtgcagggaagtgcaggaggtatcggaacagtttggatctctataagggaagtcatcactttgggtattttcattgtccataagccctccttcaggctgatagcaggatacaaatacctgtgcagtttcattcaactcttgttattttgtataatcgaggataccataatttgtattctcaaaatccagattgccttcatgagcacatactcagtatgaaattttttttcttctatttttagtagagacagggttgcaccatgttggccagggtggtctcgaactcctgacctcaagtgatccgcctgccttggcctcccaaagtgctgggattacaggtatgaaccactttgcctggccccggaaattgatcttttatctttggctcataaatgtgaaatcaaagtgccacagcaagtttaggctacctctgaacttggttcagtctattttactctcactcttttttccttttacttgcattaagctttttttttttttccccccacggtaaacctttggttttaaggcaaaataaaatgtttcagaattggggatggtaactttaagttctagagttattcaaagtttccttctcttgtgatttttttttttttttttttgaaacgtattctctatcgcccaggctggagtgcagtggcgcgatcttggcccactgcaacgtcagcctcccgggttcaagccattctccctgcctcagcctcctgagtagctgagattacaggcacccaccaccacgcctggctaatttttgttttttagtagaaatggggtttcatcatgttgaccaggctggtgctgaactcctgacctcaggtaatctacccactttggcctcccaaagtgctgggattacaggtgtgagccaccgcgccaggcccttttgtgatttttgaatgttaggttgtcattcagatagcatcccacacgtttccagcaccacagatatagcatgacctttttttattgagatggggtctcattctgtcacccaggcttaagtccaatggcatgattatggctcactgtaagctcaaacttttggattcaagtgatcctcctgcctcagcctcctgagtagctgagactacaggtgtgtaccaccatgtcagctttttttttttttaaaagagacagggtctctatgttgctggtcttgaactactggccacaagcaatccttgtgcttcagccacccaaagtgctaggattacaggcatgagccaccactcccgaccctggcattttcttagataaggtaacagtagtcattttatgtggcctcacttgtaactacaagtcacatagctcatgctattaatttataattatatataattatatatataatttatgtatatataaaatgtggcaattttctaccattaatttggtgtccaagaggagaaaaagctatgaagggcatgagacattaaacaggaatggcagaaagaatccaggagaaaagcagaatgtacctctggatcctattcgtatacaagtgggtttctgtttttttttctccctaaccatcacacatacataagctttagttttcagtgtcaaagctatacagtcacacatcacttaattatggggaaatgcttcatgtggtgatttcatcatggtgagaacatcatagagtatacttagacaaacctagatggtagagcctattgctcctacacttcaaatttgtacaacatgttactgtactgaatactgcaagcaattgtaacacattggtaattattaatgtatctaaacctgtctaaacatagaaaagggacagtaaaaatacagtattatattcttatgggaccaccgttgtgtatgtgacccatcgttgactgaaatgtcgttatgcagcgtgtggctctaccttcaacatttactcctgatgacaaaggtaaagattgctgagtgcccccacagacagcaaagatggtgattctgagtctcgctcttaatgactttcttgagttatatgtcatgtatacgttacatgccaggaaattcatccacagacagtttgttgagttttaagaaatgcttatagttgtgtacctgatacgacagtccagttttagaacatttccatcacccagaaagttccttgtatccatttgtagtcaatccccattcctcctcctagccccaggcaagtactagtctgctttctggtttatagtttaccttttctagaaatttcatgtaattgaatcatacactactcagtcttttggatctgcttctttcattgtaaagtttgagctccagtggtgttgcatgtatcactagttcctttttattttaaagtagttttgcattgtatggatatactacattttgttgatccacttactggttatgagatgtttggaatgttttttgcagtttttggctattatgaataacccatctgtggacactggtataactgtctttgtgtagacatatgttttcatttctcttgggtgggtacctaggcattgaatggcttggctatatggcaggtatatgtttaactttttaagaagttgctagactgttttccaaagtacctgtaccattttacatttccaccagcagtgtttaaggtttttagtttctctgcctccttgtcagctcctggtattgtcagacttctttattttagccactccggtgggtgttcaaacgtgcttttttatacttaacattttatttcttgagaggatttgaaagtgtctagataccttaatgctgctcgtgtcttccattttacagaccagaaggcattggcccagtaaatgggaatctaaatgtctcacccgagattcccaaatgagtcactgagcctagaatcttcatgcgtcagttggagttgtagcaacctgcttttgttctgtcaactattgtgactcagaatcctctctgtccttgtagcattgttaggtgtgcctttctttttatcctttcaaaatcatctgttcttatcctctctggaattgtgtctgatgacatgcagcttgttttctgcagaagaatgctagtgttgtggagaggttctctctgcctcttggctgcagcacacaggcgctgggtggtcagacctgcttccgaggctgtctccacagtgactgtgcaaccgcatgtcatcctgtgaaagggcagatacgtgcctcgtcagagccttgtgggagttagtgaggggacttctctaaggcagctagtactcactcaatacttaatgcatcttaaggcacctcttcacagaaggcggtggaaggctgcttacgtgatggcatgtggatagcgatgccatccgtttgtttttttctcctccatgacagagaagcaggaaaacattcctaaatttatttatagacgttaaaaaaaaatcaggcttggttttttcctgtaactgttcttcagccggcagcaagtatagcagcaagtatacagcagcaagtatacagcagcaagtatacagcagcaagtacagcagcagcaagtacagcagcagtactttatgagttgttgtgtttattccctgccttttggctttactcaagaaaaccagttgtgtttctcagagcaactgtattgttttatttgccactctcttcactttgtccattatagtacaatagattgtccttgtcccgtctccaaattggaagctccctaggtggtggtcaggctgttgatgagatttgtattctatcaaagctccattttagataatctatcatcattttttatacgcagtaagtcgctgattttgtttctttttttcaaacagttttgatttgaagttcctttaaaggctgttggagcttttgcaaatacccagctaatgaaaggcacttaagattgggcccatgtgcatcatcacattgaagttttctgtctaaaggaaggttccagctacctgttacccttttgctaaacacagttgcagtgttgcagtgtatttcatgacaaaagtgtactctagttttctgtgaaatgattattttctctgaaatgattcttggtcatgttgagcttctaaatgttaaagagaacatagtgcttttgacctgtggaaatctcatcttggtaccatggtgctgcacagaccatcaggaagaactgaaaagttcaggcaacttgagaaaataaagtcaccaccagcaagaagctgtctaaaataaccggaagattataacccaagcacgtggaggagtgtgctagtgagtagaatgttatgaaagctactagaggtcctccatagatgcatgtgctagtcctaaggagaaggaagaggagaaggattgccacggaggaacacctgaagtttcagttgagcactttgtttggaaagttgtccaaggctggagttgtgagagctgggaaagacctcacaagcttctctaattcaagtccttgtttcacatatgagaatgcagaggccctgagaagttgattcccaggcctgcatgctggcctggaactagagcctgggtctcctcttgctttttccagctgtctgcccaggtagctccccaaggcaggcatggaggcagagctgctttgggttccaggtaaggagagatgtgtccaggtggcctttgttgtattgtggggcacagacactgagggagacagggaaaggtctgggagacacaagatggtaccccagaaggccatcctttgtagactagacacacatccaaagggagggctgtttcctggcttattgaggacttttccatttgggctagaagtaaactgagtcagattttgagagatcagtaattccaaagagcagataaggattctatagtaacacagctgggttcactgcacgggttgatgtcaaattgtgcttttcatgttacattagtggattttacaaggcacagattatttgacatttttgtgatgcttgttatagaccaactgtgacatgacagtattatttaaaaaaaaaaaaagaaatatagggccaggcatgatggctcacgcctatagtttcagcactttgggaggctgaggcaggtggatcgcttgagctcaggagttcaagaccaacctcggcaacatggtgaaaccccgtctctactaaaaatgcaaaaattagccaggtgtggtggtgcatggctgtggtcccagctactcaggaggctgaggtgggaggattgcctgagcctgggaggtggaggttgcagttaagccgagattgcgccactgtactccagcctgggcaacagagtgagaccttgtctcaaaaaaaaaaaaaaaaaagacataagcatgaccagataaattgacattttgttttgaaatgcagtaatggcactctcacaaatgaccttttcaccagtctgtgctggtatttgtaaatatatatgttagtattgttttctaaaatgcaaagctgattttcatgtttatatatattcataccttgatatattgcaattttagagtttctgcagtctgtctaacttggctgtttgttcataggccagatcaaactaccctcattccccaaaacttggattgtgaagggattagtgccccagaactctctgtgttactggcagggcaaaatgggtaggaatagtctggcttagggaaaaagacatattttctctctaacacaactggcagatactgaagtgggcaggtggcaagaaaaggcaagtactgagctgattcagacttgcagaaagcttcctctcctccttcttagcaaaatgaaaggctctgggaaaaggcacctgcctttccctgccttgaggatcctggcatccttgagtctttattgaagattaatttaatgacttggtcaacaatagcattacctaatcacagagcatcagattatcataagacaaatttaaatgatgccgaagtatcttccagcagaggattagtgatgtaccagcatgcatgtgtagcttgtgtgggtgtgtgtgcatacaagcatgcacatgtgcgcacacacacagagagtctaattggcctttgtcctctgagcagggggcaggtttgggctggggcctgctgtgtgaccacagtctcccatcttagattgaagctacatcgctgtgtgcatctaactcttgattcacggtctgaccgacgccttggtttctggagaactgccctcgtttatggaagagtcactgtcatcaggagccatcccagggagaggctcagtgggaagtgtaaaggtggagcaagtaaaccggctccagaagagaaggcgaagaaggactatttctgtttagatttgcttaaccgcattttcactttcttgggaacccctgatggagttcaaggtcatagaagagaagaaatcagacactgctacaggactcttgctcttggttcagattattcaatgggaggggagaagagagtagtcgcaagtgattgttgtagattttgtctcagctttttgtttttctttgtatcaaacctgttttgagatcatacactgttacagagaaagagaggaggcatattataaacgtgtggacttcagtgttattccttctcttcaaaatgatgttccaggtgtctagagggtgaggtatgtcatttacatgaaggttaagaataaaacagaaagtgcctctatggtattcttagtggggtttttttcctctgaaaaactgttgccagcatatttgggaatacatccttatattattatttttgagatggggtctctgtcgccaggctggagtgcaatggtgcgatcttggttcactgcaacctccacctcttgggttcaagcgattctcctgcctcagcctcctgggtagctgggactacgggtgcccgccaccatgcctggctaattttttttgtatttttagtagagatggggtttcaccgtgttagccaggatggcctcgatttcctgacctcatgatccgcccgccttggcctcccaaagtgctgggattacgggcgtaagccaccgcgtctggcctattttgtttttttttaaagacagttcattattgtctatcttaatatgttagaaatcactcaaaataaagcagctgttttaacaatagctcagtagaaatagtttgttgagagtgttttacttcccaagaagttttttgatgtagttttcttagcaggaaaaatgtttgtctgttgtggatggaaacatttccccccttgcccagaacatgtgtggtttccattaacttatttttccatagaactttggccatggctgtagctgatgctgtgggtcacctgtgctattagggttaaattgagatcttaaggtacctttctccccgctgtagtccggaatgacatgggtttgtgatcagacaaactgattgaaatcccacctttttgcccctcaccggctttttcacgctggaccgactcgcttctctaagtctcagtttcctcatctgcaaaacagacttcacgggaaaacattttgcacagagctgcccctgcatcatgggtcacagacagtagtaattaatgttactggggaatgggcttttccagtactgttttcagacttaaagtcatttgttatctgtggtgtgttatgggaacagaagatgttcctgagagctgataggagagaccaggaagtgtagctgcaggaagaatgacgatgagggcacgtttggaacatcagcgtggcggatgtgggccagctgaagtgtccccagcattaagactgggaaagcagcccagtcacttctctagtgggtcccagccacaggtgcagaggacgcctgcctcccaggcagacccaggaagctgccccatggggccactctgccctagtcaaatactgcctcaggttcagttggaagtttccagtcggctcctccaaagggagttttagttgaagtcactagagctgttttattgattttggttgaggtctttgtgagctcaatttacaaaaagtctggttatccacaaaaaaatgcttgctggtgtcctgagcaactgaagaattccagaaacctttcaacaacaagtgttgagatctcccctgacccccgcctcccagcaactacagaggtctgagtttgcagtaactattattcttgtgtggaattggctctggatcgttaataagtttccctgagcgctgactaacagaaacccacttagtcacagaagaaatgggtccagtgtttgtcccagctatgagtaatgggttatgcatgatttaaaaaggcttctcagaaaggccttgcttatgtagtcaaggatcaatatttttgaaaagaagtttttataggtaagccataacattacttgataatcagacatcattttcaagtagttaaaagggtcattggataaagctcagtggaccgacactggcttcctaattgctaagggctgaaactccacatgccctgtaaattatgagcatgcttgaattttttatgggaaaagaaattatggttttatgtcggataattttcatgtcaaatgttagatcagccagccggctctatcatccaggcaggttgttgtttttccccacctgatccctgcttttccttgagaagtttattttaaatggagagtcaggaatgagagagaacgtaggataggaatgaatcatgagaaaaatgccaccagttgttttccatagtccgtgtccttgttggaatatccttacctttgtcaacagagagtagcagttcatccacaagctcgtgagcagccactggcagcactgcctccatgaggcctcgggagcattctcattgttttctccaggctgtgctgttcttcccctcagccttgagagtgaccagggatctcctaggcctagggaaacgccacctggtcattggccagagccgtttctagatatggtatctgacccctgtgtgagtaccgactgcccaagagctggcagtagttttgtactctgagcctgagcgtgtggccccacgttccatgaggcctttggccggtttgtttgccagagtgtctctgagaggagggagaatgttggtatggagaataattttattgctttcttctcaaaataaaggaaatactcaagggaatggtgggaggggaggggataaatatagcgtttccgatttcctgcttcctctactcttccacagcatttcacttttcatacggttagattttcatcctatcgacttcagctaaaaataattccaaccatttctatcagattggccctcttatcatacttgttattattttgctttcctattcaaaacctttttttccccttaggccaatgaactgttttactttattagcttcatatttatttatttgttattgatggataataggtatacatagttttagggtacatgtgatttagtaccatcatataatttataaaaatcaaatcattatatttgggatctcaatcaacttaaatatttgtcttttctttatgctagaaccattctcaatagcttttctacagggaataaaagatggtctacagtgctcacctgctgcacctggtgcatgtgtcatggtcttatggctggggcagtcttggtgtcctggcttttggatggtcagaaattctggcttgtccttgttcttccttctcccgtgatccattttcccagcagaggccattacatatgctggtgtccccctactccttccagccttctgttaacagatactgtcagcccacagccactgcagacgtggcccattgctacttccttgtccacagcaacagtgctggatacggctcagtgccttgtcagacagacaagagttgttgatgagtctgcaaagcagagctggtaggttagctgccagagctgaccccactgagcaaagcagtgagtttagtaggtacttggcaaaagttaattcatcaggagttgggagaaaaggtgcaagaaaggtcgtcttagattattgggcatgggctgcctgcttaccacattggtattttcgttttgtataattattaagttgatagtgattttaacaaataaaacataactttgaagtttgggaggtaagtgacttgtgtaaggttttaggttacatgagctaaagataagaatttctgtagtgtcatttcctaattgttcagagtgcccattatgcttagcctaggtgtcttgcttgggttagcccattctaaaagtcgtgtgttcctagggcagtggtcatgatcatcactggactctgccagttcccaggccccagcactgcctccgccggcagcaagcagtaataagtaagctccgagtggttaagcctaatagggctgtgacccagtttgaactccgtaatgaggaaagagcagatttatttgctcccctgcatgcgtccctcccccgtgttcctttattatctttagaggaaattgaatagcaaaattctgcattctcataatgctaatggactgatgtcatcttttccactctgaagtcaagaaagtaagagaaaaccggaatatagatttaacacttcatagctacccagggcttcagcacaggttctttctgtgtatatatatgtttttaacaactttaaggcgtaatttacgtgccataaacaattcactgattttaagtaagttagctaagttgtgcaaccatcaccacaatctagttttaaaacatttccatcatcccagagaaacccctggcatccatcactaatcactgcctatttccccctctcctcatccctaggcaacctgtaaatctacttcttgtttctgtagatttgcagtttctggacatttcatatcagtggaatcatataatacatggtcttacgtgtttgttttctttcacttagcataacgtattgaggtgcatgcatgtcgcagtgtgtatcgctgtgttccctttattcctggacagtattccattttatggttacaccacattttatctgtctgttcaccagttgatgcacatttgggttatttccagtttagggctgtagtaatgctgcagtaagtacagatgagttgttaaatgaacatatgcttttacctctctccgatagatgacctaggagtcacgtaagttgagtaaatttatatgagcagttgagtaaatggagtgatttaagaagcctagattgttttccaaagtggctataccacattaccttcccaccagtgatgaacaagggtcccagtttctccacatctttgccatgagctataaggaatataaccttaactgttgacttgttttatattcttaggtacagaagaaagctaggaactattttaaggtatttacagtttttcaagcattgttaacacatgttaattaaaactgtagggtgggagtggtggctcacgcttgtaatcccagtactttgggagctgaggcgggtggatcgcttgaacctaggagttcgagaccagcctgggcaacatggcgaaaccccatctctataaaaaaatacaaaagttagctggatacggtggcatgcacctgtggttccagctacttgggaggctgaggtgggaggatcgcttgagcccaggagttcaaggctgcagtgagctgtgaccacaccactataccccagtgtgggtgacagagccagagtgagaccctgtctcaaaaaataataaaataaaatagaataataaaataaataaacttgtagtctttgatgcctatcctccctactctctaggttctaccaccagtcatgcatgcaacagttaaacacattccatttaattatgtttttttcttgtggacttgatataaagtattgagttgatgtgtgtatgtgatattgtctaaattaaatttactttgaggagtgatgtttttggtattttgaattcttttttttagttctgttactcaaaccaatgtttgtcagtttgtatttctgattatacacattgttttaatatagaaaagacacacatgtgtctgtagagccatgttttggggtgctttaaataattaaatagtgaagttctaggtgttagaatttggtagcttttaaggattctttattaaaaatgcaactagcagtatctgtatgaatctaggctatctccaaaagccttgcaaaagttgtgcaggaaactttatcacatcattagaacatggcaggggttactacgttttcaagtccaaatgaccagagtttctcattatttttgcttattctagaatttgcaggtatttttaattttggcagtgagcaaatcaagtgaacctatttttctaaataagtcgtatcatcagtcatgacagagcattccggtgaaataaccctctcgtcgtgggtgaagttcaggaccaccctttgggtctcagcagaatcatgagcctcagaacactcattgcaggcctgtttatctttcaaatttgtgcttgtccaaatattctgaagcggggcatgcagtctgtcaagaggaaaagatgagaggcattccagttcacacctagcacccaggtgcccagtgccagaagttcatgggaggaaaatagtgacagagatgattttcttagggtctgatatctgaataaacaacctcaactgaacacaatttacatcaattattttggcctccagaggcacttttgtcatgtggtggcagtttgttataaaggaacggttctcatagggcagaatcaccctcgtgggagtgatgtgggtgctttgtgatcggggtgctttggccgtgggtgtatggagtccaggcgcactatgcctgtggtgcacagtgcattccagcagactggagaattacgtcactacccacacagccttcaggtgccagctggagagctgtacaggtgaaaaactggtgtctaatatttgggcttagaaattcttttatgtacacagttttaatattgactcaggtttctgggaatgagtctgaagggtaaatctgggaagattgtattttgttgaatttttccaagagttacttgccatttcagaaaatctcttttgcagtgagaatgcatttgtgatgtttgagtgaccacctgccacagctgcttcagtttgcattaacagctgtgtgttagtggggattctccaggcagcccattgcttcactgttgtatttaattgggtactcaggcatcagcttgtaaatattgacgtccatattaatgctttataactcacttttcctttaattctgctttctattatagatagagcattgtattagaatttccctgcccaattgtgtatattatttgtgttaggttatccaagaattccgcgagagccattggccccagatgtccgcagtgttttggtccatattactgagatactagcctagtgtgtctggaaggcagcgccagctggtgaggaacgcacatggggcagagtttccaggtagctgtgtgggcaggtgctgtgtggcattgagctgtcctcgtttgctgaaaactgattctctcaggggcttgcctgggactccctaggatgtggtcctctatacttgctgccgtgaccaacatgaaatctcctgtcaccgtgcactctcttggggaaactgggggtgccagaagaccagccacacatttctgagaagaggtgagggtgagaggcaatcaggctggcaggcctcaggtggacattactgaattccttatgggcattgtgtagatgcatacattaaatcattctaccagtctgaattttcctggcctttgtccttttgtctgcgtgtgttactgatgagccatgccctgtaaaccggtgtggccccttccaaagcctgtgttttctcagtagggtaaagttactcgagatcctcaagtgtaagtgctgtttcttttttgtgtgctgcgtgtcaccctcctgggccctcacacctgccatccattcagtgccatgccagtcactccttcacccccagaatttgagagacgccatgtgttagcagctcctgtttcagcactgattggagtttctaagttttccagtatttgttgtccttctttcatttgttatttatattttgggcatttcagtgttttgtaagcatcttctccagcagcttatcaggggcatggtgagaatttaaaaaggaaagttactcaagggaaggaggttgaaattcatttcaatttaatttataataaccaaatctgttaatatgaaatccaggtgatagtctggcctctctttcgtagtgcttgtcctgggagatgggtggcattactgatggtgtgcccagcactcctaagtagggaggccccctgggagtccagttcatgttgctcaagttgttgaaatctggatttgagtgctgagttgaccattgcagccgtggtatgattctggtctctgcataaagtaaccaagctttgttttctggtgtgatacctttcctgtatttttattacagttcagcatatttagtttcttgttttaaaccaactcaagataagaaatttaactttttttccccctgaatatcaaagtgatactgtctgttacagaaaattctgaaaatatgggaaggtataaagaagaaatttcaaaattaccagtaatccagtcactcaaccagcacttttagtattttgattgtcttttaagaagaataattattgaagaagaatgggagcgtgttatatatttgtgactttgactttgtgacttcaaaggtggtttcatgcaggctactttttaaaaaaataattgaattcagttgttttgaaattctgcttttttggaaagatctgttatgtacatttcataaaaagcaacttcattgaccatgagtactggaattcagcatttaactgcagctgtagtcctggggatatgtataccttaactgattccatttgataaccatctcctgtgtcctggagtaaatggctgtaagtgcagagcagcgtctgagcctcatgaagggatcgtgtcggactgtgagaggaaggtttgtgcattcgtcctttacctttgcctttctgcatgtggccagtgatgtaaaaactggcagcagccatccttcttcctctctgtgtctcttcttcctctctgaacatgaatcaaacaggcatccatttcagaatctcaggggacactgccagctccccatcatgacttgtgtgtttagtttgtaggcgcaatatggaaattatggaagatgagcttcaaggttcagcagttaaccgtgggtctatttctgctctactttatgggttacactgaaatggatactcaacttatttctaagaaacatgcagttacacagctgtctcctgctttctggcttttattaaaatgcaaatagtcctcacttcaaagtagcataatcaaatcctgaaagaagtataactgatactttgcctcctctctagtatttccactatgttgtctggcctggctggcttttccgacccttctctgctaggcttgatcccaggctagtggaaagtgtggtgttcacagtgtgcagttttaccctgggtgtgcagtcacatgcacccccacatgacatgagctctggtggtgttaacagcacaaagtgttaaatataaatatgcgtggccaaagaatgtcaattattttggcagttaatagatttctctgcatttaccagtatgtatttaatgaagtgaagtcagtgcgtcggtctgtctttgttcttcacatgtctactcttttagtttaaaaagaatgtcatgaaagtgaagtagtttctcttctctcctaaacatccaatcacggagcgtgttcttggtgggcattcttcacgtgtacccagaatgccagaacacgacgtcatctaggtcttcattttagtgtgattagaagctaagtccctcagcattttttaatagaaactgatacccgatttaaacatcaccatctatcaaagcacaagagcccagctctgccaatgccccagcagtggccaactggtggggagtgaggacagaactgcacacttttgcagatcaaagggggctgttggattttactactctacacgtaactgatgaattgctaaagctcacctgtgcaccttaaatcctgttcaagcccgattctccgggtaggggggaattaaaacataagctccctaagctgctgctggatcatgtcatttcatgctcccttttggaaatgtgtcccagttcaaacaagcgaacactgtttgctcctcttgtcttgtgacttgtcccagataactggaggattatcctgtttgtggaccatgtgccacaactgaggggctttgatgttgcagagcccccgcctcttcttttgattacatgtgtttctgctaaagacagcttttttcagtgcttacaggggcatgaataagtggctcagtgtcctgtagctttttgtactttgtggtttctctcatcctgttacattaaccataacatggaaaggggcatgatcagaaggtacatgtcccaggaaagcaaactaactggggggccctgaaaccctccagcaggactcacagtgagcctgcaaacacactttatcgtgtgtgtctgagaaaaaccccactgcacctggccagcggaggccacctgcttctggcccttccttttcaggccacccccacctggagtggtagataggcctcttggcttgagtgctgtggccagccaggtgttcacaggtgcaggggagctgttctgggccagaaagactggcagacctcgcatggcccatcaggaagcctgtccacctcccagggaaatgaagcagatactgcagcattggttttcaagtgaggctttcagatatgttatctgttaagtaaactctgccattcaaaggtattactgaaacaaaagccagagagtgaaatgtgaaaacgttctcctctgtcctatggtgagccagcgaaaggtggcgatgtgcactaccagagggtccttcaccttgggtgtacagtgggctagttggagaatgttttcttgaggagctgatgttctcccaggctactctgctctaggcacaaaacctcactttggaatacttcacctgcaacagagcctgttttgtagctagtaaatactaggtgttacttaggaataaataattggcacccaaatcagtaggtaaatacatgactaagtgaggggagggtggtttggagttgttcccacctctgtgcttttattttatgacaaaacagcctcatcagtgatgttacaggacgtgcagccctgagagccccagagctcttttctgaccaggctatgtgatgggcatgtgcatgtataggtgtgtataatggggataaggattcttctgatactgtgccaagtgctagaacactagagttcattttagaatggctgtttttgggatggccacgtattgttcagggagattgcagttggaaaaagtgcagttggaagcacacctgacatggttgggggaaggtgcctacagcttcagccagcgcagccagctaagaatagctcctgtgctatgtgctgttaatctcggagacggttccttaccactagtccatggagtctagagttggccaaacagatataagtccgctgtgtcctcatttcacctcttcttttgttctacgcctttttctcttgtacttttgttcctctttctagtactaacgtctcctccacctgtttgttctggtgccgtgtgctcagcatgtctctccatgctcctctcttaccccctaaaaccccaagtggtgattccttccttccagcaaaatgtactcattcagtttccctctcctccctccctgttgtgtttctctaccattctttgataggtgatatgatgagccagaattgataggctcatgtgtatgtggttctgtctccatcagtcggtgtgattcttcatgtttagaaaggttccatttagaaccttctttagaaaaggttccatttctaaagaagctacagttccctaactgaagtttcctccttcgtaaaaatgaagtagtaggttaattatatgacgctataattaataataaagcctgtattctacttaatatgtctttcatcaaaaaggccacatgggaaatttttgacatttaaaaattatctctgaattcagtctttgtcagggttcagcaaatcacaatacagtgtttcgtatttactttcttttgtaacattatagaaataagagtatgaaatacataaggattctacatatagaagtcacagaaatcattctgtatattcagaagttaaacatccccaatttcatttgtgagcagttaaatttggggatactgtgaaaataaatttatatcaaattatattatttgattaacccagtggagatttaaaaatcttatatattgttttctccccttgctttgctgtcagctgttagttctgtgaggtcattgatgatgacagaattgctgtctaaatgacgtactgaagacacatccctgccttgtcttccattagaggtttggttctgagtcctgacgttgatactgctttattccagggtacctatttgaaaacaagggagttttcagttatatttgagacatagtgatattattgttttttgcttgaagccaagatgtaggtagcgattgcttccactttatttttactgtacttttatatagtaatttggacaggtgtcttcataaaggagatctttgacaagggaaaatagacccagacacccattaagacgtgttttctcccattttctccttccttgcaatataggtgggtttgatagaatagtattaggaaataccaaagaatctaccaaatgggtaaatgctacttaagtgtctgtacaggtcatttagatgagaggatttgagactatgcttgttataatttgagaattatacatgggtcaggaatgacatgagggctgaggttgaagcaatttgaaaaggagagataatcatgaaactctacttggatattaataatttttcccttgaatcacacacagtggcctgcgaggcctcattttggctcatcagtttttatatgggctgaaggcatttgtttggaagatgtaaatacccttgtgtttttaatagggaaaggttggatcaagtttgctcttaattctgatcaactgacagtctttgactcaacatgaagcacactgagataaagcggatcctggtttgctgatacagatctctcagaagaggagcttgagaagcgggccttgctgggatttcctctaatcgctgcattggattgattgataggattcaggttttgttatgaacttgggagagaagtgggaagacatccaataacacccaacatttcatttaatatttgaaagaaaaccatttctttttcttttttcttttttttttttttatacttttaagttctaggatacatgtgcagccttgttacataggtatacatgtgccatgttggtttgctgcacccatcaacccatcatttacgttaggtatttctcctaatgctatccctccccctgtcccccaccccatgacaggcccccgtgtgtgatgttccccaccctgtttccgtgtgttctcattgttcaattcccacctgtgagtgagaacatgcggtgtttggttgaaagaaaaccatccctacattgatgacataccagttttctcctgaacctggacattaattgttggcatgttggggaagtctgctcctgtgatgtatctcgtaggagcagtcagcagccagacctaacagtttgatgcaatcaagttcagggccagttggaacatcttgaaaaatctaagtaaaggtatctaaggtgggtagtaaatctctaaggaatttcctttgtattagtgatttgctgttttttaaaataaatctctttgacaccagcttcagataattttttttttttttttttttttttttttgagacggagtttcgctcttgttgcccaggctggagtgcagtggcgcgatctcgactcaccgcaacctccggctcctgggttcaagtgattctcctgcctcagcctcctgagtagctgggattacaggcatgcaccaccatgcccggctaattttgtattttttttagtagagacgaggtttctccatgttggtcaggctggtcttgaactcccaacctcgggtgatctgcccgcctcagcctcccaaagtgctgggattacaggcatgagccactgcgcccagcccagataattttttttttttaaagaaattgctgtgtggccttacttgcttgtcagtaaaagcaggcaccggcccccaatcattcactcagttatgacagacttccctcctaccacatgctttcagatgctttacccagaaaataggtctgagggtggtgactgtagacccccgggagaggtttccgtgatggtggtcacactgagttttcttgaatagaagggattatgcaaatatttgtgttttaaatctccctagatttttgctgtctagtgatttacatggctttaagaatttttgtcctgtttaaaggttcctttgtgaggatgtgcatatgatcttgtgtgatctcattttccctaagcctaggcttgaggacaggtggaatcttccactgatcttgcctgctttcttaagattttaccactgatttctcaggatattttaaaacatttcatatttgaaagcatgaaaataaaatgttttatttctttaagttataattcatgaagatggaatttatctgataggtcttacttgctttaaatctttgcctttggaaaaaaaattccaacttttaaacaaattcctaatagtagttgccctttaaatgacaagaatcatagttgggggttggggtgagagaaaatctttcatctcttttaaaggtatttaatcttttttaaaagtttccttactttttaattatcttcaaatatctgccataaagtatgtgtttacttgctctttataaacaagagcagcacttcattcctttcggtaaatgtcagaatgttgggttttgttttatttctcctcctcctccccgccctcctcttcttcctcctcctcttctcctttcttgttcttctttcttcttcttcttttttttttgtggggaataaaactatagtttgtttcagaggtggccaagcatagctcagctgagagatggagggacagctgctgcctgggcaccttggcttaaagtcaccctgaagggactgtgggtttttagagatcttttcatcttgtcagtcttccagcctggccacaagcttgccttagcagtctgcagcccgtgtgccatcttttgacaatgtcattgtcatgggatggatgctccctgtgatgtggcagataatgcattccagtgtgctacttgcagaaagtggtaacatctctgtgtactttttattcagaacctaagttgctagttagttgaacaccacagatgtatgagctgtcttcggcctaagagtgggcatgaaaattgtagcaaacccatagaggcttttaatttttttctaaaaagacctcacagcagtattattgatttggttttaaatagctattttatgaagtttcaggataattttttttttacctcaccttttagcctttattttgattttttaaaggggggtggttttcctttatcaatccctaaccattttatcttaagaactctttctgaagtcattctttatttcagccagaaaactgattagtgttcattgatagaagatgataggctgtacagttaaccatgaaaaatatttttctccttgacaccttaaagttgttgtcaaaagtattaccgcattcagttaaagagagtgggtagaattttattgtctgagcttatagtatacaagcaccaaagctcgatgaattcaggtcttttccaggaagtttaacttgcatttttttctcataagatattcacatttcttttccactcctaattttgtggcataaaataaaacataacttttgttctgggcacagtttcttattgctgaaggacttaggaaagagcatgtcaggagtaggaatggtccagctagtgaaactgaaaagaaaaaccctggagcactatttgttcctcttcagcgtctgtctgtgggccttcagctgctcttggggaagggccatgcttactcctgaagaattgcggcaacagtagaaggggcttctgtaagtaatgtacctctcagtgcaagctaatacattcctaagggcttatttggcttcacttcctaatttacagtgatcttgaccggctttctgccttgagaccctgagtgtcatgccgtggtggggaaggttggcacctcaggcacgtatgagatggtgtggagctccttagatgaaaggtgctcggtgtgggaaatacagtaatgtgagaaaccttccatccagctgtctgtccgtccatgctccatgcaagcaagttctcggcctcttgagcctgtgtctcccacaccgaaagttatatgtactgtcctgatgcaggagaagaacctaagttttctggggagaaaaaatgggcttttaagcaaggtgaaaaacaaaaaacactttctttccagttataccaaaagtgatgatataactaaaccaaactccctggaaaactagataccatcaaacttgaatgacagggtagataggaatgagcccagcccagactgtaggtgaaggaacatgttttccagcagctgcaatttagcatgcattaggttgtgaattctgcactttggtttctaggcaacttgcacacattttaaatctgaatataaacacatacacacccccaaaacagaatgaaacaataaaaagcctaatgatataaaccatgtttgccacaagtctcagtaactatagcaaacaaatccaggccactacctggctaagtagagatgttggtggttagacctaggaaataaagacaaagcagctataaataacttcttttgttgcacagtgataatgtctctacaacgcaagcacatcaggtgtgctctgcctccaaggtgccctgcaagagaaggcatctcctcaagggaacgagtcttgttaagggagatttcatttcttttcctgttcttttaattagtcttacattaagattcttagaagttgtacatcttcttattgctagcagcaagctcggtaagtccaggttacttctaggcggacaggtctgacccaaagggtgctcatcagtgcctccgttgccgccagtagggaggtgataggagcagttctggggtgtggcttaatatctgtactagaaattgggacttacggataacctcgatgagttcacagatgaggcgggcttaacataggattgccagtaaatttggcaatcgaaatgatcctgttataccaagcactgtttagattcatgtgccaaagtgaccagctctgggtttgaaagagggttattgtgggccttctggatggacagaagtcaaatggaacacatgtgagcatgtgttcaatgtctttaaatattgaatagcataatggtggagttaacatgggatcggcccatgctgttggagtctgcatcttgagcaagatggagcaattgagaatggtccaaagaaaagtagtattgtgggcatgagaaaaataagacctatgggaaaattttttaaaaactgaaattgttggccaggtgcggtggctcatgcctgtattcccagcactttgggaggctgaggcgggcagatcacttgagcccagcaatttgagacaagcctgggcaacatggtgaaatcccatctctacaaaaaaaaatactaaaaaatgatgcaagtgtgatggtgcacacctgtagttccagcaacttggaaggctgaggtgagaggatcaccggagccccaagaggtccaggctatagtaagctgtgttcacaccactgcactccaacctgggtgacagagtgagaccctgtctcaaaaacaaaaaataaaactggaccatagttttaaggaattcctatcctataattaaatacatttaacataagtaatatttctctcaaaagctttaagcaggctgtataaacagaaacaacttaggagcttgctaatttgtttatccctgctatagacatgtttcttcattcattcattcattcattcattcattcacctttcatgttaattttaagaaatctttaaaatagccactatcattatttattgtcaagaacaatgatttgtgatggcagactaagattgctgactttttatttagagtttgtaaaaacaggtttcaggatgttaaatttttatagttattgcatgattgatgtgtttccttttcccacagaactaaagcatgttaaagatgctatttgaatttaattctgggaacataataaaaatagcattggggcattgaggagctcagaggcacaggcctcatcagccctgctttaatacctgagcagcaagaggttacaggtggcttctcctccctcccaggggacctcagtaggtagaggagagaggaggcacacagtcaggggaccctgaggccagagccacaccaggggattctgctgccccagtcccttcccacaggcttgtttgtccattgacaggaacagttgcacgtacaaaatcaactttgctttcccatcctctgtaaaatgtagtgcccagcctctttattatgcattttattactcacatttagaattatattgctatcaggaatggtttcttgagaactggagcggaagaaaggctgtgtcccacgatatgtgatcctgctaataaagtggatgatcagacacaaagccaagttcatcttcccaccttggggccaccacagagccacgtggtaaccccctttttctgaaggaacggcattgaggcccaggccatgtgcatttccccctgggctgcctcctctgaccccaggattccagctcttcctcagaagttgtctccatctctgcgatgaaagaggagagcagggacctttctccctcccctcctctatgtctttctgaccaggtgcccccaggacgcctattgctgatgggcataggcattcccagttccctcctggcccaagctcctggaggtgggaccacacatgacagagcgacacccagcttgtcctctcttttgcaaagtgcaggatgagaattttgggttatcctggctcctcccatgttttttgcagctccagtgacagcaatgccaaatgatacccaaagataaaaatattgatccaagtgcagatgagctgaaaacattccttttctgatagaaaacacggtaaacagtctcccttcctcaaagattgtacctggaaagccatggctggttaattttttccctttagaatacataacattgtgaacttcagaaaataccataatcagggagttccatgacagagttaagtctccacactccaaaaaaaaaaaaagcaagtaatggctgttgatcgtgtggatatgtgaattgcaataaataacaggctctcacgttttaccagttctttttactacttagacattttgtcaggcttctcaaaccaaaaggctctgtgccattcaggaacttagccagttttcatgtatgtgagtgaaacatttggggccaaagaaagactcctttgtagcaagagtgacttgcgctttaatcagtgtaggaaatggccttatgagaagatggatttgtgctagaaaaattgagaataaggaaactattcagaaataagatttaaaaaaaaaaaatcatccttgtggtaatttgaaattgtgatattgccagattgagattgtatactgtgtactcagagtccttgggggtgtgtgtgtgtgtgtgtgtgtgtgtgtgtgtgtggagagggagagacactaaaaaagtacaataagccagtttgtgatctcaccatatgtgttgaattgaacacaactcttctgcacttaatgaagacttcagcctttaggggtaaataaaacatcactaaacagggatggcttgaatatttcttaccggctgtaataattaaagccatgaaaaaggtggtggggttatgttactcattaactggaatcgctcttagatttgatcaagacgcggtggcccctggcgctttgtttcatgtttgtcctttgtttcattgacacgctttgcctcggcctccgtggcgctataaaagcagcagagcagttaaagaaccggacccagaaggcccgtagacctcctatctagccgccttttctcccctccccccaaacccaacaaactcttcaaccttcagaactgagcctgaaatcatctataaagcagcacacttagggatctgggagggaacgggaagaaaccttcctcttttaaaaggaaactgatgaattcaagtgtagccaagagcttttaaaggatgtcattggccaggcgcggtggctcatgcctgtaatcccagcactttgggaggccgaggcgggcggatcacgaggtcaggagatcaagaccatcctggctaacagggtgaaaccccatctccactaaaaatgcaaaaaattagctgggcgtggtggcagacacctgtagtcccagctactcgggaggctgaggcaggagagtggcatgaacccaggaggcagagcttgcagtgagccgagattgcgccactgcactccagcctgggcaacggagcgagactctgtctcaaaaataaataaataaataaataaataaatacataaatacataaataaataaataaaaataaaggatgtcattgtccttaggtgttgcaccaaacaggctaagaagcaatgacattgattatgaggaacttggaactcagatgtattaatttcctattgtgtcttaacaaattactacaaatattgtggcttaaaacaaatttattatagtatctggaggtcagaagtccaacatcagccttcattagctaatgtcagggtgtccgcagcactttctttctgtaggctctaggagagaatctagttcctggccttgtctagcttttaggattgcctgtattccttggttcatggccccttcctccatctttaaagctagcatggtttggccaagtccttctcacactgctgtctttttggttctctctcttgcctgccttttctacttatatggacacttatgcttacgttgagcccacctgtataatccagggtaatctaatagttgattagcagccttaatccatctgtaattttaattcccttttgccaggtaatgtggccattatcctgcctacaacctcagaggatgttgataatgtaaagggtagtgaattggggagttcatagggtttgatagttgacaaatacagagtgtagtattaggtaggggttttttggcagggtgcagtggcccatacctgtaatgtcagcactttgggagatcaaggcaagaggatctctttagcccaggagttcgagatcggcctgggcaacaaactgagaccccccagccacctcatctacacaaaaataagaaaaggtgggaggtagttagtagttttgtagttttcttacagcttctcataactaccatcaggaaaatgtatatgtgcatatgtatctgtatatgtgcatatatatacagatatatacagatatatatatacatatatatctgtatatatgtacagatacatctgtatatgcacatatacagatatatgctattatagtagaaaaagtcatttgcatttcgcttaaatgaagtttctgttacactgtaatagctaacatgccaactgctgacataaagagaaattttcagtgtgacataaaactaatttatggttttagtttgaaggaaattggcatttctatttaaaagaatgattcagttatagttttattgacttgtgaataattgagttaatcgtttgctttgtcttgtgaaattttttattttataatttgtactaacataggaaaacttccagttaaaatgatactccagttttaacattgtaaacatccttttttgtgcacacatctgtataatttttaggtttgttttgttttgttttgtttttgagacaggatctcagtttgtcacccaggctggaatacaagtggcaagatgagggcacagtgcagccttaaccttccggactcaagcaatcctcccacctcagcctcccaagtagctgggactacaggcgcatgccaccatgcctggctaatttttgtatgttttgtagagacagagttttggcccagtctgatctcaaactcgtgggcccacatgatccaccagcctcagcaaaatttttacatagttgtaaccgctgtgtacatatggtgtattaagtggcttgaccttcctgtgttctctttccccagtcatctaagactgtgggtaacatgtgttcctgtctacaaggccattgcaaagtcaactgagataacacgtgcgaagttctctgggagaaaagcaccatctgcatttgcataaagcagagctgccgaggttaagctgtcaacagcttcctagggaaaatgtccctgaaacagataagacatttacctgtaatggttttctttgcctgtgaaattaatggtacaaggcttaaaaaaagtattatcttttaatttgtcttttaaagttgattctattttaacatattttcatcatttagttgctaagaatcactgctaatgggcacaaatggaaacttagatcctgctacaagaaggttacattaattcaaaactggctccgctggatgcaggtgggggtgggagtgaggggggattaaaagtaaagacatcccagacctgcaaggagctcagaaatgggagcatcatgcgcagcagcactccgataattctgttgtatggcagaatagcgtaacagcccacgtgaaaatgaatgagagtaaaacccatgaagcaaattctgcatctggaagggtaagattggtgaagggttcttgaaaaacgtgaccccttgaatagtgatttgagtagagggcattccaggcagagggctgagaaggctgcagaaaggtttgttgaagggctgaggagtggactgggactggaaatgagcatagtgacctgcacacatagggcatacatgtcactgtttcagtccccagccagagagaagtgcagggtgggagtcagggaacccacctggtggtaaggcagggctggtgtgcccctagggcctgcactagagaggcgctggcagtgggggaagggggagagtggagagcttacttggcacctgtagtttacatttgagggttacatttggtaggatcatgggttgcgtcagtccctctcggcacacatctcaggctgtgcagagttggtgttgaaggaacgtggggaagagggtggcccattttatattcatgctcagaaacaggggtctttagccagaaagggcgcgccaaggacggtgctgtttcctgacaccctggagagttgggcgtcacagcgcttgtgcccaaggtcacaaggtgagtagccaggcaggattagaccctggtccgggttactctccagccaacggcgcccctagcgtctgcgaaatcactgtgcttggaggaaaggacgacaggttttaaagagggagtgtcatcgcctgcagcgggcggacccgtgtcccggcagtgcagctccgcaggcgcaggagggatgcgggctggggacgccttggggcggctgcaggctggggcgcgcccctgcacccggcgggcctccgctgcgtccactgcggacaggggtcggtgagaggccccaggtccagcgcgacttgcttttgttaaaacctccttgtgttaggtgtgctcccagctttggagccaggcttttggacacgcctgagtttttctaaagccttcttgttccggtcttcccgcaccttccagtgcggtcaaggatgctggtggctgggtcctctccgcggagggctctgggtcgggacccttgcacccaccctggggccttggcttcagaaccagttactcgtgtcaaggattgctgtacagcagctgccctctcctaagggccaggtgttttcttttttttctatggatgattgtggtcctcgtgcttctaatttaaataggtcatgctttaagccttcacagaggtgctccagggacagatagatgtccatgtaacgtagctcccctaaccctcattaaacgaacttgaggccagttgagaggggagcagtaccagtagatttcaggcagcatcacgctgccggcccctgcggaatggagagtggtgttcggggatttgctttggaaatgccttgggaaggcgccgccacctccactttgaacaacggtaggaacgcagggtaggtgctcaggtggcacgagcactgctggccagcagaggactgcgctgggcctagaaaggaagctatgggttcccagatacgggttctttaaaaaaatgtcagtggactagggccactgattcaacttccgaaaagcaaaatggagattataaaaatggcgtgaacaaatagtgtcggaatcatttgataagttaaatctgtgatgttagtgagaactgcttatctgaaatggaaatactctcaagaccttttgtggcttatcccaaaggcttactctctaccttttagttgaaagcagaattgcaaatttgaccaacttaatcggcagtggctttttgcttttaaaagtacatgctaaaatgtttgtgtgagcgatgaggctgatagcgtaggtacctgaagtggagatttacttttgccaagaatgttttggtgtattttgtaaaacttctttatttctgtctctcattaaagaatgtttgttttttaaaggtagataagaatttttcaaactgacataatttttaagggaattatatttaattgtaatgttcttatgcatttgaaaacatgcataaagcttattagtgttcttaacatttaaaggggagtgttgtgtgctgtacacgaagagatcgacccagctaagaacgacttctagacctgggagtgtggggaacatagggaaggataagttttttgggagtgttacattttctctgaaggagttttctccctaggttctcagttgctcaccgtgtttatttcatctgcagaacaagtgtttgggagtcatttctatatttttacttcccagacacctgattttcttagttttaagtatgtaagaatgtcatcttacttcaggaaactaaagttgtaagttaaggtagacatattagcatttgaaagtactcactttaattgtttcttattctgcttgttttaacttaaaatctgttaattttcttgtttaaaaaaggattaacttttaaagtggttattacaatttaaattgtattcagctatttgtcatattaatatttagagaggcaaatttagttgccaaacatggcattttgtaagaaaataaggtactaagttttctatcacatgaacagtttaggattttcttgacttttagatggagatattttagctcacattttataaatgcatggaatgggactgaaagccatacttacctgaagtgttttaaaaatttaaatctgtttttgaaaaatatacagtttgaaagtggaagactctcagcctatttaatgcgaagtttttatagtggtggggttttaatattcctccattcagtagttcattgcctgattttttttaacctttcacgtaaactttgttcagtaattcttttaaatggatgcagattatttaaagatcaaatcagtattgtcaaagtataagaaggctttgtttttgatgttttatttttctaagcatgttttaattataatttttctcatctacaacattctaattacattttaaattagaatgaagagtttaacatgcagaacttgtgaatggactattacagttttctagggaaaactgccctgatcagttcccttcctgaggtgggtccctatcctgtggtttggggccacatctttctgtttttgattgaagtgcattctaggaatacctacctctcacttattctcaataaatcacattcctcttaatccttgttggagtttttgattttgttgttggggtcgattctggtgacttttatctactgagattgctgcaagattggaaatgagatgggtttcttgtttgccatgcaaatgttctggttgtttaggatgaagataccagtaattaaccattaaagctgtccttgcatacagaaaacttatctctggcattttgtttttttctgattttagtgtgaacagttagcgacctccaccagtgctgattaagaattgtataaattgtttattcttacagaaagctgccctgggtggtttgttgctcttttattcacatgatataagctataagaaaacagtcctctcacacctcagcatgttgctgatttccaccaggtggtccaggaacatttgttctgcaggagggaccaaacttaaaaatttatttatgtatttattggtaagtttttttttttttcagttgcagccggccaggtctgatgttttgccacagtaatactaatatccttgtgaaatggcatgtatgctatagttttaaactttttttcttaaataccatatgcaaagagagaaagtcctcacattgtgtaagtgagaggagaaattgctacagctatgactgcctttgttctcaaagccatttgaattgccggctgtgttggggctggtttgtaccttgttgaagtgctgagatgagaacttctcattagagtaattgcctaattgccgggtgggagcggcccatccggggcggggcggggtgaggcggggcctggggcgcaggggcggggcgaggtgccggcggccgagatactcacgggcgcgggacctggccgggagactgacagcaccgggaccgaccacggcccacccctccggccgcggcggccgggaccagaacagcgcaggctctccgcccacgcctgccctcggctcccagtccgcgctgccgccgcccaggtgacacgcagggacgggagcggggctgctatgtccctcgggcgcgctttgggacgttgctgagtggctactgcttgtgctttcttgcttccaagctggcggtaaaccttttaaattcagagtgattcaagggcataggcgtcggaattgtgatttcgtgcgtgttttatttaccaggccttcaaatcaaaaaggccaggcaaacacacgttctggggctatcaagaaagttcacacgaaggacaaatccagcagggagaaagtgacataccttgcgggctcaggcttgggatttctgcagccacgcgcgcgttcacccgacgggacctcgcctgcactgccgccgggagaagcctgctctagactccggctccaggggagagggctgggctccacagagaggagcagcctgtgagttttcaaacatttctctgtcagagttagctcttacttgttaaattccgagatgagaatctatactgtgaaatcagcagaaaagtggttcttagaaattttaaagtttgtttatccactttactttttgaggatctgtgctcactggtttttcaagctggtttgttttaaaggagtcaagcttcactttggagtaaaggtggagattatagttgctctgttggaactttgatatgttaaagggaaattctgtaaaaatgcgggatgcaagcagtagccacaggagcatttttaaaagtttttctttttcagcttaatttatataagaaaaacaattaaaagcctgtgtttcattttagcctctttttaaaagataaattcttatttctgcagataaatgggaatactgaggggagggacggaaagtatggttttctatagactattttccattaaaatttaaataatcagaaagctcagaaatgttattcctgtaacttcgggaagttataggaaatgttacattttaacatcaaagtaaaattccaataaaatactttttcttataggagcacattttacatatgtaaaggaagatacaaaaatactagaaattctaaaacttaaccatttttgcgaaatttttctaaacaaatttcctgaagtcttgcatacatttgagaatttagattattgctagaaagcacatcttaggttttaatcatgttcatgccaacgcctatgaaaagacctaccaggattttagatccatagttaaccaccacttgtgagtatccattttgcatttttgaagactcgttgattgactatcaagtacttgaaattatgtaagagaatacttttttggcagcaaagtcgcatttcagatcccctgctcccctatcaacttcaggctgctccaggctctgggtccaggctggaactcacagtagaactaagattatgtctaaactcatagcagtaaagtgacgttttgccataaaagaacatttttataacgctatttcagtctacttgtttccttggaaatagtttctgtcgtgatgggcagtatctaaattaatgaattattcagctatttgtgcaaaatgtgtaacttaagggcaaacagactcgatgttgttcgcatcacctctcacacattggcaaggcagccttttctgtcctatgtaatgtaggaaaattaaacatttcttgaaatctgagacttctgcccttgttctcctgaaattaaatccattttattttcagtagcatgaatttccttacatgtccaagaggctgttaaggaattaatcctttgctctattcctcataacacttttcacagttaatctagtgtgtaaactgtgtggacgagaatccaaaactgcagaatttggaggaaatgtgactcctatgccttgtagacattaaatcattctgtgaaataaaactgaaactttggataggagattgtacagtactctccacacatttttattaaatgaaaacaacttccattatttttccagcaatccttcatgtagttggactcacctcaccacctcccccctgctccttagttgtggtcggctctccttacaaatggacaggttgctttgtcaacttggtggcagaaaccacctgacaaattgtagacatgtggctaaaatttatgcttagtttggatttggtagaaaataaagaatattagaaaataaaatgtgaccaaaaaaatatttatgttgtcttgactgtgtgtctatgcacaagaaaggacaggaactgggagtaatggaatgttagtgtttccgactccagaataaatacccaagagtgaaaataatttataaattatgtttcctgcttcagaatttgctaagagtgtatgtgtgtgtccatacttgaatcacttgcctcacctgaggatcggagtggttgacttggtttctctgtccttctgttgctattctttttctcacttagcaactattatgttgttatctctaaaatgtttttgtggcttacttttttttttttttttttgagacggagtctcgctctgtcgcccaggctgaagtgcaatggcgtgatctcgactcactgcaacctccgcctcccaggttcgagtgattcttctgcctcagcctcccgagtagctgggactacaggtgcgcgccaccacacccagctaatttttgtatttttagtagagatggcgtttcaccatgttggccaggatggtctcgatctcttgaccttgtgatctatctgcctcggcctcccaaaatgttgggattacaggagtgagccactgtgcccagccatactttttttttttaactgtgagttttgattttaaaaaacccttaatcgttaatagtaagttttaacaaggagactatggaaggcaaagggagagatctttctaagacatacagttgagtttttgcacataaagcaaactagattgttataactcctcatacagcccatctatttgctttttaaaaaattgcagagctatcatttcattgattgcagtttgttataattaaagaggcattttcagtcattttaccattagctttttaaatatgaagaataattaaccagatctgtactgtaaagaatgtttatgaaactttttttttttttttgagacggagtctcactcttttgcccaggctggagtgcagtggcacaatcttggctcactgcaagctctgcctcccaggttcacgccattctcctgcctctgcctcccaagtagctgggactacaggcgcctgccaccacacccggctcattttttgtatttttagtagagacagggtttcactgtgttagccaggatggtcttgatctcctgacctcgtgatctgcccacctcggcctcccaaagtgctgggattacaggcgtgagccaccgtgcctggcctatgaaactttttaagttgataaatttgtattttttagatatgttctagttgaggaatgagaaccactcctggtctgaattttcatgtgttgctatataaatttgcttttaataaattcttttaaatcaccagattgttaattgacagctattcttgcagacattgttaccttattatttcttcttactatattgggcattaagtcgtttatttcaatgtgataaacatttgactatcaaggatgggggtagatagcacatgacatgagcaaaatctggttccagtatttaagacacagccttaaaaatgtatattccttttatagaagttaaaatatagttttctttgaactcggttattccttgtttaaactcaaaaggagaggatcctattttctgtacataaaattctgaagataggtattttctgtaagagctgagttttttccccatttgctaatcccttctaatttagaggaaaaaccatattatcacactgaatgttagtgatgattgcctatttgtccatatgaacacagtaattttgtgcatagtatagattactattcaccaggaatatagggctgtataaaaaacatttaaccaaagaagaatcgtgttgataaattattaactaaaattactaaatttgtaatgaataatcctacacagaccatctgattgtgatttttgacatattggagtaatataggaagttatagaaaggaagaaattctgggtttggatgaaattactggttttttcccttggaaaaaaaatctgaatatattttataatttgttagtattgtaagtaacagcctaaaaacctgagcatgtgactgtttgacactgtgcttcctatatatctgtttacagaatatttggaaaattttaaattcttccagttcttgattgctgcttgcacagaaccaatgttaaaatgttatgactaagactagagagacaatgataggtttctcggtgcacacttagtgctaggaggtcttcccatacctaccgggccagctttagagaaacccctggtttccagttgcctggttcagtactttgttagagcacatgctttaattattttcagtgttcttaggtttggttgtggtaatgaatttcttcataaagtagatctctcttttaagtgaattattaggaaatacttgtagcatgatttaagaaaaatatttcagcttcagctggaagcagaaaaatggacagaggggaagccagagagttcaggtaggttactcggagaaacagttgacacaaagcattccttattttcttattatgtatctttagaatgtaatttacacaaattgaaccatagtttacattttattctgaaccttttttctaaaaacatttcttgccatcttcctatattacaaaaataattccatctcattctttttaatagctacatagtattccattgcatggctacataccatataggatgttttgattcatatactcaaccaaccgtttttttacagtaaaggtatactcatatgctgggccttagggggttataagttaatgtataactagaattggagctagcaaatgtcactgtttgtaaattaggaactcagaattataaaatgtatactctccttcaagataaatacaacaagtatattacgtacactgttattaatttaggtaagagcattaattcatttttgttgttgttgttgttgttgttgttgttggatacagagtcttgctctgttgcccaggctgaagtctactggattaatcatagctcaccgcagcctccaactccagggctcagatgatcctcccacttcagcctcccaaatagctgggactacagatgcatatcaccacacctaattttgggggtgggtagggagcgaggtctcactgtgttgctcaggctggtctgaaactcctgagctcaagccattctcctgtctagacctcccagagtgctgggattacaggtgtgagctaccacttgtggcaaaagcattaattctaaggaaacaaaaagaaggaaatttttatgaaaatgtgaatacaagaaaagttaggaatattctgatactttaaagtattccaatttctttagaaatattcaggcatatattgaacatgccattgttgtcatggcagggtgaatagacagaatcacttaggaatttagtttctttttcatgagtgattattttcttgagaagcatagatcaggaatgttttccctttggccccttgtaattggtctggcaggatctggggttggggaggtggacacaaggatcccacacatctcttgtgaaatacttggaaattttcaatttgagtgtttatgatgcttccaacatatataataacataaaatattaatgtacacgtggttgtaagagatccagttgaccagaggattgcatgtttcatcatttaaataatatgctttgtgttagattgcatatagtgtatgcttttaacaagagttaggggaataatagcacgggaacatttgacacttacaatctggaaacatgagaattatttatgccagtaaattatttcagatagtatttgcgaatgatggtatgtgtctgttttaggttctgtggtgccacttttagaaactccacaagcaaaccatggctcaaagtttgtagtaatctttttgaactgtaactattagaatttcccaaaaatctaataaatatgcttttctttgtataaaatgagctatatgaatatttgctgctacttgaattttctttccaaaatttgtttatagacatactccctaaagatgtttgataatcagaaataactgattctgctagacaaatatgcaccaattgattgattttctttattttgaagaaaatttttttcctcttaattatttggtggcttcctttgctggcaaatccaattttatgccccacaaataatgtgaacagtagagacttctacttgtaagtttcggcaattctttaaaatatgttaagtttttgcttcaacatataaaggtttttcttttctgaattgtgttttcagcagcaattcaaaccaattgtatttttccattatacaaattactaatttagaataaatatatttcatttctgtcatgatatcctagtaggcaggctcttgggcagacacctgatatgtgtatgtattattaagttgtctacttttgtttcttagaaatgtttatcatttaaaaagtaacagatggaagaagaccatttattgaagactgtggcctggctagtgtgtgggcagtaaggggtgactgcacctgggttctgtggctctgaacgttttctgtttctttttggattatgaggagggagaactcttggttttgttttgaggaacttcattgattatatcttaattttgccttattggcaaaaagcaccatgtgaaaatttatgcagcgtatagattttcactgtgttttatttggttcagagccgagtctggaagatgacttagtttataagttctgtctcgtgtcctgtagccaagctttctgtctcctttaatgagggcactgtgtgattagaagctgtttcctcccattcctgtggactgaaggggcaacctgagggtctgctaaggtggtgggtgtgttttctgggaagagtgaaaggggatttgtcagcctttgggggaacttgataaaaatgaaagatattttatgtcagtgggatcacctttttaatccaaggggcaaaagaaaactggtttctattgtgcccctgcccgaaggccgcctgcatgtgactttcaaaggaccctgcttgtgttgaatttcagccagcaagtctccagcatacagaatttgagatttcccccacccccaccgtttcttctgtttttgttccatgtaaacagttccctgcgtagtaacatagacaaatatagcagagaatgcttttctggaagaagaatgctccctaagcattttttaaccatttttgggaagaattgatctttctgtgtgtttcagacagactggagagggggaggccgtggctgtaaattgaagtgacatcatatgtattgcccccattgatccgcttttagtctccagccaggataaaaggaaatggcatcagggaggaagcatgcttcatttaggcacagatcccagagtgataatggggtaataatagaactcatgccactgtcaatccgtggctgcattagtcccaggcttattctctgtctggggagccgcacagtgactttcttcgtgtgaggctgcagcgcaccagctgggccacgccgggaggtgccctcctttgctttcggaggggtgcaggcaatggggcttggatgttgccatttgctggtctcttgtcacaggccctgcctctgcaaggtcagtcatgggacatgtccgtggcattttctgatgtaggaggtgagctggcctgttctgcatcatgctaatggaagaaatggtggcggaacctcagttgcgtgggtggtcttctgggagcacagagtgagtgatgcccccgtgacagcagtaagaggcttctgcaagagtcaggggtttttcttagttgagctgcctctagtttaggagggtgggtttggaaaattcatattttctttccaggagcatgcataaaaactctcccaaaccattcaaagtcgtacagcttgcgtcgactctgaagttgggaaaaacatgcagtggacttttttctttgtacagttcttagtatttagcaactatgagatcttccatgtttagagtagaacacagacttctaaaatccttaacaagcagcatttgtacttgactgacctcgtttagcattttatttcttgtactcatttcagtaagtttcatagttctgtgaagttctcttgcaagtacccacatcactttggcaccttgtagtcctattttgtgtaaatttccgaggcagatgcattttaaaaataatgagctggtctctgtatggaaaaaataaccccatcatgaatttcttgtttatgcaaaggaaaggacttttgcattcctgtcactgttgaactgtgggtgtgagcactgttgggcccccagaaataaaggcaagttctttttatactgtctgaaggagctgctttcttaggtggtgatgcttggaggtaaggtcctttatttttcacgatcactctgtggtacgaccaaagccttatctctctcccgccagtgctgctgtattaaacacagctggcctttcagtcttaaattcagctgatcttaaaataaataaataaacgcagctggcctagaagtcatgtgaagtttgctttgatttccacgtgggtggaagtggagtggtccacatagcatgtcccactccccctgtgcccgccccgggctcctcgtaccacccggtgctgccttgagcacatctgctgatacgtggtctctttcatttgctttacaaacattttggtttattacatgaccactgctttttcatttgtagggtggctttacggggagcaaatgtttattttacaaagacaaatgtatggaagctgtttaaccacatttttgcttcaatatgctctttttaaggtctattatcttatcctttaaaaatgttgtaatgtgtactttgcgaatgaaagatgctttattagttttattgtctgtgtcccaaaataacgtttgttcactgattttttttccctacttttttcagaaactacatttccccccatgagttagaatagttacaactaaaagccaggtggccgcaggttgtttaccaagtgagagtcatttcaagtctattcagaagaatgggactcacagaaacctgggagcatgaagctggctctggcagcactgtggtcgggggccttgttttagggggagcagatacctgaggggagtgtccatccttgcttcttacctctctcaaattagagtcagtcagtgtgctccctcccttacttccatctcgcggtcttaagtcagggagtttagctttaaatattttcattgtgtaaaatttggagaggacaaaagcttccattgatccttttggttctgtttctgtgtagagttgctgagctttcagcttaaaagaaaactcagatatacaggtatgaatgcaggtatttttgtaggttcacatataggtaattgtttgattttaaactggagctgtatctattggttaaacctagttggggttaagttgaggaccaagctagttgtcttactcagggtttctttgctctgtgtgtctctttagtttagaccaaatcccaaatgagagttctaacagtaggcttctttgtaagcacaagcgtataatatggggagatgcttttctttctactctccccttccctgtaattctgcaatttggcagggctggttccttctgtatttagttagcaaacgaggccccacttctggcaaagggtgtttaggggctggtggtgccgagaatcacttctctgtgaggctgagcccattccccaaagcctgcctgcctttgtctggaggggccttgatgccaggcgcctgttgtcctcggactgtctgtcttgagaaatgctgctcaccagttttgagtgtttgtggggtagagcaggtccccatcctgttgtggcctggcctgggtacccctcgtggagctgctgtttgacagcagcacaacaaagggtagtagtgaggtgaagtggggagagcccacgactggggtgaaaaggaagacactgggaagagggctcaagggctggagggcattcagtcagtggccctgggagacgggttaggggtacttgaggccatgggttgaaggcccagcctcctgcaggaaagcacctctctcggaacatcacaggaggctgaagggtgagatgaactggaaggagaaggagggcagagggagaaagagaaccagtctcactgggctgcctgggcagaagtgctggatacccacatgcacccggcagtgttcatggtatgaatggtgaggaggcctaccagaggctgggcgcctgggtttggcctcttctgtaaaacagtagatttctttttaataccgtatggtggatgggtgattttgttacaagtagttatgtagtaatttgatatctttaaaacatgctgcaattacttgacttctcatgaaaagaaatggagtgttagtaattctttgggtccttgtcagtgctgattgtactgcagttttgctgaaggcgccttgtttctcctgagagaatagccacagcatgtctttcagatgaagcgatgtcatgaagtacagaatatacccaagaaccaagtgattgcattggtgtcttgtctcctttctttctgcctctgtctgtaggcaagtgggggctttcttagaacttagaagagtgaggtgagaaaacagatacctagtggaatggtgcggtgggtgtggtgtttgcagtgcttgctgtctgcccgttgccccccgcataccttttggaaaagtatatgtgtgtgtgaatgagtgagggggtaagggggtagggggtagggagggtcaggcagagtgcacacttgggggcagaaagatgaggagcagggagggaaaccagtactttttaaaaattgttttagaacaccagaaagtggcagttaaaatccaggtgttcttatgaatgtactgttgacttgatatcagcttccagacctgtaattgggattgacaggaatgatctgcacatacacagggatggagagaagctcagcagagagaaccatggaattcataggattaattttaaaatcttgattttagagtaaatatttttcacttcctacaaggcatatctcaaattgattcttcctccagtgcactacagggccgatctcacagggccaccaggcctggccctgctgttgcatagcgagtaacacggatgaagtcttacacatgcttctcttcatttcttgtatttcacatacattgtgttttatttttgtaccatgttaagactatctcctgtctttgcccttaacttgtaacaccacttttgaccattcctgtatgagaactcaggaatatgggtaactttgtgtgtctgtgtgtatagctgcacatatagttgtgtacagccttttgagctttttaatggattataagtatgattttcgtaatggagggaagacacagttctttcagtatgtgctctttatttctcagtgtgcagcaggtatatttgcagagcttatgtggtaaaaagactgaatgccgcatcttagttctgtgaaatttccaggtgtttgcctgtaattggatggctccttgaatctttgtctaggctaaattacattttctggtgtatgcgtgctgtaaaggaagagatccagtaaaccacgataatgttttattaagataagcacagttttgatctgctctaagtatagaactgaaatgattagtcatggaaaacggggccaaagcagaccccagaatgtagtgtctttgggaatacagacaatgtaggccctgaggaattacaaaagtcagccgaacagtctttccatgttgccaatatatgctgaaagcacccaggttaccctgggtatgtggtcttcagtctgaacatttgggtgttgtttctcatcaactgaatggcattttcataggctgtttggttttgtctttagcttcttccagaccagctggtcttgcttctggagcatctcttggagcagaagactctgagcccccgaactctgcaaagcctccagaggacataccacctccaggatcaggatgcagaggtaaccaggaacactctcggagtttaaccagcaggtccccactgttgttgaagaatggtgatcccattgcagtcccaaactattgaaaccaccatttctattagcaaaatctcatgtgtttgctgtatgagtgaagaactaagtgctttaatctgattatgcttatgcttctaatcagagtattttgaggtcttaagtttttccctcttcttaaatcataaagatggacataagtctcctaaaggaatgagtggaatgtttttgagttgtaaacttgggtgggtcattgtgcccactgacggtggtgccattctgttgcacattaaggaaacttggctcagatgtgtcagagcttcttggttgcattcagttagggcaggaaaggagccatgtgtaaagggaatgaaaactaaatctagcagctgtagttggaaaaggcaattggatgcttgcgagaaagcaatgtgatatagtccttaatatcttctaccttattgtgaggaatgcagtgtgaatcctaagacaaattccagggttttaaaaaaatacaaaatagtaaataatgtattcagacatcttaagtaaaaacaagagcttaaacagaaaacctcttttatataagactcccaaaatgcagaaagtaagtttggttttgaacattttaaaactgtgcagtctagtacagcagccattagccatgtgtggctgttaaacacttaaatgcagctattttgagttgagatgtgctgtaagtataaaatgcacaatgaatagtgaagacactggaatgaagaaagacaaaataacttaatgtgtcccaattgattatagtgttagtgatatttgggatatattaggttaaatattattgtaatgaattttataatcattaaaatggagtaattgagaaaagcccgttccttattaaccaaaaggtaagatggccattgttaggcattttaaagccccataaactcaacagtgattgaaaaactccagaggggacatgtagctttttacccacctgagcatagaccaaatttacaactgttgctgtttatttcagctcttatatttttgtatgtaggagttctcaaatgccagactgttatttttaattagtgtttaaaagactttgctatatatagtcattaggctgtgttttaatcagggtggagtaccaccaaacctccaggaccctgtgatgggcatggacagaccagaggggaggatcagagcaggcaccgggcacctgtcacttgatgtccggaaaccatgaggtggcccccttccgtttagcataaaacatgtcctgttcttgcagctcaacttagttgttatatataacctcttagaacctttgagaagaacggctgtgggtgctaaggccagtgttgaattaggtggctggttcagaaacacctgcccaggctaacggggcagatctctagtacagcgcaggggtgcttgggacctggtgggggcagatttctttaccttctgtgcccctatatttttgagataacgcagaaaggcttcccttgctctacatgtgaccgagatgcatatgtaaagctgcctttccagaagggtaagcttgctgcctccagctgttcctgctcctcatggcaaagtgcactgaggagttttgttggctgagcagcgtgttcgggatgtagcggctgcaagtgagaagcctattccatggttgctttagctcctgggctgccatcccggtctgtccctccctcttttcatgtggatgggccggtacaggcccacccacacagagaaggaagaaaggagggacgagattactattaaccattctttctatgtgtggtgcttctgtgtatgggctgtgttcacagagcatctgatctgttggtctgattttctgagtgtagcactgagtctgctgcggctgcttgccaagggcttgaatgtcgaggggttgtggggccagggttctgaatactatctcaggttatgcacaccctgcctgccctccatgtgcctgcatcacgtgatgtgaagacccaggtgtatgctcttcatggaggcaatgcccccgtgttcagaatgtgaaaggaaaagtgctcaaggacagacagagttgagagcatgggtggagtaggcaaaccatcccaggctacctcctgccttgccacccctctgcagggcgggcacaggctgcgctccttgatgctccttggcctggagagtgaagctgacctcaaagtcagccatcttgtatgtagcaggcctcaggactatgggcgggtgctgggccactgcagccagcacggaaaatgagccgaagggaaatccgttccacagaagcaccttgtctttctgcagtttttgagtatatttctcaaatagccataaaagtttaaaaaatatatttgacagctaactctgggaacaaaacatgttatctaagatccctttttaagtaacacatttcctgcctgccttagcaggtctcttaagctgtaaaaatagctacccatggcagtgagatgaggatccctggaccttgcctttctgacctctttcccccaggaagtccatgactgaccttcaggcagcagcatctctgcaggctccactgagcgctttcagatctccgcagactccactgagcgcttttagatctccgcagactccactgagcgctttcagatctctgcagactccactgagcgctttcagactggggccatgcctcaggggatgggctccccctgtgttgttttgctggtggccacgaatccgaaaggcccatgctgcagcgtgccctgctttgagtttggttgatatgcttaataagaacattagttttctgggagaatttggtagcacccgttcttcccttcactgtgtgggggaaatagtgttgattgaaaggaagaggactccgagattggattggagcaagaaagtgtgggtatcgtgtgttgtgactgtgtcttctccggggtgctgcttcactggaggtctcccttcagggtctggccctcatgcctggccccaggtgctcgtgtgcacgtgagcggctcttcctgctgactgactacagctaattgacaaaaggcagtttcaaaaaaaaaaaaaatctcaacttagtaaggtgtcagcacagaggggagtagctagaaaaagcttgctaacaacatttagaggccaccctaagacagctatactctcccaaagtgccaaagaatgtaaccttgggaggctccactctttcatgtagaattgcaaactaaactagtaggagcaagtgaatgtgaggaaacagattgtaagggcatacctgtttcagcactcatccggctgccttccaggatagaaaggaaactccaggttgattggaaatggaaaaaacgaccagcgtcacaggcctgtcccgtagcacgggcagtagctgaagaggccctgcagaccctgtgtaatgggtctaggtctcctctacctcttttttgtttgtatgtttgagacggagtctcgctgtgtctcccaggctggagtgcagtggcacgatcttggctcactgcaacctccaactcccaggttcaagcagttctgcctcagcctcccgagtagctggattacaggtgcccaccaccacgcccagccaattttttgtattttaatagagacggggtttcaccatcttggccaggctgttctcgaactcctgacctcatgatccacctgccttggcttcccaaagtgctgggattacaggcgtgagccaccgcgcctggcctcgtctacctcttttgatgcatcgtacacaagccattggtcagggggcgggtccacaagctggtatttatcttaatatgctgttactaatacattgtttacttgggaagaaagcaccatagcatttatttgcagtccaaaggtggaagttgtgagtccagcaacacaatcatgtgacagctttaatgctcatttatgaatttcatttgggccaaaagcatagttctgtgactcaagcacttaatgattaatagaactctagaggaacttaccaaaggggcaaagaatgaaggtttgatggttgttacatctccagattctaaaattgatccatagttgtggttctgttcgttcctttcagtgctagaactctttccattagagatgactttcgtcttctgctttggagggcttggagatgtgaaatgttcaggagggtcttttccctgctgttggagcttctttttcttccctggttgctttttcatagtattctggctacaaataagtaagacatttctattttgttttgttacagagtggcttagaggaaaggttagatataatctctttgggctctgttgctgtttcaggatgctcgatgctttagatttattaatatgtagtgtgctgaacttagaagtccttcctcttgtctgccttgatccagagtctaagcgtaataaaggcagaaactctggctatgctgacgtcaggtcctgtcatcgtggtgtgtgagggcagcacccagctctgcctctcccaccacggtgctggcaccagggcctctgccccgtaggacaccgaggcttatgaataggagcagtgccggccaaggcgccggcaccatcttggtgatgtccagggggcccacccaggcccccttttcctctcctccccttctcctgctggctgcccttggtgcaggcgaatccagggcctcattactaagccagctggctcaccacgtcatcatccagcattgtcaggagacaccattgtggaacagagccctacaaggcaggttttcagattgaacatgaaaaagaacaccattgtggagtgtcagagtagtgtgtgcaattagtgaaatgcttttatagggtaaaatacaaggaaccaggtccccccgggatcccaaaagggcaagttgacacttgccacctccacctggcaacccacagaagctcagcattaggccgtttctcacagtatgattgcaggtacaggggtctggcttactggcccattgatgccatcaaccttaggttacagatcaagaggccagataccgatgagtctgaactttagaacatggcctgtgaatagtgtgacttcaggtttttagaaagctgagaccatgcttgtgagggtcatggctgtccctttgacagagcattattccttttctagagtttaaaaggtgggtatagattgaaaaaagggattggggtaattgtctttagttactttagacatatctttttacaccatctgctttttatgataggagaaagaatagagttctctggttttatttgtgcattttttctttgtcttatttggtttatgaaacatttaatcgatgtttcagaacattctttcaaagtcaggacggtctgtctctcagtacatccttcttagggttttctttctgttattcaattcagtgcctctggaactttcctgtggaaagcctgcaacagcatctcccctgttatactgtgataaagggattttttttttaaaaagctgatctaaaatcacaaagaactttcttttttagataaataatttcctgtgttgttcctgaagattgtgttttgtttactgtgaatttatagcaaatgaaagtaaagaagaagcaagccatggacagcataatctggctaatttttcttaaatggtcagcttagcatttatctgtttaaagagagagggcatttaataggtggcttttagctacaggttcagccagactttattagaaaagccactggttgcagagtgtccctgccgtctgctgtttgcacagggttcagcagtgggcccactgttaccgacctctgaagatgtgagggcctctgtgtttgctccatagggcgctctccagtctgtatagattttctcagaaagatggagatggagatttacacattctctggggtctaaatagcagtgccctgatgctcttcttccggtatagccaggaaaccagcagcatctcatattcattgtgtgtccaaaggcttctcgagtggaattaatgcattggactttaattggtgcttctgggttctttacagctcagtcagtagtttacatacttttgtattggatttctgttctgaaatccacaccagaaaccacacaactttctttgaacattgccgtctctttttacaattgtaaacttagccatattcccatttaaagtataccttaaatgccctgaaatacagggctcactctgccacagctctcaacatagctttccaggtggcttttctgccttctggtggctttcatgtacaccatctttgctctctagaactgtggcacaccaggatgtgagaggtggatctgtctggacttcaggctgtgagaacctcacagcacagataggatgtgagctttaccccttgtgttcaggccgctcgcacggagtcagcttgcggaagcacgttcccaggcctgctctgcgtgtaatggtggaattttgtgtggatggcagggtatgatatttagaacataaacacagtagagattggctaaactttgtggggtggcactaaaaatgatttttaggctgttcagtctctgcatattgctttgctgcaaccttgaaccacatggaactgtgttctgtagaccacctggttttgcccatccatgggtggaagcaaatgcccaggctgggcacaggaagttcccaggcactgagggaaccagccagcgcaaagctgacttcatggcctcggctctcagggcaccaggtagtttttctcgagagtagactgtgtagaatagtacccttcgctgaaacagcctttctcaacttggttcttagggtgaggggtaactgtttttagtaacttttttgagctataattcacataccatgaagtgcacccattttaaagtatacaattcagtagtttttaatatattcacagagttgtacaaccatcaccacaatcacttgtagaacattttgtcatccccaaaagaaacccagtaccctttggctgtcatccctagctccccagtcctaggcaagcactcatttttctgtctctatagatttgcctattctgggccttcacataaatggaattatatataatatttggtcttttgtgactgacttcttttgacttagcataatgttttcggggatcatccttctttgtagcatatatcattacttcattcctttttattgccaaatattttgagtcatatggatggatggcatttgttgatccacacatcagctgatggacagttagggtgtttccacttttaactattgtgaataatgctgctaggaacatatgtgtgtacggttttgtgtggacatatgctttcatttctcttaggtatattcctaggagtagaattgctggattataacccttgtttaaccttttgaggaactgccagtgtgttttctgctgtggctaaaccatcttacattttctctagcagtgagtatgggttcggcctccaccagcacttgttgtccgtcttttttattttagccatcctgttggatgtgacttggtaccccactgtcgtcgtcattcctttttttcacgtattgactaatggtgttgagcatcttttcatgtgcatattgaccatttgcatatcttctttggagaaagggctagttaaaccttttgctcatttttaaattggtttgtctttgtattactgagttataatagttctttatatagtctagatacgagttccttctcaaatacagtttgcaaaaatatactcttatatgatggtatcccttgaggtataaaaattttcactttaatgaagtccagtgtatctcctttgttttgttgaaaatcattgccagggtcatgaagatttatgcctgtgtctttcctaaaagttgtatagttttagttctttagtctctggggtttatttttaaaagcctgtttctctagctcttgaacagaagggtatcagaagaaatagccactgagaagagaagggggagggaaggctgagtttctttcatggagtaaaacgtgatatggctagaaattggcggggctcaggatgccccctttgagtggtgggtttcttttccttttttaggcctcagtgtgcgtggcccttctcaaggagctttctatgactgcgctcctgccacagccctgttcactccctgttgcctcatgcaccctttcgtggcttttgttaccaacacgagtctacacttgctggtttactggatttttcttaaacttcctactgaactgtaagctcctagaggacaagtgcttatctattttagtcaccattttatcctcaatgcccaatcgacttacttgctggagaatgatgttacccggatttcatgtctgacacagcaaggtgatgggagagagtcagccatccctcagacttggggaggtcctccaggctgaattcacctccagggaaagtgagggaaggggacgagtgtctgcagggcttattagaggaggtaacgatggtcactgtttctgccagcagtaaaagtccctttcagcaaaggctgtgagttacatgtcaataaattgaagaaagaaggtagggtgtattattttctaatttcagaattacatattgagatggatagccattcaatgagagtcttagtatggaaggaaggcaaactgtgccatatttcaaagtgaaccccacatgggctcccacgttgtactttttggagcctttaatagcaccagtgttattaaataaaagagcctatttggaggaaaataagaagcattccaggttttcaaaagtagttaagatttgtctaagaccacacaggtgaagcaaggttgcctcttttatcatacttgacgtttgtatttgacatcaatatttgatgtttgtcatcacacttgaccctcaccatgatctccatgtgcatgtcgagtgtgatggccctggtagcagttgagcagcacattgctgctgctttagctctaaccagttaaggtgtagacaagagctgtaggaattgactccagcaagggtggtaagagcctccagtgcttcatttgtcctcttaaccctgtgcctaggaatttactaacctggctttgcggtagcaaataaagtaacttttaatttcctttagtttaaaaaataacattcagattgcagcccttcagaaataaggagcagaaaaggtgagagagaaaagaaaagaatgaaaacacaaatgtggacagccctgatgtgatcaccacacagtgaaaggttcttttcctctttccatgggactgagcaggtagacggcctccacctgtccagaagcccctggggcagtcccccactggaatgccgtttgccctgtggctactctgcagaggccccccttaccagccagtcagcccactgtaaagtcaagttaaatctaatttaaggacacaaattgacaaagcaggtttgtttattgcagggtagacttattaacttagaagagccatgagccctggtctttctgtttacagaaataaaatggaactctaaatgaggtttaatgggcttcccagatcatgttccctggacagattttttttttccttcttcaacagtaaatttgaaaatcaaaaggactaaaaataaaggggagtgcttcctgttataaataggactggtggcattcttcaaagcattttatagcctctaactgtgcattataatttcagagtggctgaaaagcattccaagttttcaagtggtacgtttactcagaagcatttatcaagcatgtactatgtgctgggcattgcgacaggcccaaagatggcccagaggcccatgcatgccccagacttgcatgatgctgtaaataaatacatcagactagcggagaaggacacggcagtgcagagagcagtgggagctggaaaggctgcaagcccaactctgagagtggccggtgggggcacactgggagctgatctctgggctgcagaggtgaactaggagatgtggacgcgtcagatcactcaagtgaacctgggtctgctggatgagctgtggccacagcaatgccatctagtgtcacagcagatttccttgtaccctctgtctgctggctccagcatagctttcttgttaaaaggctaaaggctactaggacacacttgagactttgtagtgtcatcagaagacggaaagacagtgagctgtagtatattaacagaagggcaccatgccagtaaatgcaacagtggcaggcagggagaaggaaaaacccaaagtaatatacaggtcaagtcttccttatccaagatgcttgagaccagaaatgtttcagatttcagatttttttcagttattaggatatttgtattatacttaactggttgtttcccaaatctgaaaacccaaactctgaaatgcttcaaaatcccaaactttttgagtgctgacatgaccctccccccgccccacacacacacacaaaaaaatgctcactggagcatttcagatttcggatttttgaatttgggatgctgaatatatatctgtatcaattgttgctgttggaaacatcaaaagtgaatttgacatgaatggctagaatttcatgtacattgggttccgtatttatgtatagtcatctgcttataatttttaaatgtttaaaaataaagcaaggaaagcagctaccaaaaggagccatacgtgcttttctaagcatggtgacgagcatgcaccaaactgaatcctggctccaggattgccgtggaagagacaatgaggccattcctgtctttggtcttgatggtttttggtggtggcaccgcagctcttggaaccaagttgggtatactggctgagttcttaagagctcatctgctctgtctcgtgcctgtagccatgtctgctcaggcccttgtgaatgatgtttatttttcaggcagagtaatttttctgtaagacactggttttcagactctgtctccagtattggggtactctaaagacacagtgcccctttttaatgagtctgattcaagatgaatgccagaccatgtttccttgtacagaggaatttgacctgcagagggaagaataaggcccagggtgtcaggactagcattaaggagcacctctgattttctggtggagtcgtgctaaagctggcccaaacccactcgggccgttgttcaccttttgcctcatctctgtgttcagtgacatcatgttggtggatgttgggggatgaacaccagtacaccactgtgtatgttgtgctctgggagccatagcttgggcacccattctagagcaaggatcagccaaccccagcctgagcctgtgcagcccattgcctgttcttgtaaataacgttttatccaaaggcagccatgccatgcccacgtatttacatgttgtctaaggctgctttgaccaaaaggccaaaagtgctcaatatctggctcttgaaggaaaaaatttgccagcctctcttctggagtttaccaggaatctggttctggacacatgaagatatcttgggttaaaaagagattaggggccaggcttatgtttgtaatcccagcactttgggaggctgaggcgggatcacttgagcccaggagtttttgtattttttatagagacagggtcccactcttatccaggcatagtggcatgcacctgtagtcccagctactggggaggctgaggtgggaggatcacttgatcccaggatttggaagctgcagtgtgccatgatcatgccattgcactccagactgagcgacagagtgagactctgtcttaaaaaatattattttaaaaaagagattagagtggttcaagttgtgaggaagcttcagcagctttcctatttccaagaaaaaaagcaatcaaataagggtgaggcccctttaccatatcctagttaaaattattgttatatcatagacatgcccgttgtcacgggacctgtgtcccaaatccaagatgtggtttctaaatggcccttctaggcatgtgccatttttctagcattgcaggaagtcagaagagcaggcttccccctccactgtgtttctgagccttccagagttcagctccatggaacctcttgggtagtgtgtgataagtttcctgtaaaggcagaagtggagtctggctggggctgaggctggggcaaggctaagggagccatctttacaaatggtttgcaggattcccaggtgcctgtccctgggtctccctcccaggagatggcctgaaaagctgtagctcttcccaggcccttactactcctgggactcccctgctccctctgctgtcctgctgcgagtctctgacctggcccaggctcttgctcagccatgtggttcctacctcctacctcatgccagcccagcctgtctgtggccctccctgcatgttgacgctcttctaacccccatcttggggagctggagctggagtggggcctggttagagcagcttgcctgagccgacgagggtccagcctggagcatcaggctctggaagccgagcttgtatgtaggttttcacactgtccgggagtcaagacacagtgggttatgaaatccatctagtaggtcaccagtcagcattttaaaaaaagaaagaagaggccggcgcggtggctcccgcctgtaatcccagcaggccgggcgcgggggctcccgcctgtaatcccagaaggctgggcgcagtggctcacacctgtaatcccagcaggccgggcgcggtggctcacacctgtaatgccaccactttgggaggctgaggtgggtggaccatttgaggtcaggagttcaagaccagcctggccaacatggtgaaaccccatctctactaaaaatacaaaaaaattagccaggcgtggtggcacatgtctgtgttgccagctacttgggaggctgaggcaggagaatcgcttgaacctgggaggcagaggttgcagtgagccgagatcgcgtcactgtactccagcctggcaacaaagtgagactcggtctcaaaaaacaaaaaacaaagaataaaaataccagactgcattgcgtgtagtgaaggaaagtgttgggaaataacactttgatttcagtgtgtgtctatatgttctacatatacacatttgtggatacgtatgcacacatagatatgcatacgtgtttgtactgaccatcactctgccccgcaccatttcccagtgcctgtcatgcagttggctgccatgaatgtgcttggaatcagtgagccccatcctcatagccagtgcctgtgtgtgtgcttccttccacgtgctttttggatacccaggttgcatgtctgcttgggcctcctaggtggctcaggcctgtaccacagacataccccgtcctccctgtggcagtctgtcagtggggtagggtccacaatcctggaaccattacttggattccttgaggattttaattctctactgccagatatgtgtctgatgtgaattggcttccacatacctgcccttcattcttcccaccctagattccaagaccctcccacctgcacccagcctcaaagaagcagttgtgtggagcactcttaggagaagctgaaatctttgctgtcattaccctgtattcatggaggctttggaaacccggaaagtgctgaatccctttccaacagtataaattgcgcctctgtgttaccccgacctgtacgctaagtgagggcagcactgtcattgtttctgttgagcatgtcccgtaagcagaacactttgaacagcagatgtccaaagtaatttttattggactaaagcattcaagggtgcacacctgtgtgttgtgcaaaagtcaacttcactgtgatgacatggaaaggatccagagacccagatgccacttcttcttgcgagagctgtgctgatttatttcatatgtgagctctcgcccacttccggcaggtcaggaggccagccaggcccaggccgcacctgctcttccccctcccaggccacctgcttgtctgctgcccagcgtcagcaccggcagcggcagagggaagagatgagcacatccttgataggtgaggtgttgggtgcttgagaggctggatccagggcagaggtgtgggtgctgcaggtgtccaggaccctgtgctcactgccacgggcagctctgttctcacttctccgtgccctgtccctgtttcccttctgccgtcttgttctttctctacttgcccagtctccttccctcccacaccaacttcatcattttcctccctcgcccctttggtcatggtctgcggtctgggtctgtgtagggctgaaatacatgctgactctaggctctcaggtgattcctggcatagatttggagtgacttgatgaattttaatcacagttttaaaggtcattaaatttttcaactatattgacaatagaaatataataaaatgtgaatatttgaagtgtaccatttgattacttttggcatatgtacccatgaaacattaaacatcaatgaagagaactgagaagccagataactgtatgcaattaagaaatacaagcaaaaccgccatgaacaaagtcagacagattgacaaacctggaaaaagctgcagtttcatcaaagatgagctaattttcctagtactcaaaaacactcaacagattaactagaaaaagccagtgatccaataggaaaaacatggtaaagaatatgaatagacagttactagaaaggattttatgcacatgaaaaaaatgctcggacatggtggctcacacctataatcccaacactttcggaagcttaaggtgggaagatggcttgagcccaggagtttgagaccagcctgggcaacaataagagaccccatttctgcaaaaagtaattaaaaaaaaattagctgggtgtggtggtacattcctgtagtcctagctacttgagaggctgaggccagaggatcgcttgagcctgggaggtggagtctgtggtgagccactgcaatctggatgaccgaacgacaccctgcctcaaacaaacaaacaaacaaaagaaagcagccatactcaactggtaatagaatgcctaagctgccccgatggggatgggggctctcccgctcctgcaggctggcagcccctcccagggctctagctctctctgttccagaaatagcctcacacctcttcaggccagtgggtagctaccgcttccatggtctctggtacttcaccgtacctggctggtgtccataatactgtccccacctttctaattagtcccttcctcaagttctctcttaattaaaaactaaaggacctcatggacaccatttttcacttatcaaaagtttggtaattcagtggtggtgatggtacaggaaggtggggtctcacgtcgattttggcaggagtgtacattgctacaccctcatggaaggcaatttagcagcctctcaaagtgaagatgtacacactgatctggacaccccacatctaggaagttgcacacagatacctcagggcaccggatgacccacaccttgtgtttcattgcatcagaggttgttttcagtctttactgttaggatgtaaacttgtgtctatctgtcagggtctcgctaatcttagcattatttgtagtatcatagactaccctgcaaccattaatacaaggaatggggaatctcttcctgcactcatgggaatcgtaagtcaagatatcctattaaataatcaatgtaattatataaagtaaatatatatccttatcagggtacagaggaatgcaatccatgaagttatctttgttaggaggaaaaggaaaaatacattgtgtgtgtgtaaaacacactggcccagtggccacctgcacagtagggactgaaggcagtctctgggcatagggatgaggggaagaccttaccgtattttgtatattaatctagaaaaaaggattctaaaaagctgagaaatagaaattgacttgttttggggtgtgattcatttgctgatcagtctccatttgattgggtctaaaatgaaacagttacatttttctcccatccctatccccagctggactttgtccagtctcctagggagccaagcccttatcataatttcagatttaaagttcagatctccagtgcaggtaccttgtggctggggaagggtctgatcaggttcttctcctgccaccttccaggcctggggaggagagggggaggggacactatctcttggtaggtccctctgaccctcacagctgctcccctgcagacggccctctgtgtcctttgtggcaggcagccacagctggctgtccccaggagcccaggttatgtgtttctcctgccagcatctgctttcctaggcacgggacagcacagtgctgtggctctgggggagcctgggccagcctccagcactgccccggctcccagacagggtgggagcagaaaggcagccaggaagtgtggctttcacctctgaaaagcaaactccttcctaatcgtgcagagaagacaactgcccgggtccacagggaggccggtcgccccgccaggatgctgcggggtggctggcgaccagaagagacagtgaggagtgcccactggtgccaggcaccgtcctgggagcatgcgctgtccctgtttatttttattctgactgaggaaattacagaaagacacgttgaccaccctcgttaataaattaagaaataagagcagacctctagactggacagctgtcctctggtggcatgctgtggaactctgtggccccacctctctggcccgtagggcttccctgctttctcagctgcggaggaacttgatgcaggagggcagagcatctttcacgaccttgaagcccctcggtggtctggagacagatattctgtcagggctcctttggaaatactgctgggcttaagtgagactgatgtcatccccactccctgtggtgacgaatggcatgcgaattgtgggtccttgagagtttgggggataaaaataaggattttctttgtttctcaaaggaacgaagaaaagtgaagactgcgcgtgagcaggaactatctggcctgcccagcctcccgcagcatttctgtgatgtcttctcagcatcctgtcgccgaaatattgacatacacttagctctttataatgaaaagacttgtttttatcttctcttgatggggtgggaaagggagtgggggtgggagactgggcttggtctgtccttcctggatgctgttagcctccaggggtcagaagcctgggtctcttattaatcttgacagtaaactatttctaacagtaagaaacgtggaaatactgacttcagatccgtggtgaaagagcctcttccacccgccatctggacctgcaccagctgtgggctgccgctgcctccggccgccaccgagggccttgttctactaggaaataagccccagtttatgcttcgttgtttctgtgtgtgtaaataagatgaaggaaagcacagaaagaaaaggagaggcgaaaccctccattctcacaatcaaatctaaattgtataatgtcctccaagttttagagtgacagcagtcattgccaaaagtgtggtgtggtcagatcagacaagcgttggttgttagaacactttaaagaacacttagaaaccgacaggtctcacgcacgggaccctccctaaaagctggcacacgtagggtttcttttgtgcagttaagaaaataggctctttccctaagtctcagagcagcagctcctgtccccagctgtcgctcccatccatatgtggccatctcgccagaccacaccagcttgcctgcaaggcccttcagccttggggagctggtgcccatcttcacaaagctcgcagcagatgacacctctgctggtgtgtggacctggcagtttggtggcacatttaggtggctgtgagttggaagagagatgagggacggaggcgtccagcgggcagtttgggttctccacagctgggcgcagtttcttctagcggcttcctctggcatgggatggtgagctaacttctttgagctctggtcacttgttctttctgttggggaggtggagggactctttcttgtatagtgtgtcgttaatttctgttggctgtacaggaaagcacattttgttgaaggtggaaagattttgccgtcccagcctccttcccttttgctctgagggcagaggctatcagcccctcccagaggcatgccacttcagcacttcaaagggcctggctgcctgcgagcccagggccgcccagtggaattcctgagttaacacccgttctcagagggcactgtggcctgggggaaggattctttccaaaagattggtttctctccttcaatcttaactgtttgcatgtaaacctatttagagtagattaaaggagagatctggctaggtcagtggataatgatgtcatttacaggggccctcgccaaaatgttgacattgcttacatttaattattgctgcaaatatattactatagagtatctccctctttcacagtcagtaaaaacaaggggtgatagaaggaggctcttctaaaatgcacataatcacttctatgtatggctgatgttggttcagtgatggagtataaaatggttgacgtggtataactgagagtgctttgatgcagtagaaaaaggcaggggactggattctgaaaaacaagtggtaggtgaatcttcttgtagagcatgtgcctgcagcaccgagcaatgccgcctgctccgggatgtggggaataccttgcgcaggtggttctgcctgtgtccagagggcggccagggctggcatcggactcttccactgtgtccggagatttgaagagggtgggagtgggggttccttccgaattcctgcaggtgaacgtttaataaagtgtatcttttaaaagaacagcatccacctttagcttgtctgttttcaatgttgtgcaaacctacacacctgtggatacacagcaggaactatccacttcaggggtgtcctgggcttactccttccccagactctcagaagggtgctttgcctctttcggggaattagagagcagtgtctccgcctcttactgtgtttgttacaaatcagcagcactgagtcaaatctgctgcaggaacttaaggagtggtgatttgaaagggaaccctcactcacagcaccctgaggaaggagcaccagcagcctggtcggaatgtgcattgaatttcccgttatgctttgcgtttagtatctgtcatcttgcaaaatcatgtttaaaacagtgaaacacccaacagaaacacctgcttttctctctaaagttgaccaacagccctaattagcactgtggtttctttctttaaaaagtaaacttactgcacggtggctgacgcctgtaatcccagcactttgagaggctggggcgggcggatcacgaggtgaggagatcgagaccagcctggccaacatagtgaaaccccgtctctacaaaaattagtggggcatgatggcaggtgcctgtaatcccagctacttgggaggctgaggcaggagaattgcttgaacccgggaggcagaggttgcagtgagccagatcgtgccactgcactccagcctgggtgacagagcgagtctctgtctcaaagaaaataaaaagtaaaaaaaatatactaaaagaaaatgtaaaactaagtgtgtcaacaatgccagcccatttgagagcacagctttccggaatacagaggctgcctgtcactgggcccggtgggctgggatgcctgcctgcttgtcgctcactgggctctctcttgttcctccaggttcgccatcggtggtgtgaactcattgttaagcacaagttcacgaaagcctacaaaagtgtggagaggttccttcaggaggatcaggtaggtgtcatctttcagcagatggggattctgtaaaggctgtccctgcacttcacacaggaatccacgttctcagtatctctttcataacaaataattaaatctgttacagagattcttaaggactggtgggatcttgcctaacactgatttttctgagctgcttttttcctctctcaatgtctttgaaggattgagttgagcaccttcaatgccgccttgtggcccacacgtcatccgatgctgcgtgctcacacttcacggcatctccagcacctgctaggccatgcgtgtcccttggtgacgccgtggggtagatccctgatttcagtggccctcatttaaagtacacgtgcaagtcagactgggagagccccgacgggacagtctcggtctgtacctgcacctgccgtgctgtgctaggcgggtttccttcctgtgagagcttttctcactgttcaccagggacagcagtcaccttcctaggagttcacaggcagtgcgcatgtgggagcggatctggggagaccttcattggccgcctctgatgtccgcagtgtgtcaggtcaccaacaggtgtgtcctgtaacacgtcacagcctcccacgccttccccatttccccactctccaccccctctgcctctgaatgagtggcctgtcaagcactgtgggtaacagcatggagctgccttccagctggggtggagagtgggagtgaggcaaacaaaaggacttttgatagggtctcagtgtgggggacagccagccagtgaggcctgaggcctcattattcctacaaagaaaagtacatgcctttgtaccagaagaaatgtcacatttgcacagcagagcaagaggtatctggaaaaacatacaggagtataagaaggacaaaatttaagagcaactttatggtctgttctaaagaccagaattcactgcagtatatttagaattgtgatctttgacaaataaggatcaccatgtctggacttttttgggaaagcacttttgaacccttaactacgaagttttgctcttgcgatgtctttgagacccttcttttagtttactccagcggaatgtaactcgtggcataactaagcatggcacaagagagtagacagatccagatgggcccttgggtcttctagaacgtccttggctattttaaaaatacaggaaaaatgcagatgtgagtgtttgcggcattgttcccaagcagcagagccggtgcgggctacggtgcagggctgtggaggaaagggcgcaggcggggtgggcgtctctgcgggcatcgtgatgtgtctctgccgcggctgctgcctgctgtgctctttgcttccctggcaggtgaaggacttcccggatgagctcagaccagctactcctagggacacactttgcggggcaggagtcccgtgtctgtaatgccacacaggctctccgcgtggtaattctgggaaccatctctgtctgttcagagcgttcctgacacggccatcatggtgggaatgcctgctcatcgttctgtcaccagtgaaatcgtcagagtctgtgtagagaattgggagctgaggattccttggggttttgagtacaaggaggagacagggattgcagactgcagcttccaaaagcacagtcagcccacggcctctgtcttctctggggtctttgcaatttctagaccagcaagtgtgtgtggaacaagcacagactgagctcatgtgtgcgtgtgtgtgggtacccacaccttcgcctgatgccctttggcctctgtgccctgcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaacgaggtgattctctccctttcctttctgtcatttagttctaaccagatactccttttaggagccaactaaatcagtaagccgaatagttagccaagactacccgcagcatcaatagtcggctccctggcccagggcctggagagtaactggccaagtgggtgctgggctggtatgggagccccgggtccctggagcaccttgcctggctgtggcagtcaccgggaagcagaggctgtccacctggaggcacagcggcactccttggcactattttggccacttcaggttttataatctgttgaaacaaaaattgtgggggaacatcttgagtaggtttagagatggaatgggaagcctggcagaagcgctggtccagtcttcagggtcacggctgatacaggagtttaagcggccgtgtgactccaaagcctagcttctgcaagcagatgttttcttctagccatgtgtgaattggaggttccttgggctgtccacgcctggtcatcggctggcaggaggctctccaggcacacgcagcacacacagcacatgcaccacacgtagcacacacactgcatgcagcacacacacaccagaggacgcaccacacagagcacgcacagcacacaccacacagcgcacgcaccacacagagcacacgcggcacacacagcacacacagcgcacgcaccacgcagagcacacacggcacatgcagcatacacaccaaacagcgcacgcaccacacagagcacacgcggcacacgcagcacacacaccacacagagcacctggagcacccacagcacacacaccacgcagagtacacgcggcacacacaccacacacagcgcatgcacaacacagagcacacacagcacatgcaccacacgtagcgcgcacactgcatgcagcacacacaccacacacagcgcgtgcaccacacagagcacctgcggcacacacagcacacaccgcacgcaccacacagagcacatgtggcacacacagtgcacgcaccacacagcacccgcggcgcacacagcacacgtggcatatggcctccatgaccctgtgtcttgagggcaggtcctactttttgctttgttgtgttggagcggaatttctcccctggcttctattggagtcctagattatttaaatcacttcctctgttaattgtgcctggaattaacctgttagatttacttcctagcagttagttgctcagtatgggtttctacactattaaagcaacctagcggtagtacacaaggttttgttaggatagctgtgagattttttttctctaacaatcatcattatttctgtgtctgctccgtttttcttcagtgttttatatgatattaataggggatgtctaattttgtatctttaaaaaaactttatcaaatctgaagcatttttcgtgttatagcttctctataatttttcatggatattgaatatttggtgttgatattcttcactcagttttgaacattgagttttcttctaatgttttgtgcttatgaaaaccatttctgtgtaacgtgtttaagtagcttatttatctgaaagaactctaataatgaaaagaaataaaaagtttttcagaagcatgatcatattcttccagaagagtcaggaaccatgtgtgccaggaaagggaaacgggactgagcgtctcgtagcgaaacgcctgctgcagacttgacgcggctcccctccaggacgggctggcggcacacagactgtgcacttacctcactgccggcctcataatagtaatcagtgtaaatggtgtttctctttcgttttgttatttcgtggcgtacgtgttaaagtgtgtgaaactacaaggccagctagtcctttcatcattccctttggtgcaggttttggagcagcaccacagggcacacccctcgccactctttatggggaatttttgcccaggcaggcaaaggagtcatcttggtcacaagtctcccttttccccctccccagcatcttcgatcctgtccccacccctccagatgcatccaggggttgcaagcctgccccccaaccagtccccgtgaggaacagtggccgggattgtcccagggccccttccagcagggggacctcctgacttgagagtccccaaagccttcccagggcagctagaatctgcctggagagaagggatcttgtccccaagggttagaggcagtaaactaatagcaaggacagctgcctttagcaattgtgtgtgtcgcatggccggtccctgcatttttcttcagttccaaagctgcactggcatttttatggtcatctctggagtccctttgattcaagaaattatacctctaggatgccaactaaacgaacaacaaacagaaactccacctgtttgctagcataacaggcgtgaaggcggcagtgtcgccggcgtccttccgcggaagcccagtgtgtgcagacagcacggggtggcgctgctctcaggtgctctggctgcttgggttcctggcatgctgatttgtgacttaagattaaaatcacattgccagggattaccacgcaaccacgaccttggctgctcctccagaaaccgtggtcgcgctcactgcagattggagaacaggtgcatctcgtagctcttctttggaaacaaaagaagccaccagctgaggaagatgctcaccggtcaccgtccctttatttatgcccagcgatgacctctctaacaaggtgcagagcttagctgattggtgaacagtgattggtttccgctttgttcacagtggctaagttctgcacctgaagagaaggtgagatggggacagttaagttggagccgctggggcagaggccgttgctgacgggccggccgctgctgcacagtcagcttgggtgcggagcgcgatcctggaggatgagagaccacttgaccccaaggatgcactgtctcctgctgggaatgctagccatgtactgagtccttaagtctgtccacagaaacatgcactaatcggacatctgtctgaaaggtcaaatgtattgaaagttgcaaaaattcttcttacaaaaaactaaaaccaaatgcatcacctaagtcgtgtgaaatcatgtggtagctcatggctgtgagcggggcggggcggggctttcggaggagctcctgttgttctgggcgcggtgaactctctcttgtatttgcagtccaggccttcgcgtctcctgcgccagcagacggtgcccacggagctcccagctgaggcgctgcttctccgggctgtcgattggacccgccctccggtgcctactgagctgatatcagttctcattttacacactggctcagttcagcaggaacaggagtcgagcccttgagcaaaaagccttcgtgtctgtaagtgcccgaggctcaggagagctggggctcccactcgcggcagacaggcccgcgtccaccctgcgtccaccccggcccggcggcagcacggtgccagtcatctgcatgtgctcctgcggcgtgggggtttgtagacttggaaaaccctgttggcagaaagttaagagctcccaggcctgaaggcaggacacagtgccagcagggggccgtttgcccccatgtgtaagggaggcagggcccagctctcccacggcgaggtgagctgagactttctgagaacagttagagtgggtgcgtgtctgaaatgggtactcctagcagctattgtgtacgcaaagcctgagtacagcctgctggtgtcatggccacgtgtgagcaggccagcgtcacacggctcgctgtgacccgtcccggagactgaaatgggcctgggtcttctccttgtcctgtgattaaagtcctctcttgaaagtggagagcaaaggcacacagaggtgcgcgctcacaagaattcctcccggtgactgggtaatcaatgttactgctgtttcctttgcaggaaagaccacagcaagattctttcattcgtctcctcctagcctgggggaccaggctcgaactgaccctggacatcaaaggagggattatgtggctgctaaagccatcggcccacagccctgttcacatcttggtgcttctctttcccagaggctggtcccagccaggcacacacaaaaggcagattctcgtaaacgcagcctccctccctggaggctgcctcctgccctggatctggagtggagctgctctgagattttgagttcttctgcagagatgattaaatatatccaagagacattggaaaacctgctgaacattttacattggtctgctcagcacatggctggatgcggatatttctataattccagaaagtcacacagctcctctgtatgagaccagtgggcgccatttaaaagaacaggatgagaatctaagatatattattaataaatgtaatggattttttttttgt

SEQ ID NO: 37809 - DNA, 73708 bp, Homo sapiens
tgcccggcggcgggtcctcagcttcgagccgaggtgcagtgagctggtggggggaccgcgaggcgagcgcgggagcctgggcggcgagccgggtgtgagctgcctgaaaatgcactcggatgccgccgctgtcagtgagtagcagagagccagccagcgggccggggccgggcggctgccaaactcgccactcggctcccgcagtccccgccccacgcctcgggtcccgaaacgcgccgggagcccctgcctgggaaccaccccttcccctcccggggccggggcgggcggtgacgctgcgggcggcgtggggcgggggcgggcgtggggggaagggaccggcctgcggggagggcggaggtgaggggggtggggactggctctctttcagtgttgggggaagggagggctggacgtgcgatgaagggccgagatcggagtgtccggggtgcatggaggtggaggcagcgttgggctgtagcgggcagggccggggatgtgggggggtggcaccggcggggagagggagggagcgagcgagcgagcggggcacaagggtgaggatttccaaagggctgagtggtgcgggcggctccgtgagaaaggcgggtgagtgcgaggggggcgcgggggcggggacaatgggaagaagggctggttggcgggggggtggggggggggcggcgaacaatggggtgggggaatgggggcagcggccgagcggggcaggagggcgggcgactggacgagggctgatgtaacgggaaagcgaggtggtgggagggactggggtgtaatggtagttggggagtcctgcggggcgggaggggcgttggaagggcggtgggtaacggagagtggtgggagtggaagatgttggggtaaagagatggggcaggtgtggaagggtagggcgattgggaggaagaggagaaaaaggtgggtaggatttggggtggcagagtgggggcaggggtggagaatatgaaatgggggtgaggagctagtcggggaggaaggggaggtggggcggagttgggcaggaggactgtcacgtccagattcggtccggagccgggctaagggggtgtcagactgtgcttaggggaggtacttcctctccctgtcgaggcagggtcccttgaaggggggagtccaagcttcggggtgcggagagaggagggggcggggctgaggtggaggagacggggtaagtgccctaaggttggaactggccgtggttccccccggacggcgggaagcgaggtcagcgctggcgcgggctccggcagcgggactaggaggcggggcaggggtgcgggctgcggggtttcagcagcgggagccggaggggtcgggccctgatggccgggtcgggggcttggcgccggggaggtgtcggggtccctggcagtccgtgggtttgatagtctgtgacgcagttgtctaatttctggctatcaggtgtgggggttggtgccatggaacccgcttccttagagggatggccgggccctaggccgcgccccacgcccggggggcgcgacttctcccaggcgtgctgggagggcgcttgaggggtttcctttagggtttgtctccagtcaacgggtatgaaggggaaaggcggtcccgccgaattctgggacttgtagtcgcggccgcgcccggccgcggttgggttgggtgcacgtgggtaactgtggaaacgggtcccggcatgcagcgcgcccttggagccttcctgctcggccaactcgtgctttattccccggccagctcctgcgcgctctcgggaggcggttgagttcccagggacggagcgactccccagcccttctcccttgggagagggagagcccacgccaggcgcagccctcttcacgcttaggttcttggtccccaagtgaatttccccctgcattttgtggccttacttgtggaataaatgcttggtcttgtaccatcatgcgcacgggttgtgggaaaacatttaagaagcaacacaatgtaaagcagcctttagaatggtgtatttaattttggcatccagtgtgtgtaagcactgggttccagcattcccttgcataaatatgagaacacagtggaggtacacgtaacccttgtaacgataatataaactatgtgttggtatttcttggggtgtttgaaaaaataactgtcttgaaatgagtgatggaggtgggttagtggaatttagggtggaaatgtgaaggtgagcaaaggtaatatgtgacgtcttcaattttcgaagaagcttggaaagcaaatgagaatagaagaaaactgtaaaaagtggagaaccataagactttttttgtttgcttgttttattattagctgcaggctgcaattccttctctccttaatactagaaaccttcctctccataagtagactccctaaacgtcacatccttcaccagttccctttactgtttacagggaagggactccagaatctgtaatgtagaaggctaagattaatgcagagatgatagatttttgtatgtaatatataaggtattatgaaactacttgcaacatagtcattagaagaatattgtaatttttctgatgataaaaatattaccaagaagtcctaagatttgtaaaccttttggtgtggttacaaacatactgaacttggatacttgattgtttgatggttcttttcatgatgagtgaaaaattgggcaatgtgtgtggtgttcttgtggagatcatttatatctatctgtcatattttacttaatcgtgtggtgaaatatccaggaaactcttggtaatataaaaatatgtacaaaaatgtgcacttaactctggaattttttcttgcagagggtaaagtgatgaggttgaaaaacatgcaagagctataattgtcttcaaaatggtgtttttaaagaaaatatgaagctagtcatagctttctctttttcttttgttctattatatcccaaagggcaggtgctttttatacacatatagcccacctccctccattccccaaagccctaggctcctacacactttctgctctggtttttaggttcctttttgatttttggcgcttggggaggtcctttattttcttgtgaacgtagctgtgcatttaaacagatgtttcttacacgttatccagaatttttgactgttttatattaagaaggatttttaggtaatcttgtctgtaacattgccagaaaagaaggcctgcctcattttctcttagtggacttcactctcttcttcctctgttgttaactctgtgtacccctactggcacttaatcatgttttttcaaactttatcattgtctccttttctgtttttatgttaagttgctcccagcagctcttcttggcttattaccttcttcctggctacgtttacattattatctcaatcatcatctgctaattataactaataattaatagctaataatcctgctaacttagcagtataaaaatcaacctgtgagaaactgacctcatgatgatctcttgtatcagttaggatgcctttgccaatacaatgctcaaattaatggcttaaataatagggcttattattgttcggtagcaagaaacctagaagtagttggttctaaagctggtgcagtggcttaatgatgtcattaaggatctaggttctgcatctttttcttcttctattagtgttttagcttttattcctcaggctcatttgcctcatgtttgcagtatggttgccgtagcaccagacatcatgcctggattggaaagcagggaaggaaggtgcatatttccttataactccctgttaacagagaagtcttttgcagaaactcactttggagagttccatttcagtgtcattggattgaactgatctcatgccactgctagctgtgaggaagcctgacacagtgaatgtctggcatttaccagcatctcttgtaagatatggcctttcgtagggtggaagaagggtgagaagaatgcgctgggttggcaacttgcaggttatatccctgaaccagctactttggccagctgtctctggcttggtctcaacctttacgttgatttattttctgccttattctaaaagaattaggggtgacttgctaaatatagataaaaccctgtcaagagaagaaaaatttatatatagacttgtaaggtacacagaaacacttgccatatgttagaaatatttggcactgagctttttaatagtcaaagaagagaacaaaactaataaattttattcatttggtaaatgaagctgcagtaattttaataacccacactgaaatcctggacatttcttatcctcttcttccctggtcagtggcaaggagagattgcatctcttcccatgcccagcctctctttcccatacctattgccatggccttatgtctgagacagcctttcttacagtgttataataaccagcaatacatttttctttcttttttgtttttttttttttagaggttgggtcttgttatgttgcctaggctggactcgaactctgggcttcaggggtccttccacctcagtctctgagtagctgaagttatagatgcacgccactgcacccggctccagctgccctcagtgctgctgttttagaatttttctttactgtgctccctctctagcagactctcctttcatggaatctctgaagcagtgcttccttctgttactcagttttatgttacataacaatagctgcttgtttacttttatttcccctccccaattagattattacctttttgagatctgggaccatgtcttacccagtatccactttagcatctagcatgatgccttgcatagctacccaaatatgtattgaattgaacttaaatgatcaactattgaataacttgtgcattatctagaaaaattaattcttcctgttcctgttgtctttcattatctttagatttttcttcaaggaacacaagctttcacctactcattctttgcattttttagacaaagtcagttgtatgcaaactaatttaatatttttcaaacatgcagatatcagttttagagaatgtggcgtggagaaattctcaaggaaagagtaaaatgctggtgatgtgctgagggaacagaaggagtgtttgtgaatgtgcacacgtccgtttctggtctctcgtgtcagcgtcctacctgcacaaggttaaggcagcattaacaggtctgatgttaaggggcctagagtgtttgtccttttcccttctttttgttttatatccatattctggtcctaaggatttatttcttaagttaacaatatagtgagatcactgaaagtctttcttcagatttacagagtaaaattttctttgatgaatctgacataaatgctggtaaatttttatagttggtcaactcgaattggtattaattcttctcatagcttgctttttttcttttgaaatttacattaggagaagtacctcttgagaagtattctaagcagaacatgtattttaaaatgtgttttaagaaggaaaacattgaaatgcattctaaatagaattaggtattttaacaatcattgtgtgacagttttagatgtagcaaagtatctgctacttcaggtttgaattgcttttaatcagaaaatgctgttaatgagttatgttcaatctaggaagataggcttgtcatttgtaactaatgtactgaaaaaaacactagatatgaaaaagacccctgccctcttcaaatagcattacctgtggtatgatttattttagttctgccttcgaggatttttttttccttgtgaaattttttgctggcctgtatcagtagatttgcagagacggggagtaatccatttgtgcttctccccctgccccacgaccacaattgttggcttttaacatatgtcatcttaggcctcctccatattagtttatgattagtgtctgtaatggacactgtcagtccattgactcttggtctgattggagaattcttaccctggcaggcagatcttctcagacacactcgcctgagactgtgaacctgaggctggaggcaaggaaagaagagtagcccatgtggccattttctggggggatgcacagtggtggctgctgtgctgcttctagaggcaaggtctagttgttgctgcaatgatgatgcagtctgctgtgtccccttaggcattgttatggccagggggagattctgtgaactgtctaatagccgcctcccctttttttaaatcacttttctgtttaaattacctagaattagtttctgatgctctcaactaagaattctgatacttcagcatccagacttgtcactgtcgctggtcagatacgtggtagaagcccttgtgaagagcagtgatgtatctttttcatcctggctgcctgtacattctggtcagaggtgacccagaggactggaggaggacacagtcgatatcagctgtgggtcgtgggagctgtgtttgctggtggtcaggcaggactcccgaaccacacactagcccagcccactgggtctcatcatgtgccactctttactgctgctttttcctaattctttgtcccccaaaagttgggatgcctaggagctaatacataactccttgtgcattttttttttggctctgatgtgggaatattagctacagaaatatgtgtgtgtgtgcgtgcgtgtgtgtgtgtgcgtgttttagtggaatgtttattttgtttagccaaaaattacatctgatgtaccaaatacctttttagtcaacattatttaggtataatttcacgtattataaaattatactcattttaagtgttgttgggtgaatttactaaagatatagaacatttcattaccccaaaagttcccttgtgtccccttgtagtcagtgcttctcctcctgccccactaccacaattgttggcttttaacatatgttaccttaggcctcctccatattagctgatgatttgtcactttgctgttcctgaggatattacagtataataaaggcatgataaatctctcgtttttactgaactatgaaatccaaagaaaaactatcagtgctgtataaattatcagtctgataaataatactttgccgcacagaagtgtcttgagttagatgacttgttctggtgagcggctttccagtggatggcttttctggcttctctgtggcctgtagacatgcagggctcgggttttctccctggatgtgatgatgtcttttaattgttatctgggtcaggttgggaggcaagaaagccaaaatggctgaattcaaatccttgctctgtcatctcctagccaagggactggagtagagttacccagctgctctgtgtgcgcttcagagccctcatgcctaaaaattgcctgttgaaggctgttcagtcaccaagtgtttattgggtatctactatgtaccaggccctgctcttcatatttcatgaagttttccttttagtgtaggggagggggcagatagtaacaagtaaattgtgtaatacgtcagatggtgataggttctgtagagaaaaacagcagggaaggggtgcatgcaggcacccctgtgtgcgggcgtggggtggggtggagggtgttgtaattttaaatagtggagccaggaaaggcttcactaaggaggttttaagctaagccctgatggagctgaggggccattccaggcagagagaatacaaatgcagaagctcagagtggggagcaggcctatatttgaggaacagcagaggctggggtgcttagagttgtgggggagggcagagggaagaaagtaggaggcaaaaatcataagtggtccaaaggattaaatgagatgaaacacgtaaagtgtttttgatgcttacaattactgtgtgatgacagtctcctaggtagcctttaaaaaatcactcttgagaagaaaagttataagaaagaacagaaccaaatgaggcattccctcactcagccattcagcaaacattcaaggggatttttgctgccaggtgctgctgtcacaggcaggactgtgtgggggagaccggggcttcaggagcttccttcagtgagttcattgtggagacagaaggaatggatgcatgggacgatgatgcctgctaggttagatggatgccccgggggctttgagaacatgtggggaatggttagcagttgtcatgtgagttttagcttttgaagttggattatgtgaagaacaggatgtgtatgcatgtgcaggtggcatatggggtcaggtgggagctttccaagcccagcgacaacatggcatggtggggacagagaactgtggcaggagagtgggtgtttggtaggctagagtggaggggaaggtgaggtgcagggctaggcaggagctggtggcaggggtggggtggggtcggtgggaagaactcaaaagaggcaccagggagagtgtatgagtggaaaggaactgagagaaggaaagagaagtcccaggtggggcacagggagggaggaggagcaaaggggaatggggagggactaacacgaattcagtgatgatcttggatttgcttcaactgctttgcctgcattaactcatttaatcctcacagcaaccctcaataagttagggactgttattatctctgtttcacagatgaggacgctgaggtgtagaaaggttaactccccttctcaaggtcacacagcttataagtggtgaattgagattctaactcaagcattctgactccatggtcttggtaaccctctactgccactgaaatcattcttaacattttgtttgtgcttttcattgaaccctgattggaacactgcatgtatattggaattctttttttttcttttgtcactggcctatgaatgatgctgacagagccagctgatggattatctcttggttcttttcttcttggaatgagtcccagcaggatcaggatctgggatttctgagtctcttctttcccattcttcttcatcccctctcatttttgctggtttgcttacaatgagagtagacatttaaaaactgattttaagtgggaaactgaagaattgtggcaaagtattttcatactcttaactaatgaaatagtcatttttagtcttcttagattttatttaaatagactttgttatttttaaatataggagatctcaacgacattgcagcaaaactagaaaacaactactaacatcatttttacataacatttttgaaattatttttattttttttcctgtaggttagggtaagtttaatgtcttgtcctacatatgcaattcccaaaattaagccacagatcacttcttaattattaattaaacaggaaacgggatagttgtacatttaagtccaatagctagtgaattagtagttttaaacaccatcaccttgtgatctcttctgccctgtctttttgtagttctaggttcagtctgtctcagtgtcttctacgttctaaataataatagggatgaaaacaattaacgttgattggcacataatatggaccagcactgtgctaagtgcttgacatgcaccatctcatttaataatccccacagtagcttcgcaaagaggttctgttatttcggctttatggatgaggacacgggcacagtgaagtttggaagcatgtacagggtcactcagttgggactcagttggagctctgactccaacccagggctttatgttatcagagctgattgacattctttaaccaaaatctgggctcatttaacattagtgagatggaaagatttttactgtgaactacccagtgattctgtgtgcttcagtgggtagtacagatcatttgtgctcaccttcagtgggtaggtggggtgaggagaatgaagctagggccctttgtaccatgtcacattgggagtgcagccagacgggtgtcctgaagtgactgagtcccttgggatagcaccagcaggcacaggcagtgtggtgggcgatggatggatgctgcctcccttgggcggatggtttcttctcccagccccttttttgagtcctgcaagaggaagaaaaagccagcagcaatatgcttggatagctttaactttggatctgtgttcagtgaaaatgctgagtcactttgaatgacctgttcccttatcaattttctcctttggcttttgtgccttgtaaatagcaaatatttattgatgaggagaatgaagttagttaacaccttcctcacctgctactttcaattcttttggtttttaccctgcttttcagctctgcaatctttttcctggaccttggccttttcatcgtgtgctgatagggtatggtgaatgagttagattcctgtctagcagtgctgaggttgttccaggagtggattggctactggcacgccagggattgagttgagagtcagggatagaatctacttctctggttgcatgttagaatcacctgggctgcttgagaaacacgtggtgccccacacccatttttatttaattgatctggattggggccctggtatttggtgtttttcagtcttcttaggtgattccactgtgtagccaatggtttcatttaaatattaatagcttaattaggaagctgggtttattttgggctgtggagatggggctcaaaagatgcagcagctcccccatgggcactgcactgggcagatcgtgcagacccttcctgctcgcctatgacataatagccaattcttggtagtgcttcccctgtgccacgcactgtttgaagcacagtgcagcattaactcatttaatccacacgatatccttatgaggcaggcactgtgattatccatttcgtagaaaaagaaattcctacttgtagccatgaaggacatgtagtatgaaactgacccataaacctaggttttggtttttcctagatttacagtatagaaaacatttcagatctttgtgttttagtaatttagcctcaaatgtgaatatatttgtttttacaaatgaaactgagacctgtgccatgtcatgtagctagtgactatcagttagcatacagagttgtaaattggtattgtaaatcatttaaaacactacttttttatggttttgacatagattttactttatggtacattttatatttcaggttatttgagatgtacctcatttttaagggaatcttttttacttaaaattgtattttgtactttttaaaaacatatgtactatgatctttgagtgcatattagatcttcactgacttgtgatctgacctgcctcttcacattctggctactgtaaccctccaggatactaagcaaaactaatagcagcatttgaagcatgctcaagtcctgccattgtaaaacccaaactccttcaaacccacatgcatttctagtctcccctttaatagccaacttattgaacaagttgtctttgcctgacatagtctgtatttcttcatcactcatacaatcctcagcccactttgttctggtctcagttctgtcattgcagtctttgaggtcatggagtaacctccatgttgctaaattcagtaactatttttaaagcatttattcccctatttattggtacctgccttgtgctaggtttgtgctgttgtaggtacaggtcaagtgtcctttatctgaaaatctgaaacccaaaatgcaccaaaatctgaaactttttgagtgctgacatgacacttagaggaaatgttcattgtagcatttcagatttttggattaggaatgttcagctggtgagtataatacaaacaacaaaacctgaagaaatctgaaatctgaaatgctctggtcccaagcatttctgataagggatactccaaaagatattgggatagagtagtgaataaagcaaaaggaagtccctatcctcatggaacttgggctctaggaagagtgacaaagacataaataaatatttaatataatgtcaggatcatgaaagacctcctgttgtgtgactctgctgatataaaatgtctagaataggcaaatctatagagacagaaagtagattagtggttgcctagagctgaagaggggtgaagggagaaatggggaatgactgctaataaaaaatgttttattattagattgtggtgatgtttgcacaactctgaatatactgaaaccattgaattttacactataatgagtgaattccatgctatgtgaattatatttcaaagcttttaatatcaggaagtggtaagtgctatgaaaaaaatctaaatccactgggagatggaggtactgttttgcataaagaagttagatgagacatctctgatgaggtgacatttaaatagatatttcaggaaagatagctgttgggcctgtgaacgtcaagggtcatggaggctgaggggcacagtaaatgcaaaggccttgaggtaggaattcacttgaatattcacgaattgtgtggctagaatggagtaggcaaggataatggaatgggatgacttaggtcagatcacgtagagccttgtgaggactagaattttttttcttttatgctgcaatagcaaatacaacatctcagtgattcaagtaaaaggttgtaatgcatcctttgtgggttggaatgggtctctgctccacatcgttgacattctcatccctagtctatctgaaacccatggaaaagagggcatgtgtttctagaaggaaggaaacaaggcaaatctaaagagtggctcccaaccacagtgcagccttggctttaacaatttttgttttcttttcccatatcacgtggtacaattgacttttcaggaggctgagccatgtgacccatggcttgaaacacccttaagcattccctgatgaatcccagttagagaggcagatccctatacctcagtcgtgttcttgttctgttccagagacatttagatgagtgccaaggttagatggtaacctttaattttgtccaattttgttttgcttttttggcaataacatggtcactattttgccctttccttctgccgcctttacaggtttatttcatcattttcatcgtcacttgaaaagcatttgttaagagcataatactgtttaaaacttttatatctgagagaattgttcagctgtagtttaataataaaacactttgatgatgctttagtgaccagaagagcgaattgtgcttaaaaatagaaagttaacactggtgttaaatcttttctgtaccattatttccctgggggaaaaatggtgaattgttttagattcagccagttttaaaatttttttctttaatattaaattactttaagtgtgtggttgcttgttgacagctttggttaggaaacgttgctgcttttttcctattacagagtgtaaagttagattgatatttttgcttttattggaaataatttagaatggaagaagtagccttggattgggagttagaagataagagttttgcccagcttggccatagctagctctctgactccgctcaagctaataaaatgagaattggacaaaagaacatgaaccattgagtgcctcacttgctcatctctcacatgcagtcctgttagtttttccttacactgcaatcacattttatatagaggttggttctaaagtccctgtgtaaggtgaagatcattggtgttaaaaataccactggaaacacttgcagaagattcctctttggaagctgtctcagaagaatccagcacagcctattccttcctccagcattggaatagatctctggctgtttatttgagcaccagttgaagcatctggcctcgtcttcaacttcagtttagggaccatgttttatgaaaatacatcactttaaatactcgactcataccgtattgtgagatgcacaaaatctgattggcatgtggaaactgagaccaacagagtgactattcatgtgtcatgtctcgtgctcattaagtagaagggagggtgggcagttagtgagacaactgaaatttcttttcatctcgcttcttccttttttattttttttgaccaaatgagaagagttgaatttgtgtaagctaaatatctattttctgcaactccagtgtactcagaatctctcctctccatttttacagccagtgtctaacttacggccctaatgctttcccacctcagtcacttctagtcatctccataaatggccactctaaattcagatcacccatcatctttgctgcacacttgtcctagagtgatctttttaaataactctcctgatcagaacacctccatggcaccaagactctcaaaggagtgcttctcagacttcccaccaatgttttcctgtacagagtttggtggaataagttgtttcagggtcctgggagcacagcttgatgtggggattatgtttgttttcatgtaagactgtcatattattgctgattagaattgatgctgctggaatgtgccattcctgtcattacgtttgcatggtctctggtgcctgtgtttgaggtacagatccttaggagattaaatctaaacgctcaagcaggattcacaagttcttcattttctgatctttgccttcctgttcagtctcctcttaccatgacacttctcacatttgaagatcacttgaagtgccctgaatgtattgaatttaagcctttggtgcctttgtatctgcgtttattcatttgttgaatatttattgagcacctaatatgtgccaggtactcttctaggtattaatattacgggatacagcaatgggcaagatttaagtcttggcccttgtggagcttacattctaatgggagaggatgatgacaaatatataatataatgtcagatggtattaatgctgtgaagaaaagcaaagcatggtaagatgatagagtgaagatggggctctgttggtctggcaaggttatgtaaggaggtgatttttaagaattttatccttaattgacaaataattgtatatatttacggagtacaatgtgatgttttgatacatgcataattgtggagtgatcaaatcagactaattaacatatccatcaaaggtgatattaaaatggaaacctgatgaagtatgagagcaaccatgttattattagggggaagagcgctcaaggtaaggagaacagcacgtgcaaaggcgctgaggtgggagtgttcttggagtgttaatggagcagtaggaagctcactgtggctgagtagaatgaacaaggggaagatgagtagaagatgagattggagagattagcagatgcagggtgtacaaggccctgagcccatgataagttttcttttgctttgaacagcttccccttccatctgtaactattgggtgaggtggaattaattttaatttgttctacatgctgaccagttgcccctctgtttactgaattattatgtcttctccattgagtttgaaatgccatttaattatatgttgtgtatgtgtatttatacgtatatgtttatcagctctctgtcattgatttttcttcttgcacacatagtataacattttaattactgtacctttataccaggtcttggcaaacaatggcccatggggcaaatccagccctaccacctggtttttataaataaagctttattggaaagcagccatacttacgtattgtttatggctgcttttgagctactatggcagtgtagttgcaacagagactgtatgggccagaaatccagaaatatttacaatctggcccttcatacagagtttaccaggctctgctttatactgtgtattgatatctgatagggcaagttcatcctcattctttttcaacaatttcttggcaggcctaacatgtttatttctccagatgaactttagaatcaatctgccaagcttgcctgacttccttcttttccccacctctttttggggtggagaactggggagccagcagaataggaattttgattgcattaatttgtggtttagtgaagggagaagtgattgctttacaacgttgggtctttctattccagaaatatctctttacgtgtatatctttcagtaaactttaattgttcattctgaacaataaaatcatacatattggagtttattcctatatgtattgttgctttttgttgccattataattgcgttcttgtcccagttatattttgcaagtgactatggtataaagggaagtttttgctttttatgtatttaaattctgtttctaaccctcttatgagagtaaactattaggactgttaatttttgtttcttttgattgagagtcattgtctgaacttaccaataattgttttattaatgtttatgtctccccctgtattgtgtagttttcttacctagagtagtttgggggaatggactttgaccccctcaatggcattcatttttttttcttttgtgtaggtcacagcaaatggtagttaaaacaagcaaaaaaaaaaaaaaaaaaaaaaaaaaacccagacaagtttatgcccaatcagcagttgttggtagttttaagaaaatccagaagataatctaggcaagctatttatcaagcaggctgtgcctttgtagagctgattgctggttttaatacagactatagagttgccatgtcacacaggagagtcagactcagcactgctttactttggagagccgtctgatcatggaatgcagtcaaaacccagcatttatcctttggaattgaaatacgagcagaaggagatttttatcaatcagtgctttccagaatacgttctcggtaaagcatttgatctttacccttaacatctaggccttaaggaggtgaaatctactgtagatttcaagggctattacttgccatgagcattgaacagatgaactgtaaatccaatgtgtgttaacctttgtgaatctatcttttaatgacatttttgtcttttttttctcctgaatttgtgtcttaacttctccttatgttgatgagacgaaagaaaaattatccatgttactggtttcatttcttcctttttcttttttctttttttagttgaagtgatgatgatgtggtagcaatagggattggatatagaaatggataattggtgacatatattatgtatttgtgaaatgaacctgtttactcttgttgcctttagtaaagtaaaacttcatacgtggaacctgattttaaacataatatctgtatttttgttcctgtgtgttgtgattatctgcagtcaacattatgaacatcagttgctggtatatgagtcgcagtgccattcttgcattactataaagaaatacctgagactgggtaatttataaaagaaaagaggtttaattgactcacggttctgcaggctttacaggaagtatggtgctggcatctgcttggcttctagagagtcttacaatcgtggaggaaggtgaatggagagcaggcacaccacatggcgaaagcaggagcgagagagagaaagggtgagaggaggtgccacacacttttaaatgactgaaccccataagaactcactcactgtctcaaagacagcactaagccatgagggatccgcccccatgatccaaacacctctcaccaggccccacctctggcactgagaattacagttcaacataagacttaggtggggacatatccaaactatatcaccatcataggctaaaagatgtaccaggccacctgcctcaattacagaggaagctctgaccttgggatcattgatgtaaggcgagaattgaacctaggaaaagttagagactattttagacagctgtgtggtatggagaatggtgtaagtaaatatagtcggaattgatgtcttttattgagcacttactatcttccaggtattgtaatgggtacctgacatacctagacattgtaataggtgtctgataaatattttcaaccatacaacaacattatgaaggagaattttttatcctcactttacagatgagaaaattggtagacctgagatttgaaccagctgttagactccagagtcaggttgtgaagcaaagtggatttttgacaggaatagagtggttttgtgtgtgtgtgcaagtgtgtgcacacatttgaattctcttgggtgtaggaagggcagtgggcagaatgtggggttggaaggaagggttttgtggagtggggtggtgaaagatgtttggagtatgagttgggcccagctcaccgaagtcctggaattccagattgaggataacttgtgtttcttgtcttttctacttcttccacatttatataaaggagggagaaagatataacagttttggtttatttagattctcttatgggaattttgggagtttaattaacagcagggtggtgaaatgacaaaagcatagcctggagagttagaagagacctcattgctggaatggcttttggcaagcccctttttctctcccctcccttaccctcagtgaaaagagaatcaagaggctaaagttttctcagtttttgctttttgtttttttgggggcccaagagtttaacttcatattttaaggtgataatggaatgtatcatttgtcttcctatatttaatctgagagagtacaaaaagggggctatggcttggtagtggatggggtggaggtgcaagagttgaatgttcaagctcctcagcacctcttgctggtcctgagaggcctcttgctggtgagagggctgtagcttctagcttctacccctgttcacgtttaataaatataaatgtaaataaataggtgtataatacacatacttttctaaacctctgtgcagtcgtatttagatgaaaaatccagattctcagccactttatgtcatcatttaccttaagcatggctgggctattcagatgctaagcaattcaagcatgtctatattggagggccatttagagcttgaggccctgctctggctgtctctcagcacaaaatgctggttttggggaccattctatatggctatgactgtgaacagtgcatatgcacatgtatgtatacaggtatgacctgctgttcctgacactgcatgtgaatgtgaggggctctgcttctgccagcccctctgccctgcagacctactcagaactggatgcccaacaagctttagaagagaaagtaaagctttctaactgtgaacagggaggccagcttgttttcagggttcagagtagcagcacagaggatccagcccaagcacagacacctgatattgtagcacctgctctttggatctgttctttggatctgatacgtgtcctaaataaaatgtttcagtaaagggagctttttttctttctttctttttgtcagaatggtataacttggagagttacaatatcttttcatggtcattttcatactaacctttaataggaaagaaggaactaatgtaaatcctgatattttgtgaaaatacttccagtggtacttatatatgaaattattaataaactttcagcttacatttttattgcctaatatatatgcaaacatactttacttcaagttgaggctgcgcgtagtggcccacacctttaatcccaacattttgggaggctgaggcaggaggatcacttgaacccaggagttcaagaccagcctgggaaacatagaaagaccctgtctctacaagaaaaaaaaaaagaaaaattagctgtgcatgatggtgcacactagtagtcccagctaccatgcaggctcaggcagatcacttgagcctgggagtctgaggctgcagtgaaccatgattgcaccactgcacttcagcctgggcaacgtagtgagatcctgtctcaaaaaaaggaaaagaaaaaataaatactaatgttgggatgcttttctatcattttcttgccatgagcttacttaattgtaccagtaattctagggaagagaggggaaagtgaacatttcatttgagacttatctttctattaagttcaagttcactgctggcaggattttataactactgaagtactttttgttttaccttagaattcacatgaaaatttcatgaactttaacatttggttgggaatttaactttattgtcagactatttctaggaggtcactaattgcatgtttttaaaaaactttagtgtcaaattaattgagatagtatttaattatatcaaaacatttgtttattttctgagtttgtttttttacaatattggaaataaatgacgctgacatttttcctttttcttttcaagattttcagctgaactctcatctctcaacactggcaaatattcataagatctaccacacccttaataagctggtaagtcattcttttaaagacaaaattaccaactgtttgaagtagtcattttgtataagtgtatttgataaaaatttagattctagatattaggatatcagttgtttatgaaaatgctaacggtatgtgatttcttcgtaataacgaacatatttctttcagaacctaacagaagacattggccaagacgatcaccaaacaggtatctgtaaatgctaacactacttaattttaaatagcttcttaatattaggaaagagaaatactagctatgaatgcgctatgttgtcataatgtactccattaacaaattgttccttggctgaggttgtttttcagggagtaatgaaggcagccatgttatagcttcttcccagtaggaaatctcttctggaagcactttttaatgcctttaaagaggctcgggattctcatagtttcaagataccttgttttctctactgcagtattttcatttatattaaaaaggtgctacagtaatgcaatttgaaaggtattccacaaatatttgagaaattcagctgaaaaatgatttaatatggtgtgtgtgtatgtgttcatagttactgaagatttagaaatcagaaaattgaagcttgattagtataagttatcctctaaccctgtggttctcagagtttagctggcattatgatcacctgagggaaggccttgtttaaagtacagatgttaggttccaccccagagtttctggttctgtagacttggggtggggccccagagtttgctcctatgtgatgctgatggagctggtctggagaccactctttgagaaccacttctctcaactgttagtaatcatcaagtccagaaacttgcatttgatctatggttactaaaatcctagcaaaaattatttaaacacattttaaagtttttgaaaatggccatagtaatagacgaattgaaatttgtcttagtctgggctgctgtaacaaaaataccttaaactgagtagtttataaacaatagaacttgattgttcatggttctggagactggtaagtttaaggtgaaggcaccagcagatcctgggtctggtgagggtctgttcctcactgatggtgcctcttgctcactgcatcttaacatggcagaaggggcaggcagctccctcaggcctcttttataagggcactaattccattaatgagggctctacctccctgacctaattgcctcccaactctacctcttactaccagcagtctggggattagctttcagcatgtaaattttggaggggcacaaactttcaggccatagcagtgcttgttggggaattttgaatagcacaaaagtaaatagagtggaaagttacagtcgtcttttagacaactatttagacgtctctttagatgactaaatagagtgaaaagtgacagctgtcactttctgccagcacatggtttaacattggttctttcagacttttttttcaaagcaaaaactctttaagaaaaaggtatgatttctcattttctattcttagcataagttttaattctttccagtggaacccaaacctcctgaacctctttcagtgtcatccaaagctttgaacttctatttctggataaagatttgttcacaaatgaactgcagttcaatcaccttttttgacttcagacttttctttgccaaaataaaacagtacagcaccagcatttcctctgtaatcttcctttatgataccacctcctacatctataaagtgttttgcagccaagccagcgtggagctactcttccacaacacctggaaggaggagctctatctaaatgtctgttcacaagagctttctccataggtggtattgtatcatcttaggcactgtacaggtcatagcctgcagcctgtacagaccctcaggtcaggccgtggtatgcttggagagctgggcaaggcagagctgcatgctgacctcctccacagaccagagagcttgctgggggaaatggcaggtatctctttagagaagggcatggcagaacgagaaggtgagcgaaggagggaatgagagggtgcaggatcccttctcacatttgtatgcatgcatatatgtttatagtcgtggtttttaatttagcattggtgatatcatactgtacgtgttatagtgtgtttttctttttcatttaatggtgcattttgggggctgttgagatttaagactgtccccaccttctctaaattggttcagaatcaattgaaaattaggtgtaagatggagactgaagtaacagtgtttttggaaaacacaacttagatgtgcagcaagaatgcacaggactttcagcatttcacctgaatcactgtcacaactagataagcacaagccagcatacctgctgaccctttacaccctgcactatgacagtggaagtgttcatactctttcagcttgctccactgcaggcagatctgaaagggagttcagaggggttgggctttctgctcatttcaggctctctgctcagttcagtctctcagcacttagatcaggcactccttcttccagggaaaggagtgagacagagaggcagagaatgcgctaggagtgttctaggagttcaggggtactaagggtcccttcacctgatcattccatatcagcaaatatagatcaactcaaggacagtcaaaaacaatttatttaataattttaaaagcagtatattcgcatagttttgaaagaagtattgaaaaaatataaaacaaaaagtgaagatttctgtcccagtttatcacccctaggttccatcccccactagtagtccacgtttgactttccagaggtaactcttctgtttgttaaccaaattatggtgatgatgatgatgatgatgatgatgatgatgtattttttccttaaatacaagtgtacatttatatttgccacttttccactcagtatatccttgagatcttttcatattaacacatttataaagcatctgctttcttttttaatgactgtaattttctaatccatgggtattttataatacgttccttcagcctcctgttgatttatgtacacttatgcttatatgtttaacttttagccaccactaataatgcaggaatataacttttggaccagttttagtagttctgaacttttgaattagataagtattgttactatagtaattttgcatgtaaatatttaacccaaagtgtggcacttgaaattcagttaaacgaaagtatacttggactcatgcctccacttttgccttggttacagtggatacgtccaatactgggagtacttttcatgggattcttggggtgttgctttgccagccggaaacttctgtggctggtggcaccttctgcctgagtattgcctgtgtctgctgggctccttccacccacttggccaggcaggctgcactcagttctcactactggcctggatcccacacctgccaagtgtgagttagacatggagcagcacacggtgtgtgggtgagcaagcacccgctccaatcactgcacacagccaggcatgctggctgctgcagtggggcaagtagctccaggtgccagcacaggcgccagtacaggcaccagctctgtgcgaggctgcagctggaccagatgtactgcatgtggcttccactgtgggcacctgcacctggatgaggggaacaaggtggcgcccggaagcttggagacaccaggaaccacagaaccccaaagagggtgtcacagccctggctcaaggagcccataggtctaggctcctcaaagggctgcagctcttctctcttcaccgcccacaacgtggcaagtggcaaggggtgcgtttcagccctgtttgtgttacagctcttttagtcctgccatttggtggatcctgagttcttgtcccgcatccaggaagaatgaggtatgcagacaactggagggtaagcaaggtgtagaggagcttcattgagtggcagaacagctttcagcagacccaaagtgggtagctcttttctgcaggcaggtcctcccgacatctgtgcagccctcggtggagaggagacctggagtgagtagctcctatctgcaggcaggttgtcctgtcctctgcctgagtctggcagagtctgaggtttttaatgggtttcagaggggagaaagcacgtgctgattggtccatgggcagccatgagctggcctggaaaaagcaccataagttctcactctagtccctggaactggcagcccagcctccaggcctcaggccattccaggcttgaagttggggatttaccggggacccacccctttctgcgcagaagcctgcttcctgatgccatcaacttgccatccatggtgcccacggcgctcaggttgttcgtgccaaggggcacctgcaggtctgcgccaagctgctctcagcccccctcggcttccccctcgtgcttgttggtgcccaaagtttgaagggggctgaggtggcagggggctggtgtgtcagcattgccccaagcatgtgcacacctggtcaggtcacgacagtgcctgggctcagcctcaactttactctgataacggacaaagcaccaggagtagggagatgccaggaagtgggagcagtcacttttgaggctgtgggggcagggggccttcccagtccttgagagtgcagggatgcctgggtccgcagccatggctgggcggctgcagctgttcctggaagggcgagactcctgcccccacagctcagaatggggtggggctcctgcctgttccaagctccgtggagtgtgcagcccctgctgctcctcctccactgcagcccacctcatggcagtgattgctccagacgggctgctgctgccatcagtatgacatgctggtttattgcctgttaccttgtaagtgcccagtcaatgtcagttagtgttagtaatttcttggagtagtcaacttcattaacatttgccatctggttatagcatcacttgtgattccggtacccaacagagtatactttaaaaactgagcaacataaaatctatgatgtttagaaatctgaaatagttgagtcattgtagtacttctttgagtctcttggcctaacagtagtctgggcaatgctactgtgtgtggaagagccaaacctaagtcacagagatcgggtatcttcctgctctgcctcctctcaggcctttcttttgtgtgtcacaatcttcctcctaccaaaaggaaaaagagagaatgaattagtggctaatcttggagaaatagcacaaaataggagtgaattttaaagagcccaatcaggctgggtgtggtggctcacgcctgtaatcctaggactttgggaggctgagaccagtggatcacgaggtcaggagttcaagaccagcctgggcaacatggtgaaaccccgtctctactaaaaatacaaaaattagctgggcatggtggtgcatgcctataatctcagctactcgggaggctgaggcaggagaattgcttgaatctggacccggggggccgaggttgcagtgagctgagctcatgccactgcactgtagcctaggctacagagggagactccatctcaaaaaaaaaaaaaaaaaaaaaagtcaatcagagaggaccaaaaataaaaaaaataaaaaaaaatgagtagggatgatgatgatagatgtcagaagtatttagagagaggaaaaaattcttttgtccttagcagttcaatgatctgttcaagaaaatgaaataaaaatattagctactggtaagatatcttaagcggcaagctatttatgaacttaagttactgtatctttgtgacaatgttcaatgaaaagtgaggtgaaatagctatataaaaagtactgaagtggcagaatgagctccgtaaaatgttagtaagtgaaacaaggctgtgatacaatcagctcactaaaatgaaacatgagacagtgagatttttgtattggcacatctatttgtattaagtttggagaagtaaaatatattctctaattttgtaaacctcttgtactcttttttacttgaggaccacaaagcagaaagattaaaaaaaaaggaagtgaagcacatacttaggcactatttgttaagaataatgtgctacgtaattaaattattatgaaaatagcaagctggatagatgataaagggcctttagtctgaaccaggtgaactcaagttgccctttaaaatggactttctgtcataaatattaggatagacctgttgaaaaaatgttggcagtatttctgattaatgtgggaagaaaagctctattcattgactgatttatttgaaatcagatggggtcagttaaaaaatatttaatttgttctcttgaaacactgaacccaaaagaaatgaatctgaacttaaataataatctttgggcaaaaattgcacacaattttgattgctttcctaagtgtcatgtaaacaccaaaacattaagaaagagcttctaatgataggaggattgatttccgattcactaaaacgtcagccttaatatcttgcttctacctctgatgccagatgttcgtacctaattaagtactttaaaatggttaaaatagctcattttctgaagcagataaatattccgtaacattcttgtttatattatttgtatttttttttgtagtttaaagataaacttgtaaagtcaagtaatacaactcatacaagttgtaagtcggtgaagtctaaatttaatgatacaaataaatacaaatttgtagaaattatttatatttaagtatttttatcataaaaaaatcacagttattttaagaagcaagcattccttgaatatgtcttctaaaaaaatcctatctgccaagaaacttaaagttaactgtttgttttagtgacaaatggggaaaaaatctgaaatgatggtgttttatttactcataggtgttttaagtctctggaaatgtactttttttttttttagaagaatctgatttatacatgttttaggagcatttattcaacaaatatttactgagagtctaccgtatgactcagtaatggatgtatcttattattactgtaataagatactgtattagctgctgagtatgcacaagtgaaccaaacaggaccccgcaaagcagtatgtgcctttgcacgtgcacttgagaaatcctagttgttgctcttgcttagttgggatccctgcaaccattgggggagcaggtttggggtaaacagacttgaattgggtgttctctgtgcattttgtttatttagttcatgttggcaaattactattttaagtaaagttgtttccctaagcattaaaaagttgttttttttttgtagcctgaatgggttccagggtggctctgccttgaccagctgtgctgtgtggtcctaagtcaattcccttcccttgcctggatctgagtttgcctcatcctccttgtgagccagccatgtgagagtcagtgagtcagtgcctgaactaggatggctgttggggcaggtggatagacacagtttctttgtgaaaaatgaccccttaactgtcacttgcttacactgatgattagagtggagagattaaaaaaaaaaaaaaagtcatgcctcttagttaggagataaacattttaataaatgacagaatcactgggatgatttgggtctcagagatgagtaacttttccacagacacaagaaaaaagtatttgtgaaacttttaatagaaagcatttatcaataagaaagaaacataagagaaagctgaaaatgttagttaacttatgatgtttgtgtatttgccaaaaacatgctaatcttgacaagtaggattcagtggaaaccaaacgttgtacagtgtgtgtctaggaagaaccaggtggtagaggagctaatgaatgaacttttattggtgaatatattggtgtagacgttattttaaacagtgttcctcttcttatggattgaggcgataagtgcattttcttctgtgttttgcacatgtggaaggggaggggttactgctagactggaagctaagaaccaaaccgtgactgctattggaagaaaatgtcttttcttcctgcatatacatctaaggagggagaagccagccttgaggatcaggacagactcttcatttctgggcagtataacaggctttacagctgagcagggcaaactttttccttctgcaagccctgccctagggcattaatagatatgaataaatctttgtttttgtatgttggcagtctgcagaagcttgggtcactgcaattctttggaccttttaatatgctttagtggtgtttgtgaaccagggcagcattttacagggaagatgaatggggtgtgtggggtggtgggcagcactccccttgactctttctcttccacaccctgctggtgtgggaggagtgatatgggggtgcttagtgtctctgaagagctctctactccaatccttggaaggaaagagcctggttggttccccaggaatggtggctgagggtcatctgtttagacctgaactggttttgtgccgaaggagcaggcaggatccttgagcctgggcactgtccaagactggggtctgggaaggaccctcatctgggccagagtcccaatttataatggaaagggtgctttgaactggtatgttgctgaagcatgtcaccttaggaacttagcacagtgatggaagcccagatatgaactgggatttaggtttcagctctgatcattgctcttagcagggttgtgaatgttggctattgacagctctctctgccttcagagcaggtatctggaaagagctgttcacattcactgtgtccacttcctcacctcacatctcttgtctctccacagcccgctgcaatctggcctgcactcccaccaatccatggacactgtacttgattgctaaatctcatgtgtgccttcactccttacctgagttgacctccgtgctgcaattgaacactcccttctcaaagcatgctctcctcctttggcttccaggacatgacactctcctggatttccttcctgcctgggttttaccttcttttcccagggctctgtccttagtcctctgtttctgtttctgcttttatggcctcatagaagtggcagcaaatggtagctgagagcttgggctttgccactgggctgcttgggttcatactgacttggctttacgtgctgctttccagctgtcacttaatctctctgctttggtttccctgtttgttaaaatatgatacatgctggtgaatagtgtcctgagagttcagtgaatgctgaaggccgccatgagcgcagtgcgcatgcctccttccgtgatgctgctcggaaccaatgtctttatttcagcaacacccgaacacaacacttggcacctaagcacttagtgaatgggtatttttttccttcataaaactcctgagaggtagctatataacatttctcattcttcaaatggcgaatgagagaccctaagtaggttagtgactgatagaaccacataggtgaagaactggaactcactcattgactgcagatcattcagtccccagcacccttcacgctctcctgtcctcatcactccctgagagccctgggccttcaaccaagggcttgtgcaaggaggaaaggcatgaggttcagaattcaccacttctcactcctgagacctcaggaggtcacttaaatacctaagccttagttttccctgtctgttaagtagaaataattatctttgccctgcctgtcattcatgattattgtaggaaccaaatgacataatatatttgagggcacttgtaccaaggtggggtattttaatcatcttatagttgtcttgtagtttataacttaagacggcctgaagcaagactgcccagattcgaatcctggctttgccgtttgcctaacctccctccgcctccgttttcttatctgcataaggcaataatagttctttcctcatggaaactgaacctaaatgagttagtacatgcaagtgttaagaacagggcctggttcaaagtaagacctcagtaagtgttcagtggctattattatctgttattacattttggtatcagacaattaccaaatgaaagttatgtttcctaactgaaaaccctgactgaatgtggcaaaatcttcaagtggcagaaacaaacaaaattgttgtggacattttgctcaaggtcatgtcagacttctgcttaaaaaaccccaaatcctgttttttttaaatcagatatctcttgaagcttaagactactgggactgatgtgcctacgtgtattttagagtcagggttacttgttgagctaaccttgtttcatgaagtgtgtacatgagatagcactgcagtgcattttgagagaacattgacatataagagaaacagaaaggttagatgacttagattagtatttttggagagtaaattgaaattataataacttctatttctggtgtgatttgggttggtggaagtattaacttatttgtgtcgtcgctaggtttatttcttgaccataacattttttcaaaaaggaactaaaaacccatcttttctttaacatctaaattccttacaatacaagctgtggaagtgtttaaattagcagtactgttctttggaagtacagagttaggatgtagcataccttaattttgtgctctttgaatttgttttgtaggaagtctgcggtcttgcagttcttcagactgctttaataaagtgatgccaccaaggaaaaagagaagacctgcctctggagatgatttatctgccaagaaaagtagacatgataggtatgatgtagagacagtagatcagaatcagtgatacatatgtcgaagatgcacatttctacctaattcagtgtgggtcttctaagtgtgcaaatgccaagtggaatgggctttgccagtcgatttttcaaaatgtaattatttaatcatgtttattttgtgttttagtttaaaaacgtaagaacaaattaggtaatttgaattcttagaagttaaagttttatcttaatccattgatcgcccaaaactggtgcagagttgatttctttcctttcaaagccttgctgtctgtgcctgctgaggaccacagaattggtgtcttgttctttaagcaggtctcactcattcacttcaaccacagagctggagagatcttcctgtacttaatggtctgtgcccgcccagaatatcagccaagctgaggtttattctcacatgggtgagaattcgatagaactgtgaaaaacaaggctctttaaatcgcttctctttcagataagtgaacttgttaattttggtaactccaagggcctgttagattcgtttatttcaaacatctttattgtttcaccctgagtttagtaagtagttttttcttccttgtttcagaaacaacaaacgaacatcattgtctagtcttttctacctttctccatctttccccattctggctttgtgggtcatatcactaatgggccagaatttccacatgtattaatccagggaatttaagtgagatttttctgtttctttcttgctgtgactcagaggaataagaaagactctgaaaatgtaaaaataatgtcattgtttatatctcaaatgaatagaaaatattatctgaaagaagatagtagtgatttagaaaataatcaccagcaatctttaggccagtgatttttcaactttacaaaggcaggctactttgatacttttttggtggtgtggacgttattatcagaattgttaaattctaacaatcacataacattttgtgactttgtagcgcttagtattttctcaccacagtctaataaaatatagtatgataaagccagatttgaaactggcagtgtagttgcagtttctgagtttcattcttggcctttcttttttaaacaactttatttacataccataaagttcatccattttaagtgtacagtttagtgatttttattaagttaactgagttgtacacaccatcactacaaaccagttatagaacatttctattatcccaataagatccctaatgcccattcagccactcccagccccagacaaccactaatctactttgtctcgacagatttcccttttatggatatggtctttgtgtctcgcttctttcactaagcatgatgtttttgagattcttgcatgaaatagcatatatcagcatatcattctttttatttgctgaatggtattccgttgtatgctcttggttcttttttatgtatttttgaataatttatatagtgtctccaagttattgaccatttacaggctttgagctgagataggaatgcctgggcccagaattagatcatatctatttgaacacttggccggtatccacttttgtttctaggtggtatggctaccttttatagaagaaatacaaaactgctggtttgcagtttcagtaacctaacaccttattataaccatgtactttttttggtgttaaaacccagaaactaatcagaggcatatactgataatcgggtgagtgtctaggtcatgaatcaatgttcaataaaaaagaattataccaaatgtccaacaatgatagactggatcaagaaaatgtggcacatatacaccatggaatactacgcagccataaaaaatgatgagttcatgtcctttgtagggacatggatgaagctggaaaccatcattctcagcaaactatcgcaaggacaaaaaaccaaacaccgcatgttctcactcataggtgggaattgaacaatgagaacacatggacacaggaaggggaacatcacacaccggggggcctgttgtggggtgggggtaggagggagggataggattaggagatatacctaatgttaaatgacgagttaatgagtgcagcacaccaacatggcacacgtatacatatgtaacaaacctgcacgttgtgcacatgtaccctaaaacttaagtataatacaaaaaaaaaaggattatacagttgactgttgaacaatacaagtttaaactgcacaagtctacttctgtggatttttttcagccgaacagagatggaaaatatactattgagggatgtgaaaccccacctgtatggagcactgacttttggtatacatgggtcttccagggctgactgggggacttgagtatgtgtagatttgggtataggtgggggtcctggaaacagtcccctgcatatactggggaattaccgaatattattttcatattcttacatactatgaaaataaaaactgtatttataaatgcttatatacaccactaggtaatttatatataagtaagggatataaaaatgtatatacttataatttttatatccatatcatcattttaaagctattgcctcctcttccctctccatgtgaggagtatcaccttcctcagcccctggttattatgaagtatgtcatttttgtggaaggtcacagttgcaacaggaggctgctgtgcttcctgattcagttctctagtttatgctgggctgtccacaaggctagaattagaagaaaaaggcagaagctagtttctctatacttctgtctcctgaggtttctaaggttatactaatcaagaaaccacccaagcgacattgtctttgtcagccttacatcaaagtttatttttttcccggaagcttggacatgatttgatgtttctttttatttgcttagtgttctcttgagttgtctaatattgagagattcttccttagactgtgttccgtgcccagtctaacttgtaagacacagaagacagacatgagttgtaggctacattaataaatgtaggcaagacatttcttgccatatctcaccattattttgtagttctggctggtgaggtagaagggagtatatcaaatacctgttctgttcagttcttactgattatttgttaatcagagaaaaacttgtattaagtgcttaccagttctatattaggagtgactgtgtttaaacactgtagttaaaagctgaagcctgcaaatgcaggaaataaaacgtttaaaatatacttaaaatactgattgaatagatgtctggtttgggtaaaagaatataaattatctgctactttaaagaactcagtatctttaaataacttaaaactgccttttcaatttccagcatgtatagaaaatatgattcgactagaataaagactgaagaagaagccttttcaagtaaaaggtgcttggaatggttctatgaatatgcaggtaggtattcatttgtatcatctaagactgatccttatgacaataaggagtaccttagagatgattaaagaatttaaaaatgtgtacatttcaaatttgggtgtgtgtgtgtgtgtgtccctgttagagggagagagggacatagctgtaacaaatcaccagatagcctattttatagccagcagctaagccaaataattcagaacactagaagggaactgaaaagatgaaatgacttgggagaaatactttggattgctgggaaacctatttggaatgctgataatgggtgattatttggtcaaagcacctgtgttaaaataagctttgctgctttgaacccttacttagtgcagtgaaatttctttatattaagtgtttctatttggaaagatcatttggcagaaaatgtttgttttgtcacttaaaatgttttaaatttagtctttctttttgcaatttactataattggttgggtaatataatgttgcgacctggggcttatttgttattgtggctttgtatggtgtaaaaaagaaaaagaaaaaattttcaaacaagctcaagctgaaggctcttttatctttcttctttctcaccttatttcaggctcttttataacttaccaactggctattctagcaacctttaaaccaattttcctgtcatctcctctccagacaacctgccatgtgccactgttgtctaatttttttaaaactaagctgagcagatcatacatacattcctgaacaacctcaaccactcccctctaatcccaaccctatctcctggccaaaagaatccctgctatctgcaggataaaagagagtgaactccccgtgcctttgcctgaaatgattttctccgtttttccatctgacatgctcttacatcttttaaacccttaattaccttagtagccttttctgtacttccacaggatagtgtttataacttgttgtaacttgttttggttcccttttattggtatcaaaatgaggaattccccctgtagcctgatctggctatttttctcctattcccatgcaaccctttttgtgataagagccttgcccctgttggccacagagattggtctaggtggctggcacataacccaggccaggccagtcagacaaatcttcacaggggttttcagattgaagctgggaggatcatgtctttctcttctggtggaggactcgagaggttatagttctgattcctgtagttcttctttggacttttatgagctaccccaacatctttctaatggattctctgtcatttctttaatgagtttgatctggattttgtttgcggggcatggacactagtgcaaacacatggatgctgttagcatttgtctgttttcatgtttacagacaaattaaacatgagttcgtttgattcattgaacctgaatctcttggaaacctttagaatttctagtaaaagtgattgacggctgggcgcggtggctcacgtctgaaatcccagcactttgggaggccagggcaggaggattgcctgagttcaggagttccagaccagcctgggcaacacggtgaaaccccgtctctactagaatacaaaaaactagccagttgtggtgacatgcacctgtaatccctgctactcaggaggctgaggcaggagaatcactcgaacctgggaggcggaggttgcagtgagccgagattgtgccactgcactccagcctgggcgacagagcaagactccgtctccagaaaacaaaaataattgacactgtaccagatattctgtaaataggttctgaatgaatgaagagcgttctcatattcttatcacattgattatgaagatctcttgctttcctatattgattcacatttattgttatgaaaatgttttataagaaggaaattttaaagaaaaagtacacttaatcccatcaccatagcatagctattctgattttttggtaccttcctttataagcaaatacagattttttcataatataagccaagaaaatagcaaggtgtgacttttcttcttgtttgcctttctctgactttagaagggtgacattttggacataaagattaagctacattatttaggttccttgaaatccctgctaagtccttcgttttaactgaacccttcaagaaatttgtgtggaggtgactattcctatttttagccacccccttctttttcccccttttgctatagcttgtccatagggaaaataactggcattgggaataactgaaagccccattggcatgtgttttcattttgtgtatctcaaccacataaactgaaactgtaggtcagtattagtcaagaaaaatgaatcgtgagaagaaccagtgtgactaacaggttgtgctgtaggatgagtctgtgggaacaggctgtgatgccacagaccccctagataccagcacgaagagggcttgtaaatgaaattgagccatgttcattttccgtagaagagagcaggctggtttgggctgaggataaatgctgactccctgccttttaatctggagtagagtggagtggaggggcagcgggggcctggtgtgtgattatttcacatggatggaccttcagctcttcccagaattctcagttccactttgtaccttgccctctgctttccgtggctcctgaggcctgagcccagctcttccaagtttctgtctggccagttaaccccagtcatcctctgcacattctaggatgcagcttctcactttctaaaatctccaccagctcaatttctgatctccagaaatataatgaataaacccttcttcgctgggggcttttcctcctgttctctggttgtaggtgtactccctttcacactttggtactttagctctctgtgactttagaaaggatcggctgggaggttcaggggaagtgtttatttagaccttgatctgaacctggaatcccattttgtttcattagaatgaagacaaccaggctgggcatggtgactcacgcctgtaatcctaacactgggaggtcaaggcgggtggatcatgagatcaggagatcgagactatcctggctaacacggtgaaatcccatctctaataaaaatacaaaaaattagccaggcgtggtggcatgcgcctgaggtgccagctactcgggaagctgaggcaggaaaatcacttgaacccgggaggcagaggttgcagtgagccaagattgcgccactgcactccagcctgggcaacagagtgagactccgtctcaaaaaaaaaagaatgaagatgaccagtttacataatttatctaataacttccactttttgaaatatatctaagaataaggaattaaaccaaatacacaggtgccaacattggttttacagttatactaaagctcacatacataggtcataatagttctacaagtcctgactgtaggcccttagtctattttggattaagttctatagcagaattgtttggtttaccaaaaataaagtcagtcatggacagttgcaacaaataataaactggtctgatagcgaaggaagagatgttaaaaactacctaagagaccatgtgggccccatttgcctctgtgatgtggtatgctataattatggggccattatgaaaaggtcaaatatctttagttaggggcccctgcttaagatggcagggaaagtggaaggaccacttctttctggattattgtcagtatatcagccttaccagatgtacctccagtatcttgtcacctagggcattttatagcttattattttagatacaagttaaaaaaaaaaaaaaaaacaagaaaaaaaaaacctctctgtctcaaacttcacttctaacccactttgtgttagccagtggtgtatttgttagcttgcttgacagaggtaattaccttaattctacaggtaaatttagtgtaaaatacaactagaatcccaacaaatcatgcaattacaactagatttaaatgtgtgcatgggaaagatgagaagaaaagtgttagggctgggtgcagttggtcacgcctgtaattccaacaatttgggaggctgaggtaggaggatcgtttgagctaaggagtttgtgaccagcctgggcaatatagtgagaccccatctcttaagaaaagtgttagatggcagggttattggtagcatttcaataatgttgattggcaaactatattttaacctattttggataagatattactttgacagtcatgccattgcaaattaaaatcttgctcttctaaaacacacagacacatgtatttataagtagtacagcaacactataaaattgggaaaaaagaaaaagcattaataacttacataaccactgcaaaggatacctcagtagaccttcgttgaggtctggggtgcagtcagcagaagcaccgtgctcagagttcattttcccatgtggcaaacaggcaaataagtagagaaacattacctttatggtgaacattgacagaaagagaaggcagtagccaggttggaggatgcacgacggggagaggaagccggggaacacccaagccatgtgcagaggcatggcaaatgcaggcggcttgctaggctcaagaataagttgcacaggccgggcacagtggctcatgcctataatctcagcacttggggaggccgaggcgggcggatcacgaggtcaggagatcgagaccatcctggctaacaggtgaaaccccatctgtactaaaaaatacaaaaaattagtcgggcgtggtggcgggcacctgtagtcccagctactctggaagctgaggcaggaggatgtcatgaacccggcaggcagagcttgcagtgagccgagattgcaccactgcactccagcctgggcgacagtgccagactccatttcaaaaaataaataaataaataaaagaataagttgcacagaaagagcttttttaaattaggaagaatagaaaccaaagagagaggaattttaaaagaattacaaagtaactttcccccccggctctatgcagctgcttctcaataagccatatcagtagataccaaaaagtatctgttgcttaaaaaaaacacccttaacaaaataggaatagatgaatatttccttatcagaatattcttcagtctcacagcctaaatactttagtagaatgatgaaaagaactttgattcatatcaacacacatatgtacacttacaatgggataacataaaatgtattaatattagctaagaagaatgaagtagatgtatgggtactgtcacaggaagattaccagacacagtcagtgaaaaaggcaaggtgtagaattacaagtacctcacaaacccatgtgcgtaggtgaacaaatttgaaaactgcattttagtatatatttgcccatatgcagcaaaaaggtccaggaggatactatcatgtcttatctggtaaagaaagggagaaggcaagtttctttttttttactgtttattttattctgtatgttctctatttaaatattttgtcatgtgaatgaattgatgtgtagtgtgtctaatacatacatgaatgtgcacatgtggatatatgcactctcaaaccaaagaaagcaggcaatatattgtgtgataaaatgctaaatgtcgtatttgagtcaagaatgagataagaatgtccactctcactactcttacttgccattgttttggaagctactaggcactgctgttagacaagagaaagaaacgaggagtgtaaatattggaaaggaggagacagaaatgatcattgcagatgaaatgattaaattattttacacttggaaggccaaagagaattgcctgggcaaacttagaaacactaaataaatatgtatatattccatgcatatacaattctatagatggcttattttgagaagtgttgttaaagaagctctttaataaatagttgtctctgcagagtagggaggagttagaggggacaacttcacttttggaacattttattttttattttcaaatgaaactttgtatcatgtttatgtattaatgtacaaaactaaaatagtatttggttttcttctgataatcaagataagaaaactaggaatatataaatatatatatttatatataaatttatatttttaaatttatgtttatacatttatataaaaaggggatagaaggggacaaaaccccagaaaaaagtaacagatttgaatatatgaagtaaaatattgtgtaatgaagtagaacatttgtgattaaaaggaaaataatggcaacaagaaaaaagtatttgctttggccagattatgaggaagggcctgagtttgaactttagggggagccaaggatttgaagcagaaaaatgacgtaagacttcccagcaggagctccgggtgactttagtgttcctcctttgttaagaacagccaccttatactttgtgttagtgaaagtcttgttgttactttgtattgaggttactcctgtactttgtctcccttcatggagggcagggactgtttgcaccctaggcaactactgcagtgcatagctccaggatgtgtctaacaaatgttatgggaatgaaatggatacatactaagaaggtgaattctgctggacttggtgacttgctaaatctagagggtataggaggattgtagagcgtttcctatattctggtattcagccattcatttagtccttcattcagtttttattggaccagctattctatgccagatagtatgctgagcttgtaagaagaataaaggaactcttgctcttgagtttagagggaaagacagatgagctgggactttgaatgcagtgtgctaaatgtgtgagaaccattcctagcattgcgaggggtcacagtactgcctgacccagcctctgcaggtggggagattgtgaggactactcctttgctctcagtcttaaaggttgaataagttagccaggggagttgggggaagggagaggaggggacaggaaggggactagaggaagacaggcagagacacaaagagtaatactgtgctgggtgtgtgttcggtggtggtgcagagtgaagccacaggtaagtaggtgtttctggaccttaattttttttcatccagcaatatttattgattcatttacttctgagaaacttgttttgcagttggaaagatgtaagactgaagagggaagaaaggcactagatcatagagaaccttatgtgataagccaaacactttggattttatatttaggctctagggagccattgaaggattttaagccagcatgggattgcgtttgaagtggatcccttcagtggctgtttgcaggatgggtcggggggaaaagactctggaattaggagatcatgaggagactgctgtagttgtcaagaataaagccttgaaagagcatggtgcaggagaggcacaattaagaaataattagaaggtaaaattggtagtacacttgataattgattgggtgtgagagaaaggaggaatacaggaagactcccaggtttctatttctgggtgtgccaccagctgggacagcatacaggaggataagcaggcctgatatcgagagacattgggctccgttttagtgaggcagtgtttgaaaatgtgaaatgcgggaggagtaggtttgaagcagaagatgagtgtagttacggcagttaaacaggaggtggagcagctagtgataaagaggcaagtagttcaaaagtaaggggaaagtgtggtctagaaagacatttgggtaggacccgagaccttgagtatggttaaaatttcctaggaataatgtatatagcaggcactagaagaggtttaaggatgaatctttgcacatcaaatttaaccatctgggagaagcagaagaacccataaagaagccagaaggggagaggaaggaggaaagccagatgagagagggtgcttcaagaagccatgggaagagacagttttgtgaaaaaagaactgcttcagattttcagatatcacacaatggtcagataaaacaaagactgaatttgtctgttagatttgacatttaggggcttattggagaccttggcaaaaagaatttcagtggagagctaggagaagaagaaaccaaattccaatggttacaaagtgaaggggagataaattagagatggaatgtgtggacgcttccttcaggaagaatcagagctaatgctagaacggaaaagggggccttactgtctttatcaagaacagagtgataacttgatttttttctatgtaaaagaaacatttatgttttttcttatttaattttatagagactattatgtggttctttgctatgtttccaaaaattattttatgtattgaaattattacccaagtaagagtagaacattaagctgttttaaagagcaggaattgaattcagccttaactttagacaaatggtatataccatattccaacgattgaaggacatggtgataagttgatttaaatgattgtacaaagtagagtcctttaaagatactgaaattcgagaatacttttcaacttagacttgatttttttttccaaaaggagttaatggcctttaagtcttacttgttgacagtataatactactacagtggtaatagtatggtgtgcatggtcagatttaatttacataagactgtatttcacaggaactgatgatgttgtaggccctgaaggcatggagaaattttgtgaagacattggtgttgaaccagaaaacgtgagtcaaacttactgagttgggtgaatcagttggttgtttttcatacttaaatctttgttctttagcaaataaataaataattaaaaagtagtggtatgttagtttttatgaagcagtctaagaaataagttctaattctagtttgacttataagcagattctccattcttgtaagtgatatggtgtaactacagttattttttctctcatttaatttcttgtatgtaaaaggtacagtaagccagatgcttacaaaatggtgtggccacatgtgcctacaatgacggatcaactggaggccacattgtacgctgtgtaccttcgtgcccctcagtagttgttttagcctaatgtagagtcaatctaggacttataattattcatcatgattttgagtagattgtaatcatcaagaatttttcatagatcgtttacttccaattgaatttagctcagaagtgattgcttttttttttttgagatggagtctcgcactgtcgccaggctggagtgcaatggtatgatgtcggctcactgcaacctctgcctcccgggttgaagcgatttcccctgcctcagcctcctgagtagctgggactacaggtgtgcgccaccatgcttggctaatgttttttgtattttagtagagatgggatttcaccatgttggccagatgtctctatctcctgaccttgtgatctgcccggctcagcctcccaaagtgctgggattataggcgtgagccacagcacccggccatgattgctttttataatgtaaaagccctaggtatttatttttaattagagtgatttttataagcttaattatttttgcctaattcttagcatgttattgttgaatattttttctgttcctacatcacctctcttacactaaaatgaaaaactatgcttatacacatgccctgcctcattaactatgcagtttgatattacattagctccagtttaataaatatgtccaagatcctcaatgaatttgtgatctgggaagagatctcaagagatcattctcttcattcaggctgtttccaagacatctggtgcccaggcatgtatgtcatgcttttaaagaaactagcaaaattcacatttttttctttaaactttttattttacccttaccatttctgtgcttctgtcatctatcttggcccccagcagtgctttaaattttctaaagagcctttggaatgtctttcacttattacatagatttttatcttggttttttttttggttttttttttttttttaaatgtattccagttcaggtatttcaataaattacccaacttggcatgaaggtttggggacacctgggtcaatagtattttgccacagactgggccgtagacacaagaaaagaccattacattgaatttaagaaggaagttttctatgagaactgggccaagcttggcagagtgttttctaaacatgtagtcagagggctgagagtgagttgggcttgagaggggctccggaggttccacatggggtaccgtagtaagtatatgacagaggagtggcagcagggcctgggcttgaagttagaggctgagaagactgggagacaaagggcttgctggtatgtgagggattagctgagcatttagtctcagaggcagaaaagcctgtccaggatgggagagcactgacgttgactctaactgaagaagaaagggaggcacagctcttcaagtttcctcacccccaaataccagtactcaataaaagatagttattgtcattcttttttggcagttatgagtcctttagaactctatttctggcctggcatgatggctcacgcctgtaatcccagcactttgggaggccgagacaggcggatcacctgaggtcagcagttcgagaccagcctggccaataaggcgaaaccccgtctctattaaaaatacaaaaattagccaggtgtggctacttaggaggttgaggcaggagaatcgcttgaacccaggaggtggaggttgcagtgagcagagccgacatcatgccactgcactccagcctgggcaacagagcaggactccatctccaaaaaaaaaaaaaaaaaaactccatttctgtaggaatagaaatatccttaaaatttataatcatattaaagactaaaagaccatattatccaagtatgtaggccaggcgtggtggctcacgcctgtaatcccagtactttgagaggccgaggtgggtgggtggatcacatgaggtcaggagttcagaccagcctggaaaacatggtgaaaccccatctttaataaaataccaaaattagccgggcgtagtgatgtgcgctagtaatcccagctactcaggaggctgaggcacaagaatcacttgagcccaggaggtggaggttgcagtgagccgagatcgcaccactgtacttcatcctgggcaacagagtgagactctgtctcgaaaaagaaaaaaaagagagaatattatccaaatatttatactgtatgtacttcaattccaagctgtcaccaatagaagttgtattattttatatcactaagaaaaaatgtgctaaataaactctgatgtgctatatcaattgtgggtgcattcccatttcagagacattaacatttgtaaaacaagtgctgaaatatggtgttttcaagccttgtctgcattgatgggcaagcacgtttaaggtatttaaaaccctcactttgcctgatatttacagcttatgaaattaagcaggcttgtaaaattcaagtctatgttcatttaccaagataacagcaacattctttatttaagtacttagatttcttgttagttaacttatgaaagtctcttttttatgaactttcccattatgagtacctgttttggctctttagccatgtttcattcatgcttgtgtgtgtgtgttcttgcaccctcaccatttttttttaacttaacaagtgtttatgtagaatttttaaatctttttggtagagagtagaatagagatggtttgagaatacctagtttgcattagaaaatgtgagttggttagttgtcctaggtaaatcgatatacaagagtcagaattcctagaaacctgagggatgaggagaaaatccactaatgtgtgaataatttgaagaactgtaaccccatctttttgggaaattcttagtagcaccttggtcttttaagtcaccactttaacctatttaacaatcattgccttttaagcagtcattactaatcagtcctagtaatttacctagtaatctaaatttttaatccaaaaaaaacctaatgactttcaaaaaattgatatgtactaatttatttgatgaaagatcctaaaaatttcgtaggttctcactgatattaatttccagtgaggaaaaccataaagtcagcatcaagcgaaagcttctccttaactcccctgcatgtaaattagacaaagctagagattttttagcctacaaactagcttattggcagacagattaaaaagaagagcttctgaatctcctaactactcttgttctagagtttttaatggacatgttggctctcggaggctcagaaatcattaaaaatgatttcttgcctcatgtttcatgtttttatgtcatcttagttcctttcaccatagccgccatctgacccagttgggcacagggatggtgttttaatggttttgaatggttctttcagtagctgaaatgaagccttaggctctacgtaaagagatcaaattaactgccagtgtcggatatcctagtccttggagaaacatgtgtttatctacctattgcctttttctgtttcagcacagagagagagcccattaacagtgtatacctgatccctaatttaggagttgggtgttccttatgtatgaatggactgtccagagataaccagctctacagagtggctggcagaatggtcctaagaaggccctgtccctcttctttacctttttaggactgacattcttttttagttacttctcacctcttctaggatctttgaggtagatgagaaggaaggcttcctcctcctgtcctaatcaggcatggcctcaaccctgtccctgtgtagcattccagatagcttaaagctgggtgcacctttgaaatgtcattttgtctttacacctttaggtatttattaaaactcaccatcagttccctgtgctatcttttctctaaaatagctaaggaaaaagtagtaagcagtggcataaaccagagttgtcactgtttctgaaacctgcatggtttcagaagagtcacaaaagcacaggtggcacctgggggcctgcccctcctttacaagtgatgacaccatgccacagaccctgggcccattccaggcatagtgctgtcttaagtggaatgtggggctactttaaaataatttcccaccagtgtatatagtgaattcacaaacattaaagtatgtgtgctacaacttcactgcgtgtctccccctgtccaccttgttatgttttaatacactgttctacaccttgctgtttcacttaatacatcttggaaattattccatatttgtccagctagttctacttcattcatcttagtggtgtcatagtattcctttatatggaatgtattcggcaaagaagtatttaaccagtcccttattaatggccatttggttgttttcagtctttaactgctacaaattgtactgcagtaaatactgttgactaaaattcatctttgtgtctgtttacaggtagacctataagataacttgccatgggtggaattgtcaataactggttttacatttgatattgccctctggagagggtgatcaccttacacctccactatcgtgcatcaggagaatacatgcttctccaaactcttgtcagcagactatattgtcaacttttttagatgtttgccaaactagaactcatttttgaagttaactctgctcatatttcagtgactaaactactgtgaacagaagcatttagcaaaacgttaatgtattaatgacagatctatttgttttttctttttaatttgtgtaatatatttttttttaattgtgtatttttttttaacaggtagttatgcttgtcctagcttggaaattggatgcacaaaacatgggttattttactctacaggagtggttaaaaggaatgacttctctccagtaagtcctaggctgcactagtgggggtccctgcccttcccaggtggttgcctccttcctccctaggacttcaggaggtgattgagtgagtggaaggaagtcaggtggtctggccaagcttccccagtggccaaagatgtaaagactaagacccattttgaggactattctgggcaaatttataaagtgtctatatgtgtatttggagcgagagagtgtgttggtattcttgtagagcagctctctccaggagaaacagaccaacattttctcatacgagaaagccacctctatgtaacttaagattttttaatagctacatgtaaaagtagaaacaggtaaaatcagctttaatctattttattaaccccaaacagtccaacatattttcattccaacatgtaatcaatattcttaagaaatcaatgagatatttttatattcttttttctcatggttagtcttcaaaatctggggtttattttgtgatccatctccatttgtattaaccacatttcaagtgctcagtagtcacatgtggccagtggctattgagttgaacggtgcagttttagagcttaaaaggcaaagacttactggcatctggtttatacttagtgagaaaaagttgagtaatgtataacttgtaagttaaaatatttgatatctctatatattctgattttagctttgggcaaaattaaaacttcattactccagtgatttaaaaaattaaaaagatttggtttgtgtaacctgacccaggataagaaaaatcagtggttttatgtatttgccttgtgtatgcaatatgtgcgtgtgtgcatgcgcctgtgtgttgtgtatttgctcagtttcattcaagaaaacaaattgtcattctatattaggccttgaaagatacagttgaagtggataactaaatgtttcaaatagcattgacgatgaagtgctaattcttaacatagtaattttaatctaaagtaattgggatgactttcttttcactttaggaataatagatcttgatttttactggattaaaatttgagttgaaatggttttatttaaataattttggaatttgtccacttttaatatcactgtccatttgttattgttgagaatgctttcgcattgtgctttagtagtttatgaagactgttcactattctcccatttgaatgcctcatagctactttgtgaagaagacagatcagattttatcctgaacatgttacaaatgaggagactgaggcatagaggggatcggtgatgtgtgaatgtggcagagatgggaagaacacttaagacttctgattcttaaatcacattcttccttctaacaatattatctgatgacaaatgagttttaggtaaaagccaaaccacccttttacaaatatactttcctatcagagtgtgttctagaattttagagttaaattctctgaaatcttttaaaacttgtgtatccttttgggggaacatctccttatgattttaatcctattcactcgttttttcattatttttctcacttttcttcattgcttcctttttcttttcttttcttttcttttcttttttttgagacggaatgtccctctgtcgcccaggctggagtgcagtggcgtgctctcagttcacagcaacctccgcctcccgggttcaagtgattcttgtgccccagcttccccgagtagctgggattacaagcagacaccgccacgcccggctgatttttgtatttttagtagagacggggtttcgccatgttggctaggctcgaactcctgacctcaagtgatctgcccgcctcagcctcccaaggtgttgggattacaggcgtaagccaccgtgcctgaccatcattgctgagtagagcagccgatggctgctttttaaagtgtccttgtgatgatgaaggcatgggcatatcaggattttatttcaagccttcagacgaggcaccatcaacattttcaggtccatttttatttgtcttaagaaggtgtgatacccagtttgtatagtactgagttctttacgaaagaatgtccctctacaaaagaatattacctgataccagaccttgcccatgtgttttgagggccctatctcctgggaagtgagaagcaatttcctggaagaggtctgcgtctgcgttctgagtccagggtactccttcaggctgtttgttgggaaccttgcttgccactttgtatgatgcaggtggtggcaggtgggttctcagggtgattgccacttgatccttgcaattcagggtttagtgacaagcctgatccactgtaaaggcatggaggaaccgcttgctttttgtggtatgaaactctgaagttgatgtcctcatcagtgaggtggagataattattcagaataacttttaaggttctttgtagtgtcctcatcagtgaggtggagataattattcagaataacttttaaggttctttgtagttcaaaaatagtccaacttcaagtttaagaacctctgcctaccctcccacccccaccttccaacctttctagattagtcatttgtttggcaaatgtttgaatgacagtgatgtgccaagtgtagtattccaggccctagggaatcaaaaaccatgagtaagataaagtccattaagaggaggggcttataaacaatattcagacaaaagatccagaagtcataaggtcacttgtctttatgccagtaaagtaactaaataagcattgtatttgtgaagtatgtgcacctagtacacaagaaaacccagagagtaatcatttatgtgctctaaaggcagaaagtagtcgatctttaaactattttgtcttctattttggatttcttttctatttttgctcattttaattttattaaacctatctaatgaaatattttgatctcaaactagaattaacaagtatagaacaaaatatttttatgtattcatatatgtcttaggccatttaggcagctataacagaatgttttagactgggtggcttataaataaaattccagagaattttatttctctggaggcccagaagttcaagaccaagatgccgtagatttggtgtctggtgacagcctgctttttgattcatagatggtgccttctaactgggtcctcccatgttggaaggggcaaacaagcgcccttgggtctcttaactaatctcattcaggaggattctgcccccaggacctaataatctcacaaaggcaccactttttgataccatcatcttgggggtgaggatttcaacctacaaatttcagggggatacaaacattcagacccttcattatatttggttaaaatgctgttaaaaaaaaaaaaaggttactgtatgatgggagtgtgatagaaacagaaagcccatcggctgtgaaaccagagtttttaatcatttctgtcatttcctgggtgtctctggtagcatccttaaactagggtggtgaagtatggcttatggcttatgcctgggctctcagaggaattgtgtgcttggcttccctagggcctgtgagcctggggcaggacgtgggtggtatgagagtttggacttaggccggcagctggtagggaacatctatccttgcactcctgagatcattcccctgccagagaagacacagctcctgttttggtctgatgaattaagctaattgtggtgcttaaacttaaaaaaaaaaaaaaaaaaaaaaaaaaaaacagtgacaattgttaattaactgcaataaactgatgatgggctggaaaaatactaagtgaaggggcaggggccttttcctgggtaataggggaaagctacctctgattttataaacttcgatgattactgtgttgatttctgtccttacaaatctgttagagcagcaaactcaaaaagaaattatcttacattgtgtgcatttttttgtgttgggaaatggtgttccttagaagcgtggcactgtcactgtgacttctacacatttttttatacatggtacacagaaacatgtgggaagacttgagttgaagatgtgactgctttctgaggtcacattggtggcttacatgtcccaagccaggctctagagtcctctgaagatgtgtacgttgagtggccactagatggcaacctgtggttctggacagggtgactcagcagcctgtttcactattgggggccagtccaggggctttgtgtgttcaagacaccctttaaagcagattaaactctgtattggcaacattagctcccaaccccaggtttttaatgggtaccagagttagtaatattacttgtgttttttatgtttaaagcacaagaactgttcatttcctgcatttcagacaggatctctgagcatctttcaaacatagggacatctttttgccaggatgttgggcttgctcccaggcatgctgcagaacttcacatttcttctcatagctctgcctagagtttacagctaactttattttcttttaactatggggtagttatctaaatgagtgcttcctgctcttgaatctgttaaaacaaacaaccgctcttcttcttcgtagacaggactaaactaaactaccagtcaaatctatggctttggtccttgaccctctttccggtgaagaacagggacctcgaccttatgtttttgggttacccagtttccctcctctttgaccctctccgattattattaatattatattattatatacacaccattaaaaaaatctaaccctacagtagaaaatctaaccctatagtgcgaattcagccctgcctcccaaacttactcctgtttactgctttcttgtgtatctttctagtccctgtgaccccctcattgggattctggcactagatctctaactggctctcaatatctcttttccttcccaccagtccttctccatggagatcaagagtgagcttgtcaagatgcagccctgatcgtggtctttctcatagtggcaggtggcctccattgttcctaggatgtaattttaaaaaccctcactgtggactacaaaagccttttatgagactgaccccatgttcctctcagcatcatcttatacctctttcccacttcctctatccactccagcgacagtggctgtcttttaagtctgttggacttaccatactcccatctgcttctgggcctttgcctatgctgttcctaatagacagagagcctttcccacctctccaaaatatctagttcctgcttatctctcaactctcttagcttatgtgtcattctcttgaagaagtcttttccgactctaaaatagcctaattttaatcttttttattttccacattaggaagaaataaggggctttctaaattgttctgtttcatagaaattaaacatttaatataattgcaggcttttagatagtttatcatatcaacaaagagatcataaggacttatttgtagttaggtacaaagaaggagctttcacaggcttgtttttaaaaatagattcgtgtgctctattatgaaccattttagttcatacagtatacaaaatatattgataatacttggtgtatgtattatctgtacttagtaggttaaagatctatagagaaaatacgtattcagtgttgaaaatctttaatattgctggtgaaaatggtgactcttgattctcatttttaagggctagatattgcaaacaaaattagtttgtaaaaataaccaataagtatgcttgcttatgaaaagtaaacactgtatcacttactggtaaaaacaggttattatcaccaaggctccctggagaaatggctgatttcaagtctggaatagggtaagaacagggtgagctgttccatcttgtgccagaaagcaaggaaatgctcagagacttgtgggggacatgtcagaaggaaattggagccagctttagggggctactgcccaaatggggaaagtttctacaatcaaaaagagtaatgacagtaacagattataacacactgaattagacgcaaaaaatcctaagtccagaaaataagaaggtcatgtgtggagctcttctttatagaagaattatagccaataaatgtagaaggaatgataggattagaaaatcaccatcttgggtattcagatgttactgattcaggcaggtatcaccaatggatgctataaccattgtgtgttgtcaggagtatgtcctccttgtgaggtctttagagatcattccaacctggccacagaacttctactgggagaggaataggagattaaaggatttattttattctcagttcctagagagggaagcatggcatgccacacagggagctatatgggaggagctcccagggagtgggctccgctaagcaggtggggaactgagagagagtgaggacccatgggcaagtgccttccctggatgtcagattggtatgtgtggatgtcactcagtcatagtcaggggagtgtaagaaggggaccttgtggcaggggggcagacttaccgctagtggacttggtctcctgggtaggatgttcattgcttatttgtggggatactgaggcaggaggaaaataggaagtttaagtggtgtacaatacacattgagtgaaatgttattggggactggacatttatagtctcaaagtatcatcctgtagatacttactatttcaaagaggaagaattgcctttaaatggaaaatggtggacaccaccataaccataggaatccaccaataatggaacagggacagacagacatgatgaaggacacacatcttgtcagaagtgttggatctaaatataatcatagggacattatctgacagatggacattctacaaaagcaagtggtctggtctccaaaaatgacattgtcaagaaagaaaaaggcagagaactcttctagagactaaggaaatatgacagctaaaagcagcgcatgatccttgattggatcctgattgaaaacagcagctataaaagaaattggggaataattgggaaatttgcaggtggttgtatatcagctaagaaagttaacattgatacagtagtaagattgttgatggtgttgaagtgcttagggatgaagtttcattatgtttgcaacttttaaatggtatagaaaaatgtatatgtatatgagagagagtacataaatataaaaaaggttaattgctggatcaaggggatggtatatgagtggttatttgctattctttcaacttttctgtacatttaaaattttttttaagtgtagaaaaaataggttatggatgtgtttcaacttcagggatttgttctttcctttggtattgtgtttatattactgcctctattaaaaaaataaataaatgaactcaggtcataatttgcctttattctgtttttctagatgtgatacaacagaaaaactcagaaatactttggattacttaagatcattcttaaatgattctacaaactttaaacttatttacagatatgcgtttgactttgcacgggtgagttctctggagcctatccagatgtttccctctcttccctcccctttttaaattgccttttgaggttagtttttacatgccacagcaaaaaaacttgaataagttaactcccaggatgctagttagtatttctttctacatgtatgcttttgaaaactaagtttgattctggtcaaacattctgtaggtcagcaaaaagctctagtggcagacgtttactggctcttggaattggcttaaaagtgacatgggcatgcaatacacactgtcttaaatgtctcttagataaggttggaaaagctttccttctcacagaacaacaaaccttctcctgttgagtttactagaataagctaatcatatctaattcagattcaccgtgggtgctattattgtatttggaaatcatgtgaattttagacgtaagctaatttcttacattacttaatgtaatacattacttaaatgtatttttctaatcatcgttttgaaaagcagttaccctatttgtcacatagtgagtcaagtcgaagtatgtgaaagtggttcccttggagtgaaataaaaatcttacttttcagcctagtcaccatacatagagaattttgaagcaccagttggcatcatactcaattcaaacaaaatctatatcccatacaattacaatttattctgaaatgatgttttctgttaggtctgtttgtttagtggattcaggtgactaggctttcttgtttgattgcacttttttaaattatttttttttaaggcagagaactcggtgacaatttattcttttttccttaccaccatattgatttttttcactttttactctctttggctctgccagttcagcaccaaaggtttatttgatggtgaattttgatgcatcttgcaataacgttctctgtggtgccctcattcatgcattttcctattattacaaccttctagttaaatcacaccatgcatagaaatttattgatgttaaaaacgataaggtgaaattcagatacagtgtttgataaaatggcatttgcataataatatataaaagttacctgccaggccagatgcagtggctcatacctgtaaccccagcactttaggaggctgaggcagaaagatcacttaaagccagaagtttgagaccagcctgggtaacataccctgtctctatacaaaacaaataaaaaaatttaaaaattagccagatatggtgcctatagttctagctactcaggaggctgaggtaagaggattgcttaagaacaggagttcgaggttaaaaaaagaaaaaggaagttatttgccagatgcttttttttgctagatgcttttagaatagttgactggtttctaggattatatagtttatttcatgagttttttttttcctcccaaagtcagctgtttcttatagtatgggtagaaattcatttagaaacatcataccttctctacccaaatcagctctattttctaacttccttgactgggggagtcacagttctcccagatatccaatgtgctttagatctaggttctgctttactcctccctggctaacgtcctgttctggggcagtcaccctggcacatctcatgagtgctctttggccacctttttcttggtgcctccactgcagcctcaccggtggaggccttgcttctccttaccagccctcttctggtagcctcatgtccacattctttcacttcttaccctgtgctcacatcactagggtgtcattcgtcttccttcagcccctgggtcactcagccaccttcctgctccccacagcctctagtacctccccactgtgtttatatcgacccagcacttccctgtgtatacgacacagttgttcccatgtcagctctgagggacagccggggtggtttcagtccactttacagagtaagaaagtgcgcttcagcaaaggggagaaatggccacgttgttcatagtagatccatgactcaaacctaggccttctgtctccaagtctagtatgtgggttactccagaccctcacaactaagtcccaagcttccccactcaacgcctgcattatgatgaaattgcactaacggttgctcactggccctgcttcctggcctctctgcattctgcctttgggagtgctgggcccttgcctagagccccgtttgcattagcacagttgtacccatccaggccctgggtctgagccatgtgcttctgcttcgacacagcctcctggtcagcctgtcagggatcagcctgtcggggtgggattgtgctggtttcagttacatacccctggtgtctcctctacttggctttggagtttgagtacaggccttaatttttcctggcagattgagggactctgtaatttctttctttgtacatcctttgttttaaaggagagtctcaattaatattggtgaattaagccctttcacataacaataaataaaaacaaccatatttaatcattgcttaattaccggatagattcagtttagctaaaatatgctctaagataaattttttaatgaatcctgttcttttttgctttgttttgttgagctgtatcttcacagattttgagatgttatattttcattttcatttagttaaaaatattttctagttcaccttgtgaattcttttttggcccattgattatttagaagtatgttattttccaggtatttaggattgtccagataatctttctattattgatagtttaattctgttgtggtcagggaacataccctgtataatttttatctatttgatttatggtccagaatatggtctgctgcggtgaatattttatgcgtactttaaaagaatgaatattctgctgttgtcagtggagtgttctataaatgtcaattaggtcaagttagctgatagtgtctttcaggtcttctgtattcttcctgatttctacttgttctgtcaattactgagagaggaatgttgaactctccacctgtatgtcttctgtcacctctgtcacttttttgctccacatgttttgaagcactgatactaggtttagtattgttatatcctcttgatgaattaagacgctttaccattatgtaatgtctctctttatctctagtaatattccttatattgaagtctacttcgtccaatacaaatgtattcactccaactttctttttattaaagtctgcatgctatatcttttttaaatcttttacttttaacctgtttgtttctttatgtttaaagtggatttcttatggatagcatgtggttggatctgacaatatgtgttttaactgggatgctgaaactattacatttaatgtaattattggtatggacaaaatttatatctcctcgcttgctattttttctctatgtatcccacctattttttgttccttttttcctcttttcatgccttctttttggatattttcactattgccttattaacttttttttcctagtagttgctctgggtgttccagtatacatctttaaatttcacagcctaccttcatataatgttatgccacttcatgtataatgcaagaatctttacaactgtgtactttcattttgccctctcatattttatgctgtttttgtcatttattttatttaggctataaatgtcgcaatatgctactataacttttgctttaaattggcaaaaatgtcttttattgttactcagaaataccaaatatatcatatatatctatgctccttatttcttttgtgtagatccagatttctatctggtatcattttccttctgcctaaaaaactttctttaatgtttctcataggctagatctgctggtgatgagttctgtaagcttttattttgccttcaacttagaagagacttctgggtaaaaaaattctaggttgacactttattctttcggtactgcagtaatgtctctgcattgtctttcatcatgtgtaattataaatctggtgtcattctcacctttattcctctaaacacgtcttttgttttctgactttttattctctttccattgcttttttagcaagtttattataatattccctggaataattttctttatgtttattttggttggggattgttgagctttttggaactgtgggtttatagtttttattaagttgggaaatctttctgctgttatttctccaaatattttttctgttctgtctctgctcttctgcgactacagttacaactatgttaggttgcttgaatgtgtcccacaagccactgatgctgtgttcctttttattttttcagttttttctgtgtctcatttttaatcatttttattactatgtcttccaatattaatcttttcttttgcagtgtttaatctgttcatctcaaccagtatatttttcatttcagatactatatttttcatctttaaaagttccatttgggtcttgtttatgtctccagtttctctccccatcatgataatatttttttctgcttcgttgaatttctagaacatgtttatagtaggtatttttataaccttgtcttctggttccatcatctgttaattctgtgtctctttctgttggtttatttttctcttggtaatgtgagttacttgcccagcttctttgcattgcttgtaatttttttttttaattggagctggatattatgaattttaggtatttggttgctgtgggttttgttgtattcctttagatagcgttgagtttgtttgttttttaagtgcataaattacctggaatcagcttgatcctttggaagggctgtccaaagcagtcttgatagggatgatttggccccactactaaggcaatattttttttgaggattctacccaatgccttgtgtgctatgagatctttccatgctgactggtgggattacaaactgtccccagccctgaataaaccctggggacttctgctcactcatttgcaatgtttcttttcagactcaggttgtttcttcacatgtgtatatggccaaagactgaaggagaccactctggagaccttcacatctctttgtgtagttcccacctcactagtatttggctgcataaattatagttatctttgccaccttgaactccaagctctgtcttttccaactcagcaagattgctaggctcagttttgggttccccctcctttgctatggcctagaaaccacctccacagagtaagctggtatcaacctgaggcttaccttatttattttctttttcttggggatcacagtcctgtgttgcctgtttttcatcatctgaagccatcatttcaccttttttgtccaatttcctggttgtttttaagtggaaagggaaatcttacctgttagcctatcttggttggaagaagaactcaaacctcattttttccccctcaaatctgttttttcctactagaaaagtggactcctggaggtaaaactcaattaaccagcagtggaccttttaaaaatcacactttaatgaaaattgagctttatgatataattttaatatcccaaatattatattgcaactgacaatggtggtatatattaaatattctgaattctgctttaatatgctgggaaagaaactacagtacaacaccagaaaatgataaaatagcccctttaacagctctctaccaaaattgcagccccaaggggctgatcatttctttcttcccctttgaaccttgtagccaatttaaaatagtacttggctataaagttgtgttatttttctcctaatttgtctttgacttgaacttatttatagttctatatgatgcttgagagctgaaaggatcctcagaagtcatctggtccaggcctgtcaatgtaggatgatgagattgagagccagcgaggaggggcagcagcagggcccgcatctgcccttgacgtccaggccagtgtccttcacagagccacattgctttccctccacaaagctctcctcccgctgtggaatcttgctagaagaagacggtggaatatacacaagggccaacatgatcagttctcttctacagttggaattttgcctcagtatttttatgcatagggttttttgccctcaatataaattttattatataaacaattgttgttatatggattcttttaaataaagcagccatttttccttgcttcctttttaaaaaaggacctagtgagaacaagattagatgaagagaatagactaaaatgctatataatttttcattgatctgagactagttataaatatcagtccattggatgttttaccttctctgtggtggagacaagcttgctggttcaaggttgtgcagaggctggcgcatgggatttggaggagggtgtgcgctgatcagcagcattgagggccaggtgagagcagagaccacggatttgcagtgctgttgttctccacagagtaggatgtgtttctagcattgcagtcctaccttgatgcaggaagggacagatttagagtgagaagtttgagaggagccctggtggagtgatcgaggtgaaccagacagaatcaggaaggaaacaaagttaggagaaactgctagagagggagagaaagggaggcctttcaggagaaggggaacgagtgaaagggaagatggaaggagggcactggagaggtcgccttttcacttcttgaaataaaaccttaaagaagtcgaatgaagagtcttgtggaggcagaacactcaagtgggaatggcttttactgagaggtaatcttgtggcaggttagagagcaagtctgtcagcccctccatgtactctctttcccagcagaacgtgccagctgctcttctccagtgtttctgaggctgtgtttcaggaagctgtaagcagccacacaggttcaagctggtacactgtcctcttctctgtaccacaatggccaaaccagaaatgattagggatgttactcatagaattcactaaggaaaattttgctaggtcttgtgttcaacaacccgtgttatcagagaaatcctcttgaagcttaacctaaatctcctgcaatcatttggattcacttcctcttctgatgtgagtcagcctttcatttgttagttgatgtattcgtccagtttccttctccacacaacccacccccaacctcaaacacacgtgtgtccacgtgcacactcatacactctcctcacactctccctcatacttcactgtcatttacaaagaaaacagaaggtaggcctgggtgacagtaagaataagaatatgatggagtcatctaagcccgggtctattacactgaaaatcttagttttatccttaagattcctctttagttgttgcagagccaggcatatttgctcagcagttactgatagagcccactggcctgtatgtttcttcatatcgaaatctctcttccttccttacttctgagggaagcagccttggtaggcagtgaagagctccagcttagaatcagcttcctagctcaagttccagctctaccatttattgattttaactccttgtgcctcagtttccttatttataaattggggattatagtagtccctatttactaatagaggtgaaatgagtttaagtgtaaggcacttagaacagtttctagcttgaagtaagttctcaggaaaagttaaccatagaattagaaataattgttgaattcttcactgatattacctaggtgtctgcagacgtcatttcaaataatgacatttttttagagtagtgcttacagtagtagaatcagattgtaccaaataaaataataaagcctgtgccagctggcagatgttttccttttgttttaaaggaagtgtcaagaattgagcttaattgattgccttgcaaacattgttgtctctaaactaatgttagctaagttctaagagcacaattaaactcccgttcaaaaaattattttgctgtatttttggtttcataaactgagccacaatatttcagatatgagctttttacagccctctatttttatcttttggttacttaggttagctgggttaaggaggactgcattttctctatgtctgtttttcctgtggcctcaattggaacaccatgacacatgtaataggtcttcacttaaggccttttgatttcatgtaccaatttctgacttcaccatttatgtttggaattgtgatttgcctgtatattatttcttgattccagctagtctctcttgaaaatcttctgggttttaatttttcccgttgaatttttttctttgtaattttaataattcagggttcctcttttcctcttttcatatgtaagtcttaagctgtaaagtttggtataaattggaaatacatcttttgaaatagttaggggcctttgatttagcagatctggatactcagatgtttaaaggttcatttttgtaatatatttctatttacatgtttacagttaactattttgtttcagttgttaagtcatttgtgtcatctaagaaaaaaatgctcaattgtcaccttttagaggagaacctatactgaaacagtagtatgtgaacaaaggcactggttttttatttcatactagaactctaaatcagattgtaataaaatttcactgttctctacactagctcttagtctttagcttatggagtatatttattccatttataaaatataacgtagaatatttagagtaggatcctttggttttgcagctgtactatatcattctataacttctatttttaatctgcattaaggaagaccacaaagtagaatctagttgtatattgtgggggattggtatatctttcgtgtatagagcctgttcagtttgtattattatttgaaaaatgacacaaaattccgttgctttttatcttagtaaattaaagtttatgaaatacctacatacacattttgggtcaagaggtgggtagggagagatgttttcatttccttctcctttaaccttgatgggccttctggggatgctggttggctcttggcaggctctcaaggtaccttctgtctaattctgaccttgggatccaggaatctattggtctgccccttgctccttggtgctccatgagcagagagtcacaggatttgtgttgacagcgtataattttaatttcttacaaagagcttttggatgtctttactccttgaatttgttacggtgattttttttttttaaatgcctataaagttgatggctgcctgatagcatcctgggagattcatttcacttttaattgggaacccctttgcagagaatgtcattaggatcattgttgtcagagaaccccctgcgagtgtctccaattttgatgtttagtagatgtttgctgtgggagctctcgactgttgttcccgggaatttttagtgtttccagtcatggtcatttgcacatagccacaagtccactcacaggaaatgttggttatcagtgagatgccactattcagattgtgagtgcatccataatatctttctcttatttgctaggccgaagatggtgttagtgattgcgagctgctggctggcacccttgcagagcaggagtaagtgagtgctgttcagctttccagtcctgtgagtctgatgcctttcctccgtgttttggcatcactgccaaacatatgcattgaaatccttcatgatcatcagtttgtcagatgattatattgttgcaaagagtctgtccaggtcttttgtatcttttttttcttttttgtcaccttagtgtatgtccattgtgacggggacataggtattgatgatggtggaagaaggcacaatatatatcacagcaagactagagatttggggtttagtgaatgattacaaactctgcaaagggaaaactcttccagagcgccagtgttgtcagcccagtgctgcataagctgttgttcaacaaatggactttggccgagtcctgtggtgccgcgtgtgtttctcaacagtttactcgtttatcttgtggattgcttcatagtatggtgtgctgttgccgtctgccacacctgtgttacagggtaagaggaagttttccatttgcttgcacagtgtcatcacagaagtgtaagcccttgaaacacaacaaaccaatgcagtttgtctggcaaaaggcaggcagtctctagatcacctcttctcctgtcctcttctccattgggagtgcgtactgcagccctgagcaggacaatacatatggccaagggacaggcagagaaccctgtggaaaggaggtcccacctgtttgcatagaactgtggaactgggatacacctgccctcatcagacttaagttatgtgacctctgaaagaagggtgatgtggagccatctgacctggtctattcatggacagtcgttacacttcacaactgagaccaaaaggccagatctattgcacatcttccttaggcaacaagtttccttgtcttcatctaccttgattgttgttgttaagtgaggcccttacatttgctgtattaagtcccaattcagggtcatggctagaaatggtttgtatactaaagagtacctcactgttaagcgtccttgcagtgatgatttattttatcaggaggtatatatggctgcatatgtggcttagggtggtggtcacagcatcatcccttaatttgaacatttagattccactgcactgggctagccaggcactttctccctttgtaaaaaactacttttacaaatttccactgtagttaagataacacatggaggctagctttggatatgtaaggtatgcttatggtcccaggccctctattcctttccatggaaactgaccgcttgtagttctggaatggaagcatataagaaagacggaaatgagaaattaggatccttaattgcaaatgtaagtggaatgagcttaccctgcccttatttaggtttatgttcttatctttttttctggtgtccttatgaaatgttgtctttcacttggttactagttaggagtattttactaggaaatttacgtctaagaaatctatctatctatctgtctattgaaggactgtattgatagacttcctgccttccaccagagtgggtagatgaatctatcctctgatttagagagacacttcagagccccagcatttggtatgagctgaagtcaattccagcatgtttaggttcaagaaaaatatttatcaatgaaatcaaattgatttcgtttttattaaggaaacctgattcctaatcataggcatcaaaacctttaagctccgttgagttataggctttatggtcaacaattaggattttgataattatcataaatatcaaacaagcaagtgattgagttacaagtttttattaatcccatgaaaagcctgtagaaactgctacgacataactaattgattttgcattagggtgatcattcagttgacataaatctttctcacagtaaatttatataatatcgtaatgcccaagccttccattgtgtttgactacctcccctccctaaccttagtctggatgcagggtctttaaggtgtatgataaatgagctgtttactaatttcctgttgaagtgaatacacatttgcaattattggaatttattatttgggggcatctggctcatccttgtttttgtttgttaaacaggaaaaggaccagcgcagcctagacataaacactgccaagtgcatgttgggactgttattaggaaaaatctggcccctttttccagtttttcaccaattcttagaggtaccaaattgttgttttatgaaatgtatgtttgcttgcttggaactaccaaataactttattcacccgttgtatgtaattttttgtttgttgtacttttctgcctatgtaggaattacggtgacataattgctgtcagtcagcagctacctatcttcttggagtgcatctgtgtatgcgtttaatgttgtgttgcttcattccacattaaaaatgcatccgaaacagccacagctctgtccttttctctcttttctcatccccattttaaagcttcacttttgtttagattttctgttctttgtaacaatagaaaaagaagatttactttcttttgactttagatgaacttccacttttattaagcagaggtttaaaagacagtcatctgccttcttaccaaaattagtttgtagtatgttcttatctactcttgtcaccaagtaacttgaggaccttagatcaatctaagtattaggcagactgacaatatctccttcagtttaaattgtcttcagatcagtatcagaacaatccagcactttattccatcattgtttgtgtgcttttaagtattgatgatcagaaattctgagctactggttttgttgaagtgtcattctgtgggacctggaagtatatgggatacaagtttgagttacttgggttgtcatatatggcatcctcctttccctcctgccccaagcccttctaaaaagtgtcctttgcttgcaaggatgagggtgttgggtctttgagaaaatgctgggccgtaagatgactctggcttcactcttgaataatctttctcacaacttactttatgtaatggtccagaatatttttaatatctgataggattctttgagaactgttattaaaaatttcttttaacattactaagtgggactcctcaaaaatttaaaaactagttttacgtaagtatctgtttacccaaaatagtccatgttgacatatggtctgttctaatttctctgacaatcccttgagatgagttagcattatttggaaaaataaatagaaatagttccctgttctcagagagtttagctggatttacacctgtgtgtaaagagtcttaagctggaagacctggcctggaggaaatctgactttgtgtaattccaggtgcatcatcaactgtttcaggactggtttttgcttttacctgcttagaaagttaaacttgtagtctgtgctttgttctctctcttacattagtttgcatttttctttaaaaaagacagtattcctctcatttcagcttttcttgtgtttgcatcctcaaaaccattgactcaactctctttgctttttatgtacttgtattgttttactatgtttctgattttagtggggaagatttaaaaatcattggttctggattttatttatgaatcttcatacagggatactgtatttttaaatagacacatggcaaatttctcgtctaagaggaatagaaaaacgatttcacagctattctagcttcttttatgatcagattcgagttttgaattattagaacagtaatttttttctgtgacaagaacacctaattttgagaccacttgcagcacttaccggatctcgtcaagtaacctgctgctgcatgtgctttaagccgaaggcttggccatgggcagtgctggttatgtcaggggttatattaatgggagctactctttatttagcacttactttgtgccaaacactgaatgaagtgcttcacataaattagtaaatgatctcttttaattcttataatatctttatgaagtagatattatctgcattttatataaaatggcttttgcagtttagaattttcacttctggggatatataatcatgttattttgatgtgctttccattttgtattgagaccctgtcatatttttgtaatgacaattgtcatcttaaattctactcttgctctccctcaccatcctcctagattggtgcttaacaaacctcaaacagaaagagttaaccttacatgaacttaattaagttgattcataaagcaattgaaaccgtcccatttgttcattttaagtgtcagtaattcatattacttttccctccatcagcaatcaaaatacaaagttattaataaagaccagtggtgcaatgtcctagagtttagcagaacaattaatcttgacctcagcaactatgatgaagatggagcatgtaagtactgccgctaccattctgccattcgtgtacatttctatatcatcctcattgggaaaagcctcagctacattactattattattattgttattattattattattactactgtttctctctttctctccagggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaaggttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtatttttaggtttgtattttatgtctttttttttttttttttttgccattcttgaggaaatatagagatgacatgttttcaccccaactatctggtgctattgaatgactaattcagtccctaaagttctgtgaaaacacaaaagtctaatgatttgagtgagtaaaaggtaatggtgcatttgaacaagtaaatgctgtcgtggtcagcaagatccgtgatttgaacatgtgatgactggaaaaaggtttgggttatttggaactctggctaaaacttctttcgggtgacatgtgatcgtttaaatggcattaagtgaataaagcacacagacagtgctactcttgaccactattttaccatttctttgcaaacagtgttcacattttcatattttttccctaactaaaccaccaaagaaagaaattttgtatgtatatacagtgtgtgtgtatacaaaatcatgatatagtagaatgcaactactttctttttctaccaaacgaaaggttttatttgctgtgaaataaaccagaagtttaaaaaaccctgtagtgattaagcatacttaaccactccttatttgtagattcactttcaaccttaaaaattaataccagtttgcataaaccaatatctgaaaagaacaggaaatgttaatggcaagcaacagctattaatactgatgtgatggatgcatttgttttgcagtggtgactggcctaggcaggtttggatctgtgaagaattgattcattttcaaaattattccataaagttaaaaagttacactttaaaggcaacaggtcatacagttctttaaatctgatcaactgtagctttatttaaagcaaatataaatcatagatgaagttattttaaacactatgttagaatatagagatttttaaaaaatgctgataagcacagttaattctaaaatgagaggattgttacaggagggagatgttacagttaatccacaatcaacattttgatggtagggaaaaaactgcgtaaaaactattgcattatgtatgataagaaagtaagtattccaaagggataatcttgcatattaagaaaactccaaataatctttaaactgccttgaaaaataaacctctttgactgctgagcggcagagtgcttacccttgattgtcttgattttatatatttatttctaaggggagaaaaaggggtcagacagagtaatatgatacattttcttaaaaacttctctaagttgcacaaaactgaacaatcatcaagcacttatttactggctaatgttgaataaattagggtgccttcatctgggttttctttagtacctaagtctacaaccctttctctttttctattgtgtttcgaactccacattgcaatactctgttgtcatggaatacaacctttagatgtttactgctgaagtaggtcagaaattgtattatttgatttgcctcaaacatccactgtaatgttacatgcaccttttttgaagcatgaactctgaattatgtttttataaatctgactaggcaaacctagattctggtttcacaatggatttattttctctctcagtctccattttaacagtgcttttgaagtttatacagaaagctttaaaagttagtttgtgcccttggtttttattcttaaaactgctaaaatacctctgtaagccttatcctttattctttcatatgttgtataataaatgtatagatttcattgaccaactaaaatgttgggtgtctgtaaatgagaccaaaacgtgggttgcttttttcataaaataatttctattgggggttactgttcaatgacagcaggtaacctataactgtgaatgcttcgtgtcgtcagtatttgcattacattcataaaagtgtgcaagtcctgtgactcccagcttaactgaaatactgttatgccacctaacttgagtacagcaaactggttttaggtttcaatgacattgatgtaaaatgatatcccatgaataaaaagtatttgtgtttggtttcagaacaga

SEQ ID NO: 37810 - DNA, 3925 bp, Homo sapiens
gatgggtgggcgccgggcgccgggcgccaggcagtgatgggccttcccgcgctgcggccccactgaggaggaggctcggggacagcaggagcacgggctgcccgcgcggtgcggaccatggcgttcctggccgggccgcgcctgctggactgggccagctcgccgccgcacctgcagttcaataagttcgtgctgaccgggtaccggcccgccagcagcggctcgggctgcctgcgcagcctcttctacctgcacaacgaactgggcaacatctacacgcacggtgagccgcgtcccgcaacgcgcttcccacacccccggccgccctacctgcgttgggccgggggcactgaggccgaggagggccccagcgcccaagtccagggctgccccggccctggcaccgccagtagccgcggtgacaaagctgccattgtcccgggccgcgctgccagcttccgttttcccggcgggtgggggccgggtcaggagaggggagcagagtagggtctgagcctgcttaatccctctgagccccaggggtagggagcatggtgtccggcctctgtaatcccagcgccctgggaaccccctcccgccagcacccagccgggagatggtgttgactgcgatgaggagggcccgggaggagcctcccagcgccgccgtcctgacgcccccgccccaagccgctctgtcttggggctccgcctggtggcggctccttcttcccccaacaggcgtccggcccctcctccgcgccccgcggagctctgctgacacagccctgcccgtccttgagctgccccaggcgggcaaggggccctgagcggcctggcccagcctgggtgcctttcccgagcttttgccaggccacattctcacaagggtgggcagccttcggagccccgtttggcccctgggaggccagtactagaggccggcagggaggggtggagacctcccagaaagggctaggctggaatcaaactccccagggagaggtctggggagatgggacaagcccctcgaagcccccttcccttcattctggacttgtcttcccccacctggcctcacccctttatagaagataaaaaggcccagtgcctccatttgtctggacacttatggagaggggaggacttgggttgggaagagcaagccaagtggccccgggctggcatcactgctcatgtgtcctcttcacaactcaacttgaggtttcgctgccttagccttctcctgtgacctgcttgtatggggagagcagtgtgggagtgggacggcctaggcctgtcctctgccattgcttacctgctgggctcacccggggccggtcactcagcccctccaagtctgtttcctcacctgcaaagtggggatcatggtctctacttcccagaccatcctgagccatgataagtaaccagtgccaaaagccttttgcccagggcctgtctctggccaaggccaggccgccaactggatgacagcattacctggacctgtcttgccctgtcctgtgttgtgtctgaaccgtggtccccttgaggatgtgactgaaactatctggtagatgactgtctccctccctagggctggccctgctgggcttcctggtgctggtgccaatgaccatgccctggggtcagctgggcaaggatggctggctgggaggcacacattgcgtggcctgccttgcaccccctgcaggctccgtgctctatcacctctttatgtgccaccaagggggcagcgctgtgtacgcccggctcctcgccctggacatgtgtggggtctgccttgtcaacacccttggtgagtcagggcccaagggatgggagctggagccaccggcgggagaggcatggggcacgcatacaagccatgggtagggaagggcgggtggaccctcacaatgacatgccctctcctgttctctcctcttgtgcaggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccgtggcgctccaacttccttccctgccttttccctccaagctcctattttactgtgtcagctggaaggaaacctttccctcttgggacctctttaccctctgtgacctgtggggttagaccagagagggactctggggtcacgtcttgctctgagagttcaagtcctgccaggccgccagcccagagcctcctcaccctatcctgttcctcccaccaggcctgtggccagtcttcctgatctccatctttctgccctgcataccagccctcccagcagccacaagcttgcccgccctggctccctctgcccagagactatggagtaaggcattcaggacaaaaggaccaagggggcgtggacccgtcttgtaccagctggccacaggcacaagggctgcagctgcttcttccaggaaactgacacagggagctcagcggcctcagatcctgggacccctgggccgtgcctgccctccaccttgagtgccatactcccaacagctccaggtacccaccgggggatgtgcctgctcaggaaacctctttgctccacacagcatggggcttcagctgctggcccaaggccaggagcgctgggttctgcagcagggctcagcctcaggggcgttaagaccctggatgacatcaataaagggacaggaagggccatgttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctccccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggccccctctgtccttttcagaacacatggacttggaggcagatttgaaataaacttttagtaaatgt

SEQ ID NO: 37811 - DNA, 1638 bp, Homo sapiens
cggaacacgctgggaggagggtggaaggcaacctcggggaaactgggaaaggcggcctggacttcgggaacaccgcgtacctgcgggggcacagccccacccgagcgaacgggctccaaaggggaggtcccgcggtgcccaccgcgcagagctcagggggtggtgcgcccggcccttctgcggcgcacagcccagcccaggaacgcgggcggtgcggactcagcgggccgggtgcaggcgcggagctgggcctctgcgcccggcccgacctccgtctataaatagagcagccagttgcagggctccattctgctttccaactgcctgactgcttgttcgtctcactggtgtgagctccagcatcccctttgctcgaaatggaccccaactgctcttgcgccactggtaagggaagctctgcgccctggaatccccatttcccagccctattacagagggtctctgggtttcaggaagtcgcattttaagttctgagcgacggggactccagtacttcgttagatgctttcttcctgatcacgcccctgagagcattgccctcatccctgggcctctacgtcagagttaagaatactgaggctcaaggctgaactgctccacatcacccagttggtcatgggcctgctggctgggccccagtgctctgtccaggctctgagcaatcagtgtggttgggggtgctggaaacattgactcttcagagttcaggacagaaggttctggctcgcagtctcaatattcctgggttgtatgtgcacgtgggaccttcctggtgcggtaaaacaggagggtccttgcccttcccagcgttagtggagaggacatggggcttctgttcctctgtcctgagtgggaaaggagctctgagggctggccctgcacagaggagggggcactggagactcactgacccactgctgtaccttctgcatctcactcactgcccactgcgttttcctcttccttgtaggtggctcctgcacgtgcgccggctcctgcaagtgcaaagagtgcaaatgcacctcctgcaagaagagtgagtgcggggccatctccaggaatctggggctgtggctcaggttgggagggaactcaaggctggccctgagtgcatccttctggggaactgggctttctttgccctcattgcccgtgtcattccctctccaggctttctgccctaaattcagatggggcaggacagcatttttctcgtgggacacaaaccccaactgtaccccctatggtttcagaacagagctgtgccagacgaaaaaaagcatcctctgggtctgggttctgagctcgagccaggcttgctattagggcagggaggtgcccggtcaagtctactgccacctctcactctccccttcttccccaggctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaa

SEQ ID NO: 37812 - DNA, 264590 bp, Homo sapiens
ttcttcccttcttttcacaggtgttgatagatatctatttttaaacatggaaagatggtggtgcaatggccagtgagtacaaaaagttaaaaaattgtaaaaagtatgagcccatccttagaaaacattcatagagatttttacatagagaggaaattgttttatacaaaagtgattattaacagtagctgcttgggaggttgaattgtgagtgattttttttcttttgtttccccttttgtaattttccataataaacatggattatttggccgaaaatataaaaacctatttaaaaatcatataaatctgaatgaaacatttcaatacgaagcaggaatagtgttagtctttttcaatactatttcagtatctttttaaattcatcagctttgacttaaagtcatattttatagataagctttttttttttttttttttttagcctgttggcaaaatcagtctggggtaggcttctgtcttctgtagagctatctgatttccagaaatgaaaggctcttcccaataatgaggctgtcaatggaaagggagcagagaatgtggttctctttcattggagccttccaaaacattgcaagtagtttgaggagttgaaatggcttagatgatgtcttgcctggaaacagaaaatagagatgatcttgcaaatgctttccagtggatgattctattattttgtatgagtgtcccctggctggaattagctcttattttttccactacctcattatagaaaacttaactaactccagatgaagaatttcacagcttcaactcttttagagttgatcttgttaacgggtctttctagaattgaccaggtaaaaaaatatacaaaatttagtgtggataccaagaaattatgaactctgaagacatcacaacagccccttttctgggcaaatttgcaagaaaatgccacaccaaaaagatcaactgtgtgtagaagtggttgctgttgtacaataaaaaagtttggaaaaacaaaaagaatactcttgagactccaggaaaattccacttgcatacatcatagaattattaaaacaggaaagacagtgtaaggtcatccaaatcaatttctttctttcagttagtcccccagacttggtgatgaccaacagtcattttcactgtgaagtttaattgtaccaatacgtacactatacttaatattttgaaagacagcttttttttctaaaacatgattcaggtttagtagaatcccacaccctcatcaacagaattgttttcttctccaagatgtagttgtgtttaggtgttcaataaaataactgaaagtcctttcagtgttacaaatgaatattaattggtccctagtagtaagtcaactatgctacatgtactcattccaaaaatcagacagatacatttatttcgatcgttgatttgaaatctcttagttgaaagtgcatttttgttctgtgtagtaaggaaagatttttaaatcgtgttcaattctatcatcacagacactcataaattatttcattatcacaagtgccgacagatcaaacttggcaggttcacttcacagaggtttggaatgagctgaaggttcatcatcatctatcctctagtttaaggctgagtccctgtgcagaatacctctaagcaaggaatatatctaaccctttatggtcctggatcttcctctggatttctgaatggaaatgttttgtgttgtttgagatattaagccaattaattatgctgcaagttggccctcatactggtgaggtagtgcctcctagggactggctacatcatcacaaatctcctttttcttatttaatttcttcatgcctccatttctttttctaaatggatgttactacatgctcttcctatatttataggtttgtgataaaaatcatgcgtgatagtttatttcaggaagctttgaaagtgaaatggctatctcataaaaattattcttattatcactcttagaggcaagattttcataagaaaaccttctgagaaagtcagatatggatgcttgagtgggcatcttaatttttattcttatttttgaggcctagtctcgctctgttgtccaggctggagtacagtggcatgatcttgtctcacggcaacctccacctcccggattcaagcaattcttctgcctcagcctccggagtagctgggactacaggtgcgcactaccacacctggctaattttttttttttttgagacctagtcttgctctgttgctcaggctggagtgcagtggcacgatcttggctcactgcaacctccggttcccggattcaagcgactctcctgcctcagcctcctgagtagctgggattgcaggcgccatgcccaagtaatttttgtatttttagtagaaacggggtttcaccatgttgatcaggctggtctcgaactcctgaccttgtgatctgcctgccttggcctcccaaagtgctgagattacaggcgtgaaccaccatgccagccttgagtgagcatcttgatagttaaatctgaccatatcattgtcctgttcagaaatccctcacttacacagaacaaaatccaaagtctgtctacgctatctggacccagctacaatacttatgacatctggaccctcttcccactctgatctcactcttactctttcctcttatgcccacagtcctccttgctgttctgacatccccagagactgcttttggggctccctgcatccttcctccagttaattccaagggtggctgcctgcttaaatgccctcgacccccctccatctaaaagggcagcttgtgtccattttcacccctgggtcttacccttctttccagcactaaccagtgacattatatcatatatttctctgttgtgtgttttctttttctttttcatttttttttttgacggagtctcgctctgtcacccaggctgaagtgcagtggcgcaatctcagctcactgcaagctccgcctcctgggttcacaccattctcctgcttcagcctcccgagtagctgggactacaggtgtccaccaccacgcccggctaattttttgtatttttggggtttcaccgtgttagccagggtggtctcgatttcctgacctcgtgatccgccctcctcggcctcccaaattgctgggattacaggcatgagccaccgcacccggcctctgttatgtgttttctgtcagtctcccccatgagtaagctccggatggaaggaacttttttgctgtgtatccctgatacctagaatttcacctggcaggtcaaaggggatggatgaacatggaagtaagtgaatggcccctgagtcttctgccagctgctctcttggttagacagcatgtggtgcacatgtggatttaggtagatgccttaaaactgatgacagccacatgggaaggattgaagaggcataactgattaattttgttcaattcaatgtagcaaacatttaccaagtccctattatgaataagatcctgtgttggagttgatattcgcacttctgcttctctaaaacaggcttataataggtggtttccatacagacgaaactaaagcagaaagacttcctctgtcagctaagaccatttcttctgatttctgctgaaataaaatgtcagttgacgagcctttttgaaacccctactataagcaaggcactgtgctgcttatgatctcaactgaaacacttcacaaggacgtcactctttcagctttaaataatggcaatctaatactcaggaaaaagaatttgtacagtaatacagcataggattatagacttttgcagactacattaacctgagtgcttctaaaggtacaaatgtcaaagctattagaattctgttaattctgataatgtacccacaccattcattgatgtgaacttttgatggagatgagaataaaagtgccattacaaattagtcagaaacatatatttttctcattattattattattattgtggacggagtcttgccgtgttgcccaggctggactgcagtggcacgatctcagctcactgcaacctcttgcctcccggtttcaagcgattctctcacctcggcctcctgagtggctaagattacaggtgtgtgctgccacacccagctaatttttgtatatttagtagagacagggtttcgccatgttggcctggctcctctcaaactcctgacctcaggtgatcagcccgcctcagcctcccagagtgctgggattacaggtgtgagccaccatgcccggcctttttctcattattagctgaacatttaggactcatttttgtgcaaatactcatatagtttatttctggtatatttacctatacaattcataagagcaaattttaaatgcacacatatattagggcctcattacccaaaaggcctgggataaaaatagtggaagatacagagtggtatctggcacagttaatattagttaacagtgaggacttactgtgtccctgacactcttctgaaggcttgaagggattaattaaattagatggattgattcatttgataattaccacatgcccatgagtaccatagtgggtactcttactattcccatttaaccatactaaaaaacaggcacaaagaggttaagcgtcttgtccaaggttagtagtggtaccagaattctgcacaagaatccatgcttttaatcactgcattatgaatgaacatgctccaaggaagcatgcattccacctgggcagataagaaagaaacaatctaaatatcagagttgagagcagagctctctaaaattaatatgtatattttttccaaaatacacaataatgactataagggatcaagggagccaaagataagttctccctgggatagtattgagcaggaacttgaaggaggggtgggttctgtttaggtagatgggaatagaaaagtgttcatatggtttaacatcagaaaaagggcagaattaggaaaattctatttgggtgtcagggaataatacaagagcaaacttttaggaagtgcttactaagtaataggtgaagagccttccagatattataaaattaaatctcctaaacacgataagaggtaactataactaccatgctacaatgtggataaagtaacatgtctggctctgacttcagaactcacatccttaatctacattataaagtttgtccaggaggttgagtggacataagataggaaagttaggctaaggcagacacggaggaacttgattactaagctaatatatttacaccttattctgtttaaaggagccaccactgggaggatcagagcaggtgaaggatgtaagtaaagtgggtttgctcctgcaggaatatacagactgttgatctcaaccttggctgtgtgctagaatcactgagaagattctgataaaatacccatgtctgcccctgctcctggtcagctaaataagacactctgggttgctcatttccctcatttacttaaaactttccattgccaagatatagtcaaaatacttaccttggcatacaaggttgtccaaggtctgatccttgttcacctcttgtgtctcacatcacccatctttatttatttatttatttatttatttatttatttatttagagacagggtcttgctctgtcacccaggctggactgtggtggcgtgatctgggctcactgcaacctgtgcctcccaggctcaagcgatcctcccatctcagcctccagagtacctaggactataggcacgtgtcatcatgcctggctaatttttaattattattattattattattattattattattttgtagagataaggtcttattcccaggctggttcccaactcctgggctcaagtgatcctcccaaagtcttgggattacaaaggctctgagccactccacctggtcttaagtctctcctctgatttcaccaaactctgctcattcaaaataatttgggcctatgcaagctctctcttgcccgatgactttgttttcttgttctttttttcaattgtttggttgaaaacccaaggacttaataaaagcttttctttcttttcagaatgcttttgtttcatatcttctcaaggctggctgtctctctttttgtcagcctaaaggtcacctcctcacctatgtacttcttgatcattctacctgaataagttgcataatacctgcactcttgcccctcagcccgctaccatcagagcacttcatgttttgtcagtgtgtgtttgtgtagctggactctagactccacaaggccaacggacttgttttgctcaccccatgcatactcagagcccagcagtaatatctgtggcataagttaatgagaaggcatatcttgaataacttagttaatgtcacccaactcatgagggcaaagcctggagacgaacacaagctcgaaaccatcatggtgctctgctggaatatggtggtttgctcattcattcttgcttttgttcattcattcagagaacatgttttggattgataatatatgctaagccaggtgctagggacacagataaaatggtcattgatcctgagaacataatctggacaactttaagtgaatacagtcacagagggagcagggcactgccaactgatttcagtgctcagcttggtttcctctaagcttctgtactgaggctattacagggtagagaaattctcagtctagtggcccatggtgaattttcagacaaatctgaaggttttggattgaaatagtaaaaagtttgagaacaaaagtttcatcaattaattaacacgtcaaagggcacagatcagaagagatactaacttgaaccacaacttacatgaataacagctgaaaacaaaacaaataacaaatttcgcagaacacttcaccacagcataatgaacagaattttccaaaacctagacccatatgagattttctatctcatgcgttctctgtctctctgctctctcaattctctaaaagaagagatctctgtggttttctctttatttctagctctgtgtgcttctcatttctctggaaaatctaaaatgtcctcagagaggactttctggccctcttcaatcttcccaaggctgattcttgaaatgctgccttaggatgtctttcctttggtttaaagttttgctcctattaatattttaaatttctttgtagtctcagtggatatatcttggtggttatatgttatccaaaatttttttctggggtgtaggttcttggaggaagtctcaccagaggcctgaggctagccttggtgaatctatggactatgctgtatatggaagcaacagcctgaatagcaggaaataatctgagacgtagctttaggctcgatgtacaatgcaatcaccacttctttcttttcctttagcaacatattggcttgaccaataggcaacaggtaacaggtaacaatgcttcatccttgtcatcagtttttactgttttttgggggtgtgtgttattattgtggcttcttcagaatagtcaagtaattttccttaaaagagaaaaaataggcaacatgaaattaagttgattaaaagaatgtgaatgggaaaatagatcagcatagtgttaaggatattagctttggtgacatttgaattctcacttccatttacagactccatagtaatcttggtaatctcctctctccaccctagttccctcttctgcaaataaagagtgtaatagtaccactttatagaccccctagagatgcttcttagctggtctactcttctggtaagggcatgagtctcatcaggggcgctcgaccctcatgacctcatgaccctcatggcctcattacttcccacaggcactacttccaaataccatcttattgggggtttgggcttcaacctatgaattttgggaggacagaaatattcagcccagagccatgggataaaaagagttggtgctaaaataagaaggattgggtggaagatgtttaagagggcaaatttctagtccctctccttaatgctacactcctgtatattggtacaaaacaggtttattgtttggagatggaaaaacgtggagttttgagcctgagagtgaacccatgcagtgaagagaacaggcgtgctactgacaatagaggattaagaggccatatgcataaggagtgctgattttgaagtcctcaagccaactcgttcaatcagaactctggcagccagactttgtccttgaggcaagggacaggaagtgcacactttgaggaagctgccagcccaagaggaaggaataaagacactgaccctggggcttcttaacaaagggctacagtgaaggtcaccctaaaaagcaggggcttatgttcagcttccaattcctttttcaatctcccactctgcgtttactctcctttctttttatatctcagatttttactttgaaaaattaaaatctcagggtgggcatggtggctcacacctgtaatcccaatacgttgggaagccaaggcaggtggatcacttgggaccaggagttcgagaacatcctggccagcgtggtgaaaccccgtctctactaaaaatacaaaaaggagctgagcatggtggtgagtgcctgtaattccagctactcaggaggctgaggcagaataatcgcttgaacccaagaggcagaggttgcagtgagccgagatcataccactgcattccagcctaggagacagagtgagactccatcttgaaaaaaaacaaaaacaaaaacaaaaaactacagaaaagttgaaagattagtacaaaggatacccatatagtctttacataaattcatcaactgttaacattttgtataccttctcttgctcttctctacacagactttttttttttggaaccacatgatactttctcatactcagaccaccaaagaatagcagaaatctaagtaaagttcctaatgtggagatggaattccaaacaaacaaacagacgaagtcttttggaaaatatagagtctatgcagagagaaaaaagcttaaaaaaacacaattgttaatatcttcagagaggttgtgcctatgaaacaaggataggatagtattataaaaacctttaaaaaacacaaaatggatttattggaaatcaaaatgtaatagcagaaattagaaactaaaatataaggccaggcacagtggctcatgcctataatcccagcactttgggaggccaatatgggtgaatttcttaaggccaggaaatcaagaaattaaaataaaatttaaaagtaaagtgacaacatccataaggtagaacaaaaagacagagagaaacagtaaagaaaaagtaataacattacattatcactctcagaggtctattatctgaaaaaggaaatccagacaaaaagaaaagaaaaatagaagggaggatttcattaataagatgcttgaggagatttttctagaaacaaagcatgtgaattgctagattgaaagaatctatagagtacctagtcaatggatgaaactggacccacatcaaagcataccatcatgaaatttcaaaacataggagacaaaaagattttataaccttgcaggaggagtaggttgttgcggagactgttcactcagagaggaccaaaagtcagaatggcttcttaattatagcaacaatgcaggaagcaagaaggaagggagcaacacctttaccattgtgaaggaatattatttctaagctagaattctgcgcccattaaacttgtaatgaaacgtgagggtaaaacataagacctgaaaaatgtgtctcccttcaccacgcacctatcttaggataccactggggaatatccttattcaacatgagggaatgacatagaactaggaagacatgtacaattgaaaacaggatatccagcacatgagagaaatagagagaacctgtggaatcagaattgcgcccaggtagagaggtcagtggcaacaggctgaatatttttggtccccaccccccaaagaaccatatgttgcagactaaatccccaatttgatggtaatggaggtgggacctttgggagctgattaggttctgagggtggagccctcatgaatgggattagtattcttctaagaggagatgcaagagagattctctctctctctctctctaccacgtgaggacgcatgaagacagccgtttgcaaaccaatatgtaggccctcaccagacactagagctgttagtgtcttcaccttagatttcccagcctttagaactgtgaaaagtgcatttgtgttgtttaagccacccagtctatggtattctgttacagcagcctgaactgactaggacagcagccattcaaattgaagcagcctggcgcaagagacagatagctaagagctgtcatcaccatgcctgctactgttgaaccagctttttaaccagatcaaactcctggaggatgtactcaaccagagcaaggggatgtactaggaaagagggagccatcgtatccaggaaatcagaatccagtcttggaaaaaggcaaaggaacttctaggaacagtagaaaagcaaaggccaggatgacaaccaagcagcagctctaagggggaaaactgtccaaagaaggaaaaatgtctaaaaaaatttacctgatgtaaattatggaaccctgtactgagatgctgttggaagtagtaggaagaactagcaaaaagcaaagagaaaagtaagaaactgaaaaagcaaggtagtttattaacttcaggaaaaactaaatgtagaaagaaaataatcactgatgcttccatatgaataatatttgcatatcatatgaatgaaaatgctgaatatggatttaaccaaaattgtaatctaatcacattgggatgatagaagaggagaaagggagatggcagcataagagagcctatcctttctgccataataggaaatatataaatgatgtttaaaattgattaatagggctgggcatgatggctcacacctgtaatctcagcactttgggaggccaaggcgggtggatcacctgaggtcaggagttcgagaccagcctggccaacatgatgaaaccccgtctctactaaaaatacaaaaattagccaagcatcgtggcgggcacctgtaatccgagctactcaggaggctgagtcaggagaatggctggaacctgggcagtggaggttgcagtaagccaagatcgcgccactgcactccagcctggatgacagagtgagactctctctctctctctctctctatatatatatatattatatattatatattatatatattatattatatattatattatatattatatattatatatattatattatatattatatattatatattatattatatattatatattatatattatattatatattatatattatattatatattatatattatatataatataatatatataatatatataatattttaaatataatatataatacattatatattatatattatataatgtattatatattatatttaatatattatatattatatattatatattatatattacatattatatattataatatatatattatataactgattaatagacacatggcagtacatgcgtgttacttagaagtatggaaattttgaaagtctcaaaaaaaactgctaagagagaaaaaaatacttctggaaagcaagacagtattatttctattttacaagttttcagtattatataactttaaaaattatatgtatgaattattttaataaaataattaaaaaattgaaatagtccatatcagttctcccagcacatctggaatccaaaagcctcttgatagaagttctttttcttattataatattgttattattggaaacagtcttggctttttgtcagatgatatttaatctagtaatatctgacactgactctttttggggacttaaatggggcatttaattcgttggatctcagtttcttcatttgtaaagtgaagggagtttggcacatacagtcatgcattgctcaacgacagggatacagtctgagaaatgcatcgtttgacaactttgctattgtgcgaacatcttaggatgtacttacacaaacctagatgggctagcctactgcacacctaggctacgtggtataacctattgctcttaggctacaaacccgtacagcacgttactgtactgaatactgcaggcaactgtaacacaaaggtaagtatttgtgtatctaaatatagaaaagatacagtaaaaacgtgacattataattcttatggaaccaccgccgtatatgcagttctctgtttaccgaaatgttgtcatgccactcatgactgaatgtataatctcttagacctgatccagcattattgtgctatgaatagaatcttttatgcagaatgcatatgctgataggacgctgtcacacatgaaaaacttggctgctgttagggtcatgactttgatctgggccatggagctgaaaagatgaggaatgcttcatcattggttcaagaacatgaaaggcaattgtgagaaagggagggctccagcaccctaaaggaaagaagaagacaatatgattttcacctctgaataagtcttaaccttgcagagctaatgtgttaaatagggtgatggacttgaaggcaattgcaaagcaaaaaccctgcaggagcgtgggaggtatcactacattgttcggaaagaagtcagcacactatagtggaaaaagctctggcctgggagtcaaaccatttgaattctagtgttcactttgctgttaatactctgggtaagtttggacaagctctctcatggcttttgtcccagcttcaggattggtggaataaaggttgatttggttgagtttcttccgttaatagggaaataaatcaaatctggagctaatggggttgttcatggactgagacaaaagattcaggaagaacaggagccagatgtcctggagctctgagcagggctggtattcaaaagattgagcaaccagggtggtacagggacaatccaatccgaatgaatgctggaagctacatttgagtgcaaactagaggcctgcagcaaatctccaggctacctcttcaattgtgggatcaaaagggagacctgaggtagaggtcccagggaggggcagggaagaggatgttcagggtgttggggtgttggagaagcagctatttaccaaccgatatggaaatatttcaattttttttttttgaggtggagttttgctctgctgcccaggctggagtgcagtggcatgatctcggctcactgcaacctctgcctcccgggttcaagcgattctcctgcctccagcctccctagtattggggattacaggtgtgcaccaccatgcctggctattttttaaaaaaatatttatagtagagatggggttttaccatattggccaggctggtcttgaactcctgaccttaaatgatccacccacctcagcctcccaaagtgctgggattacaggcatgagccaccatgcctggccacatttcaatattttaacaactggtataactgcaatggtatgctcctgctggaggtgagagcgctatctgggtattaggagatagtgttccctcagacatcattgttaggataaactgagataaaagttcaggaaacatttttttctgcccttgtgtcccaccacttagtactcagatttgagggacagagtatctctttggcttagtttagagtctatgcccactaactagggtaatagttaaaaaaaaaaaagggcaagctgaatgacaacccccctgcaactgcatacaatggattggaggtaatttcctaaaggaattcagacttctgctatggagggtgagaaacgaagtgcttaacagctggtacagcaaagacatcagtcagttagatgggggcatgggcgcttgactatgaggcagagtctggaagacactctgctgtgctggccatcaaccctctgttaccagctttgctattgtaagatcggggcaaataggggtgtcccagaagcaggaatggggtagtcagcatggatgggggatcatgggagaggaggtccgggacttgggccatggttattgctcatagatatggcatattattatcagctggagcctgcttactggctgagtatgagggtagaaaggacaccagactgggggaaaagaatcacagctgggtgttacagggaggttggagtagaactgcaaataatttgttcagctgaaactggggtttgctacagcttgtgtggtggtattttttggttatcacaatgcctaggagatgggtgggtgctactggaatttggttgatggggccaggaatgaggtagtcatgctgtcctgcccagaatgtcagtagtacctctgttgagaaacatggaaaggagaatcttccagaaggggcagctgaagagagtacagtcctgtgcaacgggcagaagggggatagtagcagtttgggtaacatagctgccatttattaattgttggttatgcattgggtccataaacacatctattatttaatccacatgacaatcccctaagatataattaattaccctcttttttctttttgagacaaggcatcactttgtcactcagactggagtgcagtggcaccatctcagctcactgcagcctggaactcctggactcaagtgatcctcccgcctcagcccttcaagtagctgggactacacgtgtgcgccattacacctggatgggtttttttttttttttgtattttttttgtagagacagggcttcaccatgttgcccaggctggtctcgaactcctgagctcaagtggttcacctgcctcggcctcccagagtgttagaattacagacatgagccactgcactggctatcccctctttttacacatgaggagttaggctcagggaggcaaaataacctcaccaatgtgagacaagaaaggggcagaggtgtgtgtgcagtccttacagagaaataggatcacagtcatgtcacagatttggaatgagactctggggaagagttgtgtcctgaaatcaattactgtaagaagctggaatttttggttatctttgaaaaggccccagatgttcatatgcagtttttttttctagattgaaggagggaaacttcagtggggtcttctggtcttgtttctgtgattcagttctcattactccaccagactctgaggactggccttaagatcagtgttgaataaccactctcgaagctgacacttcacacacaactgcaactaaatggaaaactgattgaaaccagccattctgattcaacattaactgaggtttatctacatttaaagtgaaatgcaagaagtcaaaacttaaggagaggaaggaaggatgagttagaattcttgagaaggaacccattttatatgattactaaatcaatacaaatcatcacataagatttttatcaaatattatgcttatttgtgggtttttgcacacatatttcacattttaaaatcatcagggaacctcccattcccaattttctgtaatttttttttttttgagacgaagtctcgctcttgtcccccaggctggagtgcgatggcgtgatcttggctcactgccacgtccgcgtcccgggttcaagcgattctcctacctcagccccccaagtagctgggattacaggcgtctgccaccacacccggctagtttttgtatttttagtagagacggggcttcaccatgttggccaggctggtctcgaactcctgacctcaggtgatccacctgcctcagcctcccaaaatgttgggattacaggcgtaagccaccgcgcccggccaattttctgtaattaaatgattggaaccacccccttggtaaaaatgaacacaaaagtaaatttttaattagtgaaaaggggaatcagaatatgaggatgatagacacttgtatgggggcagagggaaagagatctaactaaagtggtgattgtcttcaggaataaacactgcatttcaggaattctaatccctacgtgtggatctagggtgaatgggtgtctttccagatcccgcctctcccaaaccccgcgtagacactagatggcgctctccctttgcagtccttggagtcggagcgggtctcctaaaaagctgcgccggccgcctggcctaagagaattgcgttcagtgaagcgcagaagccgaaaggcgccttgctgcggccgcgccctgtggctgaacttaggccaattccgagcgagaccgagacgcagggcggcggtgggggctggaaggggcctttcatccactccagccgcaggacccctgctgcagctcggagcacgcgcagcaatgcaaataacacattcgaggagagcagaggaggtggctagccgcagcttggacagttggaatgtcggagggactaccctgcaaatcacagcccttctatcgggattctcagctgggcatgatggaggcaaatttggaaacctaagagtaccacttgccttcctctctcattgctccatcaccagcctttggtggtggtgaaatattcttttcagttttccaaagcaaggaagtattttctcacaaaatagggttttgctgaattctcagtttccacccaccttccgcctaacatttgtaaagaatcgggcatgcaggatggggactatgggtcaaaaataagtaaaggtgttgactcttctagagggcccacccagcaggtgagcgcgcgggacagagtctccggagagccagcgccgggccctggtggcctcctgctcttcacatctcaaggcagagcctctcaaagagtggcctgcaaggatctgaaccaccagggggtgtgatattgcagagtccctggccttacctcaggctccttaaaccagaatctctgcgggtggggaatcagcaggttatgaggtacaaccacacgaaattgcctacattcgtctttttgtaacctacagaaatgtccatttcgatacctccagctgattcccctgcaccttaaagtttgagcatcgctgctttggcgttttagagcccttggacttgttcacaagaggaagagggagaagaggaggctcgaagggggcctttatagtggatacctgtttcactcggagctcagggtctttgacgcgggaaggcaaagtctgtcttttggaaatggggaagtgggcacacagcacctgagaacaggagggctcgagacctcccaaagagagcagggggcctggtttgggagcttgcagtagcttctgccccagtggaagggaaagagcctggctcgctctcggcgcgccacatccggctgccgcgcgcacctggggggaccgccaggttcggggtaggcgagcgcgtgagcggcacggggctggcttctccacatctccggtagggcggggatgggggagaggaggaggagagaaagtgggggcgttatgggcttaggcctgcctcccacctccccacctcccgcctccgcggccaccctccgctctataattggctgccggcgggccttcctttcctcttatctgatcctgggctcccagctggagaggcggaggcagctccagggggctggaagtggaagcgcagcggcagaaggagagggagagagaaagagagagaggctaattaaaaaaggatactccgagggaagagagcaagggcggtgcgccgccaaggaccaactagcggcggagcttcgatcttgcctaggcgcggagagctcccaacctgggctggaaccttgcccagcacaggtcagttcgtctttctctgctcttctttggctcggcttcgaagtccattcatgagcaaggaaaagtggaggcagcgagccacctgcagacgcaatgcagttccatggactttcttttcacgcgcgcgcccagaatggactggggacctttgggacgggatgggacgggtacacctggatgccttttcgcggggttcacggtgtagggagattagaggcattgggtgatgagagcgcagggatagtggaaataccatgtgctgctccgggaagcttttcccagtgtttgagtgacgtgagcgtgtggcgggaagaagctgcgtttggctgcgggacagtggcggctccagcatttccatatagaaggggcttaacaaaggcggtaatttgggtgggatccgtcttgaagggctgtgtgtgcataaagaacacgctgtttttatttatcttgtgtttgggatagcttgagagagctgctgatggagatcataggggacgaaactcacccagtcacctgttggctctgctacagatttgggtagctgagaaccaggcgctggacgcaaagggaaacagctaggtagagctcgatgatggaggatggggacagtaggcgctcctccacctctctgcgccgggaggctgggatgcttcgtgcgttttgctttggtgccagaagccaggaggttgcggttttgagagaggcaccgccaggttgtaatattggagaatcctctccgctttggcttgccgacctctcacttgcccccttttatctctctgacaccccccgcaccccgcgccccctcaggcctcctattacacagcgcctgggcggataggcatccggggcagctgggcttcggcgcatggggccattacagtggcctcggtcctagggcagagcctggaggccgccggcaggtccaggaccacaggtgctcagatcttggtgctgggttcttgggtcctctgtggctcagggttgctctgctaaggtccaggagggttttggacctgtccttacggaaagttccgtgtccaaatgaagcttgtgtgcagctctcacatgggccaggatttccccccaaacattgcttctcagagtcccattacttctgcaagttttggagagtcctctgttggcagcagctgaagggggtgggagtgggggcaggaacaagagaaagatgggagtaagtctttggtggctgtggagaggagagcagaaatgaaaatggattttcctgaaactcctgttaaaggccttggggcccctcctctactgagggacagggagggcactttttataatacttgcagtaggtgatagagaggctctcttgaaacccagcaaacaggctttaagctggatgcagtgaaggaccggtgttctgtttctgacagcatggtccagtctgcacatagagaactcactggtaaatttagaatgagtgaatgaataaatgaatgaatgaacagcatgtgaatatttggtttttcagaagagtaacttggattcctttgaacccaagtgcttcgctattataaggtaaacttcagaatagttttgtttgcttgtttttaaaacagctttattgagatataattcatatacctctcaattaaccaatttaaagtgtacaattcaatgatttttagtgttttcacagagcagagtaaatccaccattttagaatattttagcaccccaaaaagaaaccctgtacctattagcagtacctccccatttctccctaacctgccgccgtgtctgtatggatttgcctatttcggacatttcatataaatggaagaatacaatatgtggtcctttgtgactgcttcttttacctagcaaaatattttcaaggttcatccatgatgtacaggctatctttcttattctctcagtaaatactgggtatccatcctctccttctccctggggatccctgagccaggatagacctgaacctccactgcagccctgacctcctgtgggtccctttgaaaggacaggcgccccactggtaaggcctcttagtaattccctgggaagtattccttggaacccatcaggattcctggagcagttttggatggatcccagccttcaagattgatgggaggaggctcttggcacttatcctgctgcgaaccgtccagctgaggatttcagagaactcttggggccctccacgcatgtcttgatttttcagaatcagccagggctgctcttaaaaatgggctgaacaaatcgatctgatttgaggggctctagggaaagcccctagctcattaagaagacctcttggggagtctccctttcaatcttaaatatttcctagtgtcacacagtaaaacacaaatgtcttttgctcgttttcagttgacagcctctgcagtgataccactgtaaagccacattcgcagtcagtgttatctaaacccagccaaatgactgctgttttcctggcctgtctagtgtaacctaagatccctttaaaggacaagagccttcctagaactgctgcatgatggagtggtgctgtttgagcaccactgagttaacaaattatctgggattatgatagtccattgagaacaaagttgttggtaaacggggcactagttgatccccccagggaactgacagtagagtggagggagaaagtttaaaggaaagtgataaaaataaactttcttcttggcaggtttgcccctcgatagtgctggatgttaggaaaataatcattctccttgacttcttctgtgagtaaataaaaaatggcagggatccagttacttttctgtatacactaagcttttgttgtagaccaaactgcatcctgttcctgtgacgtgtgtgtgtgtgtgtgcgcgcgcgtgtgtgtgtgtgtgtgtgtgtgtgtgtgtgtgttggaaatgttggcatattttttgagtacttactgggtatctgcctttttctcttttagaaacacacttaagtctcccagttacttggggaagaaaataatattcctcctttagcaatcactgagcttcaaggataaaaagcaccttgtatgggatcacaaagacagcaagtgacagaaatatgattaagaaaagtctatatggggccaggcacagtggctcatgcctgtaatcccagcattttgggaggatcacctgaggtcaagagttcaaggccagcatggccaacatggcaaaaccccatctctactaaaaatataaagattagctgggcgtggtggtgggcacctgtaatcctagatacttgggaggctgaggcgggcattgagaatataaaagagagtctataggaaattctgagcgttctttaagtcaaagtttagagcctagactccccgtttcctccaggtaatttttttattagtggtcttgttgcacttttctctctatgggcctttgtcggagctaccctgaaaggtgtctctgtgaattttagagagcaatgttttgcctcatttctcctagaaattatctgagttgcttacaaaaattggtccagaggtaggttgtgctttgctaagtccattgcaatgtcttagggtgtgtctttatctaggagcagtcagagggcccattattggataaagatctatttctgggtggccttttgtctctggcttttgcaaagaggagaacatttaattgatgtctaaaaatgataatttgctgcaggttgtttgcttctgttcttccttcacttcccagccctgtctcctgccatgtgctggcactgtgctaagcattcaaaatacagtagggaataatatgctttggcaaatggaaatgccaatagctaactacggggtagtgttcaatgctgcagaatggaaaataaagattactactataggaaacaggaagagcacctgaccccagacttggaagatcaaggaaaacttcctgaaggaaaggatgtctaaactgagatgtaaagctaccctttatactgattacagatgtacattgtagttaaaaacagtctcccatttctttgacagatgaactatgtcagtgtttgaaaaaaatgaagagagggaaaaaaagccaggtgaagaacattcttgtgtcaagcagctgtcattccaatttgccatacttttggaatggctctaccttctgtcatttagaacatacagcatgagtttaatactgattgagcagctgtataactgaggctaattttcagtcaaattccttgcgtttgagtgattcacagggatgctgctaacctaatatagtttttctgtaaattagaaaaaggaagcctctctgtgcaaacctatggcatgggagaagaaaacagttctgttttatctggataacacagctttgcactggggcacacaacttgggagcagagtgtctgccaatttcaagtgtcattgaccctaggcgaagtgtaaattgtttagttcattaactgcgagctgtacacacattagccctgatcattcagtcattaactattaaatcaatcaatatttactgattgcctatgtgtgttgaactttcttgaatatgggttaaactgcccatctagatgtctgatagtgcccaagatctagaaggttaaaacagtgactgaggccatgaaactagctggagaacctcaataagatgagggacagatgcagttcatcagaggcctggttggtgaaggatcaagtttggtgctactgctggttggtgcccatccacaaactgttacctgcctctgataagacaaaaactacacgatgatgtaaatcaaatatgtcaataagcgcactgttcaccaagcacactgttagttcaacggagattatcattattttttcatagcaaagcttttctgacgaaggaagcaaaagaatacatagacttgcatattggcataagctccttatctcactgaggaccagtaacagttcatagaccagctactttgagtagcaccaatctaggcaacattggcccacatttggccagataggtcatcttgtatcctttctgcctttatactgttttcttttctctcttttccccttattttttctttgtttcctctgcctcctcatcttcttcctcttcatcattttcccttttcttcttccttcccttattcctactttactgttgctttccccttccatttgatatttctctcttaaacaaaaatcactgtgcattttattcagctttttgtcttttaaaaagcaaaataaagaaagcctacgtgtacaaggaaagaaatgtaaaatggaaacatcactaacttggagaaaattaaaagaatttaatggtaattaaaataaaaatatgccaataaattagaaagcctggatgaaatggattcttttttttccaacttttattttaagtttggggatacaagaacaggtttatgacataggtatatgtgtcatgctgaagtttagggtatgaatgatcccatcacccaggtagtgagcatagtacccaaaaggtagttcttcaaccctcacccccttttttttccttccctcgctattagtccccactgtctgttttctcatctttatgtccatgtgtactgtttagctcctacttataagtgagaatatgtggtacttggttttctgttcctctgttaattcacttaggataatggcctccagctgcatccatgttgccgcaaaggacatgattttgttctttgttatggctgtgtagtattccatggtgtatatgtaccacattttctttatccagtccaccattgatgagcatctaggttgatttcacatctttgttattgtgaagagtgctgtgatgaacataggagtgcatgtgtctttttggtagaattatttatattcctttgcgtatatatccattagtgggattactgagttgaacggtagttttttaagttctttgtgaaatctccaaactgctttccacagtggctgaaccaatttacattcctaccaacagtgtataagcatttccttttctctgcaaatctgtttttttttttttgactttttaatgatagccattctgattggtgtgagatagtatctcaatgtgattttgatttgcatctttctgatgattagcaatgtggagcattttttcatgtttgttggctgcttgtatgtcttcttttgagaaatatccgctcatgccctttgcctacatttttaatagggttatttgttttttgcttgttgaataatttaagttcattatagattctggatatcagacctttgttgggtccatactttgcaaatactttctcctattctgtagattgtctatttactctcttgatagtttcttttgctattcagaagctctttagtttaattagatcccacttgtcaatttttgtttctgttgcagttgatttgaggacttagtcatagattcactgccaaagcctgtgtctggaatggtatttgctaggttttcttccttttttcttcctttcttttttttttttttttttttttttttgagacagagtcttgctctgtcaccaaggctggagtgcagtggcgctatctcggctcactgcaacctctgcctcctgggttcaggcgattctcctgccccagcctctctagtagttgggattacaggcatatgccccaccatgcccagataattttttatatttttagtagagatgaggtttcactgtgttagccaggatggtcttgatctcctgacctcatgatccacccgctttggcctcccaaagtgctgggattacaggcatgagccactgtgcccagccgatatttgctaggttttcttctaggatttttttataatgttagatcttacatttaagcctttaatctattttgagttaattttcatatatggtgaaaggtaggagtcccatttcattcttctgcatacagctagccagctattccaacaccatttattgaagaggtagtcctttccccattgcttgtttttgttgacattgttaaagatcaggtggttgtaggtgtgtgactttatttctgtgttttctaacctgttccgttttctgtgtgtttgtttttgtaccagtaccatgcttttttggttactgtagccttgtagtagagtttgaagttggataatttgatgccttcaattttgttctttttgcttagaattgctttggctattgaggctcttttttggttttgtttagaattttttttttttctatttctgtgaaaaatgatgtaggtagtttgatagcaataacattgaacctggatattgttttgggtaacgttcttttttttctctttgaaacagagtcttgttctgtcacccaggctgtgttttgggcagtattcttattttaatgatatgaaatgagttatttttaaacaaagtacaaattactaaaactgattttttattatacaggaattatgaataaaacattagacacaaacatgttgaaaaagttgttaaaaagtaacctctccaagagtactgaactctccccatggttttgcaattgaatgctaatgaaaatgtaaaaaaataaaaataccgtgctattataactgttccggccgggcgcggtggctcacgcctgtaatcccagcactttgggaggccgagacgggcggatcacgaggtcaggagatcgagaccatcctggctaacacggtgaaaccccgtctctactaaaaatacaaaaattagccaggcatggtggcgcgtgcctgtagtcccagctacacaggaggctgaggcaggagaatggcgtgaacccgggaggcggagcttgcagtgagttgagatcgcgccactgcactccagcctgggcgacagagcgaaactccgtctcaaacaaaaaaaaaataaaaaaaaaaaaaataactgttccaaagtacagtatagagaaagaagaaaaaattctgttattttttataaaactggaaaaaataatactgatatcaaaacttgacacagcataataaaaaagaaaagctacagattaatttcactaatattgatgtacttattgatatgaatagcatattagtaaatagaacccaaaagaataattcacaatgatcaagttgggctcaaattttacaggtaagtttagtattagaaaatggattaatataattgtcatgttaaaaagttaagagaaaaaagttagaggatattcttcataactactacaataatttaacattttatttcagattaatagctcaataaagtttacacagatggaaatttactaaacatgatacatttatatcagtatatttgtgtttgtcttctctaacagtctgtctagccatgtgtcttcaaaatcaaagtcatgccaaagaagcattgctattaaaaataagaacaagacaaagtttccaggataaatattctggagatagtagccaaagtaataagaaaagggaaagaaatgaaaaacataaaatttggaaggtaagaagaaagatatcatctacagaaaaaattaaggaaatcaattttacaaactttaagactttgaaaaaatgttaaactattcaaggtaggttacaaaattaatataaaaataaaattgctttactataattaataaacaacttgtttaaaagtgattaagaaaaatccattaacaggaaataaaacatatatgtatataatatgtagaaataaactcaaaatgtcaaatttatataactctttaaagtgctcatgaagaaatgaagatgactggcttgaataaacaaagaatatattcttttttgatgtaaagatggactattgtataaaaaaggtcgatctacctaaattggtctactaatttaacatgatcccaattttgaggagtttttggtacctagtcaaaaataatcagaaagaaaacttaaaagaaaatattaaaacatattataaagttttgatatttacaattacttaatagtcacacataaatagaaaatcgatagattcgaaaataaaatatagcattgttaacctgtgatcaaaaggtaaattattctataagtggtattggactaattggatagacatggagaataaaagttaaaactttttcatttacatcaaaataagttttagatgatcaaagatttcaatttaaaaattgaaaatgtaagaatactaaaagaaaatataggaaaatgctataattccaaaggagaaagagacttatatgcatgtcataaaccataggagataaaaaagaaaaaaaataaatattgggcaacgtgttttatcatatatgatggaaaaagagccacatattaaatacaaaaatttctcataaaaagatgaacactcctagctgagtgtggtggctcacgcttgtaatcccagcactttgggaggccgaggaagtcagatcacttgaggtcaggagttcgagaccagcctggccaacatggcgaaaccctgtctctactaaaaatacaaaaaacagttgggtatggtggtgcatgcctgtaatcccagctatttgggaggctgaggcatgagaattgcttgaacctgggaggtggaaattgcagcgagccaagattgcaccactgcactccagcctgggtgacagagtaagtgagattccatcacaaaaaacaaacaaacaaacaaaaaacagatgaacaatcctatagaaaaatgaccaaggatatgctagagagttcaccgaacaaaagacagcttaagtaaatgaaagatgtgcagtcatacttttagccatggtgatgttatatgttgaactacaattttttcatacatgaaagaatttgtaaatatcagagccagcaagtttatggaaaaatagacacatatacttttggtggtatataaactggcataatctctctggagaccaatttggcaatatgcattaatacttttttttttctttttgagacagtgtctccctctgttgtccaggctggagtgcagtggcacaatcttggctcactgaaacctccaccttccaggttcaactaattctcccacctcagcttcctgaatagctgggattacagaagcgcaccaccacagcctgtctaatttttgtatttttagtagagatggggtgtcaccatattggtcaggctggtctcgaactcccaacctcaggtgatctgcctgtcttggcctcccaaagtgctggattacaggtgtgagccctgtgcccaacccattaatactttttaaaaggaataagcatactttataaccagcagtttaacttttagcaaactgtcttagagaatatttgtccatgacttttttgagattttgattaaaattgctttgaatctatagattatcttaaagacattctaacagagtacttttttttttttaacccatgaacatggtgcactgctctatttaggctttctttcatttctgtcagtaatacacttttatattttggtattctgaagagtatagaggccttgcatgtcatattaatttctaactattttatgtttttgatgtcattgtaaataaatttaaaatttttttctttttatttattttctgctattatataagaatacaattgattttttgctgactgatcttgtctgtcagtctttctaaattattagttcaagtagggttttgtttttggtagattccttagaattttctggtaaacaaccctgttgattgtgaatagagtcagtttacttcttccttcccattctttctgccttttatttctttttcttgcctgattgcactggctaggacctctagtacagtgttgagtggaactagtaatagttaacatccctattttattcttgatcttaggagaaaagcattcaatattttaccattcagtgtgatactagctatggagttttcattgatgccctttattagattgaagaagttcctttctatttttagtttgctgagtttctttaaaatcctgaatgtgtattgaattttgtgaaatactttttgtccttctatttagattacacgcacacacacacacactacatatatatatatataaaatctcatgctaaatgattagtggatattatcttgatggttagcctttttctccctgagggaagaaacatactaaacatgctaaatgatttaaaaatattaaaccaatattacattcctgtaataagctctacttggtcatcattattattattttttacattgttaaatgctatttgataatattttgtgaaagatttttatatctatgttcataagggttattctgtgatttttattttttgtgatgctgtctagttttgataaaaaggttatgttagggctgggtgtggtggctcatgcctgtaatcccagcactttgggcagctgaggtgggcagatcacttgaggccaggtgttcgagaccagcctgggcaacatggtgaaacccccatctctaccaaaaatacaaaaattagccatgtgtggtggcatgcgcctgtagtcccagctcttcgggaggctgagacaggagaattgcttgaacccggtaggaggttgcagtgagccaagattgcgccactgcactccagcctgtgtgacagtgagagtctgtctcaaaaaaaaaaaaaaaaaaaaaaaaaaaaggttatgctagccttcacctgtgctttcaggaagagtttgtgtaggattggtattatattttccttaaatatttcatagaatttgctagtgaagccatctgggactgtaattttccttgtggaaatattttttaataacaaatttaatctctttaatagatatagggctatttgggttttctatttcttcatgtgtctgttttagcaagttgagtatttcaatagtttatttccaagtaagctaaattgttgggattattggcaaaaagttatttgtatttttcctttttaattgttttttagtttgtgaagtaggcagttatatcctctgttattcctggtattgttaattgtgtttcaatctttgttccttgatcacacttcctaaaggtttttaaattttattaatatttcaaagaagcaaatattggttttgttaatttctactaatgttttctatttctttagtatttgcttttatctttattaatcacttccttcaacttaatttggattcagtttgctcttctttttctagcttctttaggtaaaaaattagagcattgattttaaatctttcttcttttttatatcaacatttaaacctataagtttatctctaattctttagctgcattccacaaattttcacaaattgtacctttattttcattccctttcaaacatttaaaaatttccgttgtgatttcatctttgactcattgattatttagaagcatattgtttaattttcaaatattttgaatttataaagatattttattattattcatttttttttaattagatgaggtctttctgtgttgcccagttgtctcaaactgctgggctcaagccatcttacacaccttgacctcccaaaatgctgggattatgggtgtgagtcaccatacccagcctattattcatttctaatttaaatctattttcagaaaacatacagagtatgtttttcaatcttttgaaatttattgagttttattttatggcccagaatatggcctattttgttaaattttactgttacacttaaaaaatgtacatttttgcagttgttggatgtaatgctcaataaatatcaactacttgatagagttgttcacaactctatcaatatatctatataccgatatatatctatcaatatatctatataccaatatattgtctaattgttcaaccagttcttgaggagtgctgaaatcttcaactttgcttatttcttatttctttagtcctattagtttttgctttatgtattttgaaactccattattaaattcacacatatttatgattaatttttcctaattaagtgatctttatcattctgaaatgtccaggatttgagggcagttttatgcagattttgctccccctgcccccacattgtgtctcattccattctgacatttcccttctcaatatctagtttctctagtattcctgaattctgttccctgatgctttatgccagtaagacagcagctttccccctgatttctgatcaccatgccatgcatagtggggagttccttcagagagaaaaaagctaaccaccaaactaataggaactaaactaggtcttctttattcctaatttagagttttttcctcctatgtcatgatgctaacagataagtgtaataattgctcacttcctccagtactttttaagtagatctcgttagctaatcttgaaaatccttttatgattctggatgtgaggagggtagtatttcaatagtgagaagaaatgaggaggaatattttcaaagctaacacactggatgatacattaagcctatttcttttgttgttgtttttttggtttgttttttaatttacaaaaatgtgtgacctagatcatcagttgactgtaaaattctctttctataaagtagatatgaacatatatataaaatgtggagttgaggaaggcatcctagagatcattttatccagttctcttgcccccaaattcaggaatccctttgataacatctcttatgagtaaaacttagctagcttctgccccagaatttctagtgacagagaagaaatgcttctaactgttagagctgttacagaactcctgtgggttgggagcatcccaactgattagagttctgttttcagaagctatgtaaaataatactgttttatcttctacataaaactcttctaatatatgaaaacttctgttatgtgtctctgattcttatttttctttcgtataaaatatgcttaaatatcaccatttctttcaagtcttctttgcctgaacttgtcagttgtaactgctgagtccttttttaagcctatgaattactcgagtcaggtcgcccatgtcttcatatggttgatcatttcaaacctgtatagagctatcatctggagaatgataaaaatggctagaaatgtattttgaaaagtctaaactggttcactcttgcaaataactgttgcctctgtcattatctggatattcagtttttgcctaaacttttttgccaagttagtcccacaaccttaatgtgatagaagagataaagtcttcttgattctccttccttttttagcatctgctcaagtagaaaattcattatgattcccctttccttttttgctatttcaacatgttgcgatcatgctaccaattagaaatttttgagagttatctgtgttctaagtaaattaattaaaataccacaatcatcttaaaaggtagacatagccaagtgcggtggctcatgcctataatcttggcactgggaggcggaggtgggaggattgctggagcccaggagttcaagaccagcctaggcaacaaagtgagatcctgtctttataaaaaaaaataaaaaaaactagccaagtgaggtggcatgggactgtagtcccagctactcaggaggctgaggcaggaggatctcttgagtctaggagttcaggcatgcagttggccatgttcatgccactgcactccagcctgggtgacagacagagatcctaaaaaaaacccaaatcaaaataacaacaacaataaattaatgaattaaaaaataaaagatagatattatctcacacatttcattgataaagagcagagagtggttaaaccagctagccaaggacctatatatagcaaattatcaccacaagtggcttcctcactcacaattttctattcataccaccacctgtgctacctttctgttctgtttcatacttatttcattcggttttgcaatatgattgctggcaatcttgcttttcaagtaaattgtaagtgagctcacctaaggttcacttttcaattcatctttttttttttcaattaactttaagtgagctaccaaggggaagatatggtacgaagttttgtatctttcttattatcaagtacagtgctttggttatatagtaggactcttaataaatgattgttgaaatgaacatttaatactataaataacaatctccctcagggcatggagttgctggatatatggtataccaaataactaacaagaatttcatttaagtttatggtttattttttgtaagtcaccaacgattgaatacaatattatccaaggtttgtgtgtatatatgtgtataaatctcggcgtgagagagagtgagtgtgtgtggtttacgaaaacgttaggataaatatttaaggaattttgataaaattggctgtatgttagtctgggaattttgtggatgcctgtaagcattgcttaatgcttacactttgggcctttgctcgttattaaacttatctggacaaatgagattaaataaaacaaacatatgagtggaagggcaaattagcactaatgggcctagttttatgttactgattgtaaaattatgacagtgttttaagagcacttgtattaaacattatcaactttccataaatttggcttataccttccgaatagagaactaagtagccatttctaacatgacgtttttaaacaagagcaaaaaatcaaggcagagttatttgttttgtgcaggctttggggcaaagttttaacaaattaggtttgacattttggtaaatgttaaactatctcatggcattttaatagcattgggatttttcttgcccttactttactgtccaaaagtttggggacttggcagaaaagcttgggaaaactgaaatttcacttctcccaatgtggtattgctcatcctaacttaaaataaacaacaactaaagaagaatttatgctgggcacagtggctcattcctataatcccagtattttgagagtctgagaagggggagttgcttgagcccaggagttcgagactagcctgcacaagatggggagaccacatttctacaaaaaatttttaaaaaatcagcaaggtgtggtggcacatgcctatagtccagctgcttggaaggctgaggtgggagaatcacttgagtccaacagattgaggctgttgtgagccataatttcaccactgcagcccagcttgggtgacagaagcagaccctgtctcaaaaaaaagaaaacaaaagaaaagaaaaaaagggttttaaagataagctatggttacaatgctttttccatataaataatgcccagtttccaaaaaaattgccaagactagcatagcatttatttagttagttaaaaagtacatgagatgcagattaacctgcaatattacatgttaagtattgcttcaaaacacttggatgcaggaactgctttgatgagaatagagaaaggctatttgattgtggcctttcacaataggagaaaaaggttccttttccctatgttaaagaggacctttttcttctacattaaaacagtattatgggtatcttttaacattttttaatttaatttttaatttctttttgtagagtcagagtctcactgagttgctcaggctggtcccaaactcttgggctcaagcgatcttcctgccttggcctcccaaaattctaggattacaggtgtgagctaccacacttggccagggatgtctaatgtaagtctcctgatctgaaaaggaaattttttttttctccaaaaagacaaacgtggcctgtttttttttacctttcttttccttgctttgttctgattgaaacctctggttataatgtttggaaaaggaaatcttagaatatttcattggagttgagtgattctgctgcaatatgtttctttgggtgtggtggacagctatctgtgtgactggcagatttactgaatgttttgatttgatagggctgaagcctgctgccatatcttttcaaattctcctgcactcatgccttctgtctacagaagagctgcttatacttgtttggataatccactaatcttgttttacttgactttgtagggttagggttatatgtataccctggggcttttcctcccatagttcatcaacttttactaaccattttcccaatgtcttctgtgttctgataaattaatccaggctataatgctatatagatggtagtcacttaatatgttgactattcttttagcatgtacactgaatgtattgcctattccattaggaattttaaggaatttccagtatgtgaatttgttaatctaagaaaacattctttactaattagcattttggtggtaggccggtaggggaagatatattttgaaccctaagcacaaactagtacattctttaatttttattgcaggaccttaacttgaatatttgtataatgatcaaagtatatgggtctcccttttattggcaacataaaagagttgtatactagactgtgattggatatttaaaaaaagcttagttgtcaaaaatttttttatgaatggttgcttgaaggaaatataattaatttattcctttagatataccatattattttgaaataaaacccaagtatcagagatttaactacgtgagtcatgttactttgaaagtttacgtaactatgctttgctgcattcatcagaggcttttgcacttaaagctactacctgaaagctatattaatctaccccactcattctattcacagaattgaatgattgtaggagttatagaacccaacatcccacttgatacagtttttccttcacactctccagactgaaaggatgcaaacaggattgtttgaaaatcttcaggcctagctccagtctaaagcctgattggcatatgccttaccagattatagatgttgtttcaaagaacagactagtgcagtatctctcaaaagaacagcatccaggactgggggaagtagcataacagcaattaaaaaatacttgggactggccgggcacagtggctcacgcctgtaaacccagcactttgggaggccgaggtgggcggatcacaaggtcaggagtttgggaccagcctggccaacagggtgaaaccctgtgtctgctaaaaaaaatataatacaaaacaaaaaaattggccgggcgtggtgcacatgcctgtaatcccagctacttgggaggctgaggcagaagaattgcttgaacccaggaggcagaggttgcagtgggccgagatcgcaccactgcactccagcctgggcaacagagcgagactccatctcaaaaaacaaaaacaaacacacaaaaaacttgggatttaaataaacaatatggagtattttttaaagcattcaagggggtcagagtctccaagctttgtaagctaagagatagcttgtactctgcttggtataatccctctcatggtgggaattttatccggacattccattatcaaagatcttgaaatggtaatagtatggagatactagataaatgtaatgtgacttaaaatatcattgtaataataatttttaaaatactcatactcttccatttgggggtaaattacacctagaatagtattctcattcttattcctcaagaagaattaatattcttttgagtcctgtaatcagtcatacctagttttgagttgcaattaggtaacttcaattgatgtgtttttattgttgccactggagacatatatctatagtagagaaaattataggaatttaaagctgaacacattttgataaatgataagcatataacaaggagtgtttgcacttgattagtttcttaggagttggacagaaacaatcttgagctgtctctcttgttgttcaagaatataaaaaaacagtagctcaaatgtagtatcattattaacggaatcttatttaaagaatgatatgtcattactatctctatttgaaaatggcttggcctgaaagccaaagccattataattacattaatgtttaaaaaaagcgataattgccataataggtatgaattatttctatatttcaaagatagattaatgctagacatatcaaaatatgttaactacactgagaggtcaagatgaaatacggacattccaatgaatgaattgtcataaaggcaaggttcagcatccgttcttgatttaaaaaaattcttagtaaaaagacaagaacttttaaaagtttgacataacatatctgaactcaactaccgttaatattcttaatggtaaaatatttcaggcatccctagcaaaataattgtttttaaactactaacctatacagtaagaaaaaacacgtcgattgcaaacaatgcagttgtcaacttggaaaatccaagagattaaactgaaaaaaatataaaggtagcaagaattcagaatggtggtccattaatatataaaatcaatatcttttctatattaaaaacgaatctatcagataacagtgttggaaagagtccattaataacagaaactaaaaagttaactagaaatatactttggggtaagaaaggccattttacccatgacactgaattagaaaccataaagaaaaagatcaagtcagatttctgaccttaaaaaaaaaatcttaacccagtaaatgaaattgtcaggcaaaaaacaaactggaaaaatactaagtatatatgagttaaaattaacatataaagagttattgtagatcaataagaaaatgggtaaaagtcatgaacagttattttgtttaaaaaaatttaaatagccaacaaacaccaaatgtcacattttactggttatgaaaaatctgattaagatgctaatcccattttacctgtaaaatcagaatatattgaaaacaacctctgtgatggtggaagtgttgtgacctggtgttcatatgagatgcaggtggaagtggaaatcagtgttattttctgtagagcattgtgtacctatattagaaaaaccttaaaaacatgcatcttgggctgtgtgaggtggctcaggcctgtaatcccagcactttgggaggccaaggcgggtggatcacctgaggtcaggagtttgagaccagcatgggcaacatgatgaaatcccgtctctactaaaaatacaaaaattagccgggcgtagtggcacgtgcctgtaatcccagctacttgggaggctgaggcaggagaatcgcttgaacccaggaggcaaaggttgcagtgagcagatcgcaccgttgcactccagccctggggacaagagtgagactctgtctcaaaacaaacaaacaaacaaacaaacaatgcatcttgttttgcctagcagttctacaattgggaatttagccaaagtaaataaatcatatattaaaagagatgtgaattaggatgttcattgtggtgttatatgtataaacgaaatttggaagcaatctgtatttccaaataaaagtaggtaaataagttgtgataccgcatatagtaaaagggcatttactgtcatcagaatacacttgaacaagaaaataataacaaaagatgtattgtttttgttgtactttgttgtagtctgaatttttcactgttaaaactctttgtttttgtaagcagaacaaggtatttttaaagtggaaagaaagtgatgtgaaggctgatcttgtagaaatgttttcctaagatgcttctaccatgtctgatcatgtctatgtggttaaaatcctggctcctgaactcactagctctgtgacttgggcaacttctctgtgccttattgtccatctgtaactatgtattagaattgtacctacttcaaagagttgctgtgaggattaaaggaatttatatgtgtacttggagtagtctttacatacagcaagggctcaatacattttatggttaataaagtaagatgactttttggtgtgaaccatgggaaaacttctactcagctttcggtatcagaaaaagctatgcatctcctgaaaaatatgttttagttaatctaaaaatatagtaagctttaaagcttattatgcttccttcttgcttagctgctaattcataaatttttaagccaaattcagcaactataccttactatagtaaggtataccttaactatcctttaccaactatacaggaccagatacattttctctgtgctcatttaactcattactttattgttttatcaccaaaatttccccttatactaggattgctggatcaaatatatgacactcagttaaattttaattccagataaacaatgatttttttaaaaatagtgtttttcaactattacatagaacatactaacattaaaaaatcatttgctatttatctcaaattaaaatttaactatagtcctgtattttacctgtgaaatttggcaccgttatctgatccattatgtttatttattatttagttgcttcagatcctttgtgggataatactgggaaatgaataaacgaatatataaatgaaaaaatgaattaaaaaatatgccctgggtagaagaaaactttggagatatttccttaatctctgagggaaggatttcagaatttctcctctgtaatgacctagtaatagaattgtaatctacaatttgtagaatggtcttttaaattaatacagaacattcattgttttttcccctccaattctgcctctctccctttctccctccttctttcctttccctttctttcccttctttttctaaaagttttttaatgttaaaatttttattattaattattatagatacgtaataattataccctttcttttttcttcttcattttcttgtcttccatttatcgtcctttctttcttttgcttgtagctcttctttcattgatatcccattgaaaatgaacaatttggaagagttttagattcacttatattaggaaaaagaagaactatgagaaaaagatgaaaggattaggggttattcaacccagtgaggggaagtctgagtacaaagtggtttttcaaattctcttggatcaccagtagaaaggtcctatatatttgttctttgtaggcaatataagacaacagtaggagtttatgtgaactttatgtgacaaatatgggaggaacacattactggcaaggacattgggattgatgataatgctaatttcaggtaaaattatgaaatttatccacttgggaaattcactatgcaatttatgtccatagggaagagtcacaaagtacattctgaagttctcttccaaatatttcaaatcattctgtccatttacagcaccttctaaaaagtcttttcctcatcagtttgtattttagagtgaaatgcacgatgctctagggaattaattacttcctgacaatactaatccatgttggcttattcgcctgtcctaaatgattacatatactttattttcagccttctcaaaaatgttcctgttctctctgtttctaggtggctgctacaccccatgtaaaaagcggaaaataaaatgaagattttccagcgcaagatgcggtactggttgcttccaccttttttggcaattgtttatttctgcaccattgtccaaggtcaaggtaattgaaaactttgagaatcagtagggtctgggactctagctttcttgtttctgattatcattttattttatttatcctaacaatatgtcggcttttactgagttttaccaactgtttgcactgtagaaatatacacatctttgatgaggattacaacctcaccagtgactgagcatagtgattttgtggcaattggttaaataggtcattcttttttttttttttttttttgagtcagagtcttgctctgtagcccaggtatgatcttggctcactgcaacctctacctctcaggttcaagcaattttcctgcctcagcctcccaagtagctgggactacaggcatgagccaccatgcctggataatttttgtatttttagtagaaacagggtttcaccatattggccaggctgctctcgaactcctgatctcgtgatctgcccacctcggcctcccgaagtgctgggattacaggtgtgagccaccatgcctggcctattcttaaagtgcttctgaaaagcctgtgcaagtttaatcagtgaaagtcaaatttttatgttatgatatcagttatattaataatgctctaataattaaattgctttatgaataaagccctatttttacagctgtattaataaagaactgtaatgtgagtgtgtgtgtatcctaatcatgtcttgtctcttacataatgtacaggatatttctatcatttcatacctggtccttgattttgccccttttcttaaaaactgagcacatagtctgaacattataagggcctgacagagcctgccaatatgccatttcaagcattcctaatgatttctagctttgttttaattaaacttaatttgtgaaatctgctctttgcattcctgggatgggaacttttatttttgatttccattcatttttataaagtaagtctggggctgaaaaactacctgtgggccaaatctggcccactgcctatttttataaataaagttttagtggcgcacgtcatgcacatttgtttacatattgtctgtggctactttcatgctacagtgacagaattaaacagtcatgacagaaactatgtgtcccgcaaagccaaaaatatttatctgaaaagaatgtgctaacttctgaatatgcacaactgtgcaaagtgatattattagacaaacatgggaatctacagagactgaagtgttggtgatgaaatgttatttatcagctgagcaaggaattgtaaatgtgataaagtgattttaggaatgctaatgtctaatgtttggcattgagggttgtagaaaagatcaatgcatgaaccaccacacactgtttcctttaagggaggcgtacctgtttggaaaggaatggaacttgactttttgcatccacaaattgctattatacacctggggttaaggaactgtatttccaactacttcattgaacacacagcaggcagtttggtagacacattctgcttatgttatttatgttgatgaaagaatgcttttagctgtggcaattaggaaattctagatcacttatcttctaaactccaggatacaagacacagattcttagaaacaaagggcgggcaagttgctaagccctccagagttgctatctcagtctagcataattcagaagtggtaatttgtggaataactgatcatatatagctcttacgggatactttcaaggatgctgtctaccagatgaatattgttagccaaattctgttttttcatttttttttttttttttgagacggagttttgctcttgtttcccaggctggagtgcaatggcaaatggcgcagtctcggctaactgcaacctctgcctcctgcgttcaagcaattctcctgccctagcctcccaagttgctgggattacaggcatgcgccaccaagcccagctaattttgtgtttttagtagagagggggtttcaccatgttggtcaggctggtctcgaactcctgacctcaagtgatccaccctccttggcctcccaaagtgctgggattacaggtgtgaaccatcgtgcccagccaccaaattctgttttaagtgaacacttatggggcatattctatgtgtcaagttcaagatacaaagctaaataagacctatttatttatttattttttgccttcaaccaggttactgtgtactagggagacagggctgtaagcaaataaattgcaatataagttatgttgggggtgaagtgtggcagagacaaagatggaaagatagattgcagccagattatggaagattttaaacaactctgtttttgagaaaaacactctaatagcaatatcgatgattctcatatttgcaactcatgggggtttgagggataggaacaaacaagtcatgagagatcattaaaatatactaaattgtccatgaaataggtgttgaaggctggaagtaggcaatgtgattagagagaatgcatctaagaatcatttaaggggtataagagagaaaagttgtctgctgattataagtggagacagacaaaagatagggaaatattgaagataaatcaagtttcttgatggagacctgagcagatagggtctttcatcttgacccctgtgtcattactgcttctatatctttgcattgtaattgtttatttacctcagctcataaaagccaatagttctctctttagtgtctgtatctccagtacagagcaatgtttcagtcatagtagacatttgttgaagagtttaaacaagtagaagacaatgagttcagttttagacaaatatatggagcttaaggtgtctgtgggacattcaggtggagatggctggtaggcagttggtggtctggagtttagggaaaaaagatcagcgcaggagattatattcgaattgtattttatttaggaattcacttataaggatttttgaagccttagaactagaattaggaagggatatcaaagtggaaagaggtgaggatgaagtctgccaaacatcaatagagttcaataagagtttaatagaagaaaaatgactgattgaaagagtaaaaaaaaaaaatccaacatcaattataaggagagtcaggggaatgtagtggatgataagtgaaggctggagaaattttcaagaaggaagatggtggctgcacgctgggggaaacctcaataagaaacgctttagaggcctttggttttgctgattaggaaaatatgagacctttgagaaacctcatcttatttctaccattacgcctcttatttacgtgactgattttgagcaaggaataaaaaatatgaattgctttattggattgattttctgcttttaaagcaaatttagtagtgagttcctgtgggttggccaaatttgacattaatttgcaaagccaaatagacattttcagagaaaaaaaaatagtctggtggctcacgtctataatcccagcactttgggaggctaaggcaggcggatcatgaggtcaggagtttgagaccagtctggccaatatggtgaaaccccgtctctactaaaaatacaaaaaattagctgggcatgatggtgcgcgcctgtagtcccagctgctcaggaggctgaggcacgagaattgcctgaacctgggaggtggaggttgcagtgagctgagatggtgccactgcactccagcctgcacaacagagcaagactccgtctcaaaaaaaaaaaaaaaaaaaaagcaaagtcagtgtggtaggcagaataatgtacctgcaaagatattcacatataatcttcagaactagtgaatatgttatatggcaagggggaattaagatgtcagattgaattgtttgttaatcagttgaccttaaaatagggaggttagcctggattttctgggtgggcccaatgtaactgcaaaaagttttaaatatggaagagggagatagggcagccagtgtcagcggccaggtgagaaaaacttggctgggtactgctggctttgaagatggaaagagaccacaagtcaaggaatgtgagaagcctctagaagttagaaaaggcaagacaatgattgattctcccctacagaaagaaattcagcccttccgacaccatccttttagcccggtgagattgatttcaaacttctgacccctagaactgtaagatagtacatgtctgttgttttaagccactaagattttgaaatttattatagtaacgataatcaacgaatatagctagtattaaaagacattcagtatggctcacgtctgtaatcccagcactttgggaggcagaggcgggcggatcacgaggtcaggaaatcgagaccatcctggctaacacggtgaaaccgcgtctctactaaaaatacaaaaaaaattagccgggcgtggtggcgggcgcctgtagtctgtagtcctagctactagggaggctgaggcaggagaatggcgtgaacctgggaggcggagcttgcagtgagccgagatcgcaccactgcactccagcttgggcgacacagcgagattccatctcaaaaaaaaaaaaaaaaaaaaaaaaagacatacaggaaattaattcttgctccttaattgctaatccacagaatgtgctttaccatttagtctctccatggaatattttatgaaaaatgttccctctccaggacctgtgaacctacattggctcaaataactgtttaaacctggattattccagcatcttcttttcaagacaacttgttaaatgaactagaatacagaaaaagtagtgtgatggctgtaggagaaaaatgcgtacagcaataacagagtgatgggatccacactttcttggaaatttcacagtaaatatgtacctggttctagcgatgtttgttttggatggttacaggagggagccactgaaggtaaaataactcatttaaaaacctcgacgcatagaaaattggagacttcgcataggggctagctttaactttataaagacctctgtgttcacacgttgacacatatttcttgctgttagtagccaaacacatttgaaaagttgagaatattttccttacagctgttttcagcatctttataatggatcatgaaattacaacatatgaggttctaaaccacattaaaaaaaaatccctgtagcatatcctacagtaaaagtctctcaaaatttaattgctccgatttataaaacatttaggcagtacatttaactgaaaaaaatgactaacataaaaagctaaagtttttgtattttattttatttgttgagccagagtcttgctatgtcgcccaggctggagtgcagtggtgcgatcatggcctccacgtcctgggctcaagtgatcctcctatctcagcctcctgagtagctgggaccacaggcccatgcaaccacactcaactgatttttgtatatactttttagagatggtgttttgccatgttgcccaggctggtctcaaactcctgggctcaacgaatctgcctgccttggcctcccaaagtgctgggattacagacatgagccactgtaccccgccaataatcaaaaaagaatttttttgtttttagattacttggaaaaatagccaaatacttttctgctgtttaaaagtcttttaaaaataaatataattggttgccctatcaacttagcatcctaaaatatgttttaaagaggtaaaaactctcaatgtgattcatgctgcattatctttatcagccagaaatttttggttgtgaataaaataaattttctctggtcaactaagcaaaaatgtattcaccagtaggtaatgcagtagctcatataatcaaagtaaaagtaaataatcaagctttgaaaaggataggaatctgggaaatcctctgggatacagtctgtagaaactagtgaccattttccttagggcatgtcattggaatgactggagttattttccatccttgcatcactggagtcaagtttcagattcttgggagagtctgcttgaccgggtttaagtgattttcccagactttagccgggggaggatggttggccctatgcagtgggggaggtagtgttgttcgttggaagaaaaccaggatgctgtcatataaggaagaggagatgcgattatgggtagggaagaacacaagatgtccatttcagtgtccctatgtaaaaactagcgttttaataaacaaatgtgaatattttattaaaataagtatctttacgtagattgtcacttgacaaaaccgtaagcgttcaaattcagatgagaagaaaggaaggaaagaaggagggaagaaagggacagccaaaagtcaactctttaatgagtagattatgaaacagaatttcgtaaatgcttgataatagtgaggcttcaatgacatgacataaacatttctctcctgcctatgagcctctatgggaatgattgcagtggtattctttgagcttaaagaaaatcttccttcacaaacaaagcacaacacagcacagcagaataaaaatgcccctacactttcagtaacaagcctaactctgcagtggagtggaagataatgggtagccgctcctcagtcttccccctcagtctccctttgggatgatgtttatatattcacagatcttatatcaggcctaatctcatgtgcaatctcatcttttacacttcaccatgcaaaggatgagtctgttggtttcctctgggctcttggtgtgtgctggaaatcaaactttacacttgatgttcgtcttttttaaaagattaggatttgaactgacataaattaatttttcagtcaagttcatgcaaacgtttataattattaatggaagttaagtatatgttaaaaaaaagtacttcctttgtgcttgcaaacagaaaaatcatgggtctggtataaaatgtacacaaagttttgttccatgagataagagcaattatttctccatggcacttaaagcatttctgtcaatcctgccgcccttgctttggctccagtcccagtgccttctgaaagggggaaaaaacctaactttgaaatccacagctgtgacctcaggcctctttcttttttaactagcatttcttcttttcaatattttttaccctaaaggcaaaaacctaaagaaaatgtgtatgttatgtttaaccaagatctccttttgatgactgtgagggtatttatgcttctataggcaatagatgtggtctgttgctaaaaggtaataatgatattgtttttggctagcagttataatgggaatgtagacagttgaatcatttgtaaattaatgaaagagtagagtattgatggatttggtcgttgcatttgcttcaacagttttacactttgttttcttgagcaattgaatggaagccgatgccactcttggttctagaacaccatccagattacctgaacatgctccacgttgccctcattttctactggagatttggaagccaaatcttagtctattgactaagagatgttgagggctataaactcagatgacatttaaagaatagtagcatggatagaaaatttagtaatttttaacctaggaatcctgaatgttgtttgctgttttgagatgtcaacacacctggagtgctaatggaatcaatgattctcttggaatttcctagattgaagcctccatcctatttgtacttttccacttgatggttccccagacagctttctttcagcagctcattcatgcaaaaacttgggcgatgacatttactagtccactgacttgattttactcagaaacttgcatatatttttaatatttaaaaattcttacttttaattttcttccataagtaataagaacctatctattaataaattttcttctcaagttgatgactaagcaaaatagtaacagttttctgttcatccaaatgttaggttcagcaccttcctcttccatttgaaaaaagttattcttatgataaatttatgctttctcattagccagagaaatgtaaactctttcttccattcatgtcacattgagaacaggaagctaatgtttttattcagcatggctagcattctctacttagagatagtaaaggacaaatagaaagaaaatctattcttaagattgtgtctttcagtgcttactgatttcagatgctttcatctgatttcatactgatttcagtttgtggagcagtaaattcttcattcatctagctcaatgaagggtgacttctttttttttttgagatggagtctctctctgtctcgtccaggctggagtgcagtagcctgatctcagctccctgcagtctccgcctcctggattcaattaattctcctgtctcagcctcctgagtagctgggactacaggcgtgtgccaccacacctggctaattctgtatttttagtagagatggggtttcaccgtgttggtcaggctggtctcaaactcctgacctcaggtgatccacccgtcttggcctcccaaagtgctgggattacaggcatgagccaccctgcctggccgagggtgacttcttaatatgaatcatctttcaaagaaacagtgcatttcatctggggtcagagattgtccttcatcagtatgtgaacttgggcaagtgctttagttgcaccttggttcctttatctataaaattggaatagcaatgtatgtttcgaagattaagtgagcttttaagctgaatcattacatgaagtaggggaaagggaacaaatatttattgactccctattataatgcattatattcatgatatccattatcctatttaaagttgtcatctctcctttgcaaaaagtattgccatcaccttttctaaaaataaagaaactcaggttttggaagaaacaataacctgctcaaggttattagctaagtggtagaaccaagaatgaaactaacagccaaaccccatgttataccccatgcctatgtaggagaatgtttgtttcttttctgtacactctgttttttaaaatgagaaagagagactgggcttaaaagtggataaaaaaggctaacttttccatgaagtattaacttttcttttctaacaaactaatttagagagtatgtaataaaaacgttcttagcttttttgaaatactggaacatttgtgtagtgttccagaaatgtgttttgaagtttgaatgacctacacaaaaagtaacacaaaaatgagtacatttttgtaaactgtcagaaaagataaaacattctgggctgattcatgaccatgtgctttgtatctttctgacaggtataaatcagctatccttgaaaactggatccaagtttataaaacataattattttacttggtcttgaatgcctttacaatcattttctcaaatgtttttaaatgaatatcttattaccataatatatccgtaatagccctctcaaattatcatataatcaaaaatattgaattaccaaagtgaaaaacctaaggacaaacaacaggtctcagtagagtagattatagaagctcacatgtttcaaggagaaaaatttatccttgtaacataatgaaagcattttacaaaattagcttcaattattaaactaggctagagtattacattctaacacttggtcttagttctttgtcataaggtcactactgtttgacaaatggatatcccttgggtaagaaacaaatgcctttagttttgtgttatcttgcaaactgatcagttcattagtgaggttgtaaaaaataatatatattatggccaggcgtggtggcttatgcctgtaatcccagcactttgggaggccgaggcgggtggatcctgaggtcaggagttcaagaccagcctggccaagatggtgaaaccccgtctctactaaaaattcaagaaaattagccgggcgtggtggcacgtgcctgtaatcccagctactcaggaggctgaggcagagaattgtttgaacccaagaggcagaggttgtagtgagctgagatcgtgccactgcactccagcctgggcaacagagcgagactccctctcaaaaagcatatgtatatatattatatattttgaggctgatgaagtcttttgtgtgtatttttattatactactttgactttctgatttaacaaatagaagcttaaatgttacaatgtttacatcatttttgttcttccttttcagtggctccacccacaaggttaagatataatgtaatatctcatgacagtatacagatttcatggaaggctccaagagggaaatttggtggttacaaacttcttgtgactccaacttcaggtaaaaacaattgactttgttttgtagagcattagcaacttttcatgcataggcaactaaaaacatgtagtgccaagcattgtgttaggattttttggaagcttttggtttgtttaatcttcagtgtttaaaatcttaccctctaatcaaggtaataatgttccccaaagagtaaagaatgactcttggctccagttctttttagaccaaataatcagacaatcaacaagttttattttctctgtttagtcataaaatgaatactttgaattcattggaacttaaatatacaatgcacctgaatgtccaatagttttgactagttgaataaactattattaattaactcaatagaataatattcagcattatacattgaaattagaaaggctaagtggacattgtgaaaataagtgataaggcaggaaaaacataagttgaacacattttttgatcatgaatagttatttaaggatgctttaaattaagcatctttattttaaagatgatacttaaatgatgcttaaagatactttattatttaaagaagctttaaattaagtgtctttaaataatgaagtatctttcaacatcatttggttgaatttttctttctcatattttatgtttttattatatgaatataataagctaaaataatacagaccatatagggaaattgcctctgctacatggttgttatgaagatgaagatgggatcaacaactggattgcttgaattcaaaactcgattctgtcacttataagtagtgtgattcaggcaagttaatgactcagtgcctcaagtttcttctatacaatgagcaaacaatatttgtacccaccccatggagttttctatgaatttgcaactcaaggttgatctgggatcagcagcattggcattacctgagagcttgttagaaatgcagaatactgggctctacccttgacctcttcaaccagcgtctgaattttaaaaagatccccaggtgattcctatgcacattaaatttgggaagtactggttgtgaagactaaaataaatataaagcccttagaacagtggtgccatatagtaagtgctcagtaaatgttacctatgattgtcataaagatgctctcaggtcccattagttctccaaggatccattttcacacagtacataataagtacttaataatacatatttgtataatatatatttatgtaaacataattattttttctttttattggtgataaagagggttatatggagctacaagcctttcagtggtagacctttttccaaaagatacagtgaaggagacagatgctgtattgttcattaatgtggacgtcttactcaacagttgacgtaaacattcaaacaagacaagcagatgaaacacctggtttcttgcttggtcaccaaaaggccaaatcttttatttattttttaattttttaaattttttgagactgagtttcgctctttgttgcccaggctggagtgcagaggtgcaatctcggctcactgcaacctctgccttctaggttcaagtggttttccgctctcagccccctgagtagctgggattacaggtgcccgccaccatgcctggctaatttttatatgtttagtagagatgggatttcaccatgttggccagactagtcttgaactcctgacctcaggtgatccacctgcctcagcctcccaaagtgctgggattacaggtgtgagctatcacgcccagcctgatatatctttcattaagaaatattatccgtagactcattagaatgacttctggttgagcaataccagatgtccacttttcccatggtggcgtacagaagtgacttgcttatggaaaacaatatttgcaaaccttgttcagagttttcattttggagtatgactcagttatgaaatttctttgatttttaaaaatatagcttatttttttaaaaataagctatcatgggaaatttaaatttaaaagattcttgaagatttatgattctaaaggtcaaaatacaagttactattttttgttacctctgagaatccctcatgtctgatctggaaaggtaattttttttccttcaagtgattggtagcttaactttttttgattaattgctgataataccaaactattaagtacccccaagcaagtgttactgaggaatcacagaattgtagaagtgacttgggtagcctctgaaacaaaccttcatctgaatgcttcaatcctctcttgaagagtgcacccaagaagtagatgtctagttcttgcttagacatctcccatgataaaataaaaattgggaatgaaagcaaattatttcttcataaatgctaggtttattttccacagtgttcttaccgcagcaacccaagacaatcagtcttgacaatctggtatctatttgattaaacatagtaaataaagagtaataaatacatttagctgcaaaatgtttatagctgtttcaacactatgagatatggtccaactattgtttctgccagcctttctgaaagcatgttccatggtattctgtaggatgctaatagctattatatagctaaatagtttaatggtcaaataaatttgggaaatgctggtttaaacagagtttaaagctttttttgtttgtttgtttgtttcaggaatctcaaagcctttaataaaataatacactccataactctcaaagagggactctaatatacagggtttgttttttgagaaacttttttttagtgaaacacacattgtgaaagatatattaggtgcactttgtagtagatgagttttaaatgacagaagttcctaaaaccagatttaacatcttgaacataaacgcacataaggaaatgggttttggcaagagaaagactccattttgccctccagtagcaggcagcccagataatagcagcatcaaatttcagatttaaaaatattaattttattggcatatgattaaattataatctgtattatgtttgattaattcagcaaatttcagtcttctcttgctggtactgctagagagacagaagttttaaattaattttccttttctcagacacataattgcaggcaaaaattagagaagaaaagtaaaatttggaattctgcataaaagttgagtatttatcatcagcactttcaagaaagccttagatgtcagtgtaacctgatggagaggtaatgggattttgaaatcttttcatgaaccaagccaacttttaagtagccagtcaatgagtgattccttcagcatcctcagccatttgtggtcagatttaagataattaaattgctcatgtttcaaggatgctttgactcactttagagaggctgtagaaaaaaattccagtgtaaataattaccttcggcctgcccatatctccccttcacattttttttttgaggcggagtctcggtctgtcacccaggctggagtgcagtggcgcaatatcggctcaactgcaacctctgcctcctgggttcaaacgattgtcctgccgcagcctcctgagtagctgggactacagacaaacaccaccacggctggttaattttgtgtgtttttagtagagacggggtttcaccacattggccaggctggtttcaaacccctgacctgaggtgatctgcctgcctcggcctcctaaagtgcaaggattacaggcgtgagcctcctcacctggcctcccccttcacttttaagtggaattctttccttgaagagtatatctgatgttgagggcttgctgtcctgtaatcttgtactatggcttttcctgctatataaaagcagtagtgtgttatgatgaaatatttttgtgaatttggttttctctaatttcgacaattgttagttatctaatgtaaaaagggtacagctaaaaaggaagatggaaactattttataattaggtgcaatacacatatataccattgtatgtatttttaaatgtcttcacctcttgatgtatgtaaaaaaatcatgatgtacactctaaatatatacactttaaaatatatacaataaaacacatttcaaaaaatgcctttactgtttaacaccataattgctaactaataaagtttcttaatgtacacagtggaccttatttcttagaactgatttatttttctcttttattataggtggaaaaactaaccagctgaatctgcagaacactgcaactaaagcaattattcaaggccttatgccagaccagaattacacagttcaaattattgcatacaataaagataaagaaagcaagccagctcaaggccaattcagaagtacgtatttacagttctcaaagcacctccgcaggactctgtcccagccttggatttgagtctgtgatatatattctacaacttaaaattctagatttttcagatttatagagatcctagaagaccttcagtcttaccttcaacgaattcctctgatctctaatactttgctacccttccctttcccccattttgctatattcttacttatcctttatgctttagtttccaatgaacttcttaacattggctcctgaaccttacccagacatctctcctatgtgatttcttagcatctagagcttcccttctggtactataacaccatattgtaattgcttatttacttctctgtgacccctagaagcctgcaagttttgcaaagactgtaactcaatgatttttatttctcattgtatcacagttgcatattacaggcctggcatataatgggcgctccatgaatatgaatgtctgaatggataatgcctgcatctcctctgtaggatccccagaaggcgccagtccaggctctactaaaacagcctatgcaacagggaatttaattctttccaattgttaatcagttgacacagggactgttctatgccagtctccatgataagctgatttgtcaacaaatacaatgtgataagtattggagagagtacatataggactctgtgaagagaggtactctctctgcccgagtaatgggctgtggagaggataggcatgggaaagcttcatgtttgagccagttctcaaatagtaaattgggcatttggagaaaggatagggtgtgcagaggacattctaagagggagtgaaagctctgcgatggtccaatcaatgtccacacagttccttaggaagcatttccttagattgagtttaaaaatggtccacacaggctgggtgcgttgactcatgcctgtaatcccagcactttgggaggccgaggcgggcggatcacctgaggtcaggagttcgagaccagcctgaccaacatggagaaaccctgtctctactaaaaatacaaaattagccgggcgtggtggcacacacctgtaatcccagctacttgggaggctgaggcaggagaatcgcttgaacccagaaggtggaggttgcagtgagccgagattgcgccatcgccctccagcctgggcaacaagagcaaaactccatctgaaaaacaaaaaataaaataaaaaataaagatccacacaggccctgattcttctgtctctcaggagacattcattcattcttttttttttctgttgaacaaatgtacgccacatgcctactaagtgccagactgttttctaggcacttgggcacatgacaaatccctgcccctatgaatcttatagtctagtgaccagagactacagcaacatcctcttcctgaaagcagtgtttcaaatgtgaaggataaaaattttgtattgtgaatgcaaacagaagagacctagcctagttaactttctgttacttcattgctaaaacagactcttttaaaaaacccaatttattattaaggacaatttaaagcataataaaaaatcatcagaatagtataatgaacccctaagtagccatcatctggcttcagcaattagctgctcagggccagtcttatatcttctatctttcaaaccctttgccttattattttttgaggaaatcacagacatcatttcaagtagatttttttctaaattttaaacaatagcttttaaaatcctaccataagatgaatccataaatctgtgaggtggtgggtatggaactttttgtgcagcaatgttctatctagattttttacaccccttccctcccttttttctcttcctcttgttggtaatattttgtgagacttataggctggtgcaaaagtaattgcagtttttgcaattactttaaattggaaaaatcgcaattacttttgcaccaacccaatattttgtgaatattttaaaaatttaaaagaaaacacaacttggttaagttacctcttgaaacttctgaacaaagacatttggcaaattcacctgtcagcaggacatacacatgttgtaaatgttacattcttttgagattcactttgtctgggagctttggaaaaggtttttatgttaattttggtttaaatcagccttctgtctcattttactggcactgcactttagtttctggcctccaacattcctgcatgagttgctgaaataacttcacttacagtttgtgagaagcagtaaaagggataaggagaaaagattcatctttctctagtctgaggttttgcaattgattatttcaaacattccactgattgaacaggggaagaaacacagagagtcatataaatcttcccaggctacttcttcaaaacacataaaaggaaattcatttgtttccatcttgcttaactctgctaagatagctgtagagaaacaatataacttttagccagataaataatatgcaagcgtgtatgtttttagctgtgttatttttattggcaggatagagggatttgttctgcccaaatagcagtttgtaagaataaaatgaaaattgcttggatagctttcttttcccttttgcatttcatttatattcttgctctctgtgagacagagctaaagcctagtctcctcttcctagaaaactttcgtggttggatccaggaaagtggtgatcaagataaagccttgtggctataggtttgcatttagtgcagggatttgcattctttatgagttcatattttgatacacagtaaaacataagaaatgatgtttgaatttttaagacagaaaggaatatctgatctaataggtattatgattccaaatttgccacaagcagctcaaccacttccagcctcagtttcttcacctgcaaatgagggtgatgatatgcctattactgtgcagatgagcttacttcaccacgtagtacagcatggtagctattgttgtcgtaagaaataccattttgcttgtaacaatctattttccaactgattttgcccctacatgaggaagacatatatatcttatatgtgacatagtggatcagcttccataatgtctgttattttttcttgtttatttatagactgcttttatagctctgtgttttaatttaggacctttaaatatggagggcacctcttcaacgattaggagagacacaagatggaaataaaggttttattacttacaggtcctgggagttacatggtatgcctggaggccacacccatggaggtcagggagcacatgaagtgggggcacccataagccaaggtctttaatggggtccagggcattatccctgggtttctctgaggagagttttaattgggggatttgaagtaagcaggcatgagttccaggaggtcacactgtgactgagaggtggtcattgtggcatatctgcatagtccctgcagagaatgagggtcagtggggccagtcaggtgggctgtgtgcagctctcccatagagaagtagaaggtagaaatagatctaggagagaataatgaataataagagtaactcccgagtagagactggcagaaactcctctggaaaggtgacatttgaactagactttgaaagatgggcagggagcagttgtttaaggcagatatctggattaaccacatttaggaactagtgctttagggtatgttgtaggactggaaactgtgtcaagggtgactgagcctgtttctagtatgagtaagtccaacttatatttaaaatggatgctgaggcaacataaaatttataagaattcaccacattctatgttggaaaattttttctcttttaaatgtgtcttgtcaatctttgcctgcaaattcctgcctttctttggaagtctgactcaaaacggaagtttctctaagtctctacctctgaatttattactagtctttcccagagctatttctacctccagcatcactcagcacaatctttctcatattaaagtggcagacatattttgttttagaaaatgcaagtaatttggggtgacagcccatgtgtgggtggggttgaagatacagatttggaaattatctatgaaaagatgagaattttaattgtgagatggtaaaattacaggagggtgtagagagacacaaggcaaccttagtatatgattgtgtttcgtgaatagtaatagagaaagagcccaaagaatgcgaatgaaacggagtggtcaaaaggagaaaaccaggataaagccattctaacaactgagaaagaaaagaatttaagtgtgtgtgtgtgtgtgtgtgtgtgtgtgtgtgtgtgtgtgtgtgtggtggtgatgatggtggtggtgggggtgctccaaagtgccaatgcttatcaagaagtcggtgaatgaggttttaaaaaattgttataaaaatttatacatatcaggatcaaggtatcttacatttttatttttaaaatcttttaaaattttgttttatatcctggaatttaatctctgggtagcagaaagccaaggaaggtttctaagaaaaggaataatagaattggagtgacatgaccttggcaaatgacagatctcaaaccatttcagcaaagggatggaagacagtggaaagaaaggggaggaggatgtgataaagacaggatgaatggaacaatatcctggagaaggcagcaagggtggttcagaggaaatcattgtttcccctatgtagcttaccctttaatacatttgctgatttccatgaaatgaatgtagcaattaattgaaataccttggctcacttctgcattttcacagggtgttttatttgtgcagagaccactgacatttggcaggctcttgactgcttcaaacagcctgaggtgctatttggcagaaaagcagctgtgcagttttaaggagagaatgcagtggaaagttaagctaatggtgtaggttgatatgaatttattaaaaggccaaggggcattttttggtccttgaacattttctaattaaagccataaaaaactaccatgtattaatagagacctttttttaagtttgaaaaggaattattataaggctcttcatcttcttgttttgctgttggagcaattccaaatgaggctattcatggttaagatctttctagaatggggaccaagctcatcggctaagtccagagacttgaagatctggctttaaccccatgccagcacttaactggttttatgagataggtgttagctttctggttcttcattccctcatgtataagctagggataattatgctgattttacagcagttatgaaggattaaatatatgtgacacatctgcccatagtgcatactcagccaaagtaattccttaagtgtttctgtgtcttttcatgtcaaagttgagaaaaaacaaaacaaaacagcagttctaatatttggggatgagtttgtaccacggagctcatttctatagatacttttagggctttcaagggttttagtaaaactcactgaatattttcttttagattttagtataacatggtgctgtatctctacttttcttccagttaaagatttagaaaaaagaaaggatccaaagcccagagtcaaagttgtggacagaggaaatgggagtagaccatcttcaccagaaggtcagagacgattttaattaactcatattgggagttgggttgttttaattacacaggcaatactcacatgtggggttgctggtcccatctaagaagggcaggtctaatacgaagatcgcctgtggcctctttgtactcttccttcctttcccacacaagatgacccccaaccacttggcacgtgacctttcaggcacctttctcagaatggtgcatatatgtacagcctgtcatatttcttgttctgtgcataccttttcacttggaaacctttacatgccaattcatataggaggcaggatcacccagtgtaaattgcatgggctctcccacttgcctgcctaaattcaaagcctgcctttaccactttgagtgatcttatactagttatccgaatgtctatgtctctatttccttatctgcaaaatgtggagaatgggattcagatcacagagttctttgggataaaatgcgttgatatgtgtaaaatacttagaactttgcctgccattgaataatgttaggtattattgttagtctacctcattctttttaatagccagatagtgttctatgggatagactattataatttattgattagtccccccaaccccgttttttttgaggcaggatctcactctgtcacccaggctagaatttagtgtcacaatctcggctcactgcaacctccgcctcctgggttcaaacgattctcctccctcagcctcctgagtagctgggattacaggtgcgtgccaccatgcccagctaatttttgtatttttagtagagacagggttttgccatgttgtccaggctggtctcgaactcctgacctcaggtgatccaccttcctctacctcccaaggtgctgggattacaggcgtgagccactgcaccctgccgattattccccttttgatgggcatttaatgttgtctaattttcactatcacaaacatgctgtaacaacgtatttctaactgtggaactgcaaggttaaaggataagcaaattttagattgccaaattgatagatggcaggctctatcaatatcgacttaaatttttttcagtaatttgtacttctgttaacgatatgtaacaggaattatttcatatgttcttttcaacatttgaaatccttaatattgaaaaaattctccaattatatatcatttgtttaatttacatctttttgattactagtgaggttgaacattttttcatatctttagtagtcatttgtaatttttcctgtttatttttgttttgtgttgtctttatttctttaatgaacacataaaaactttctaaatattttgagtatgaaacccttttctacatattgttgtatttttgcaaatattttctcctggtgtataatttgccttgcaactttattcatctttttgataatttttaatacaattaaaaaattcttgaaaaatgttttactctgaattttgatgcatttcttggttttctaatattttaatatgaaacattttcatacttttcttctaatgatgtataggtttatatttatatttattacaacttattaaatatgttagatataaaatgtataaaaataatgtcatagacatgtttgtccagattaagaaaataaacctattaccatacagttaaaactcattgcttattcctataaattccccttcctgtcttgtaggaggctgccactaagctgaagtcagtttttatcattccaatatgtctttatcattttacttcatatatatttgccagcttaaaacatatttaattatacaaagttcaaattttatatatctttgcttatgtctccttctgtacaagtcgtagaatttttctagagcatataccttggagtcaagttatttagttgctgcatgtgtatatttttatagctcctcttgatatctttttgtgtttttatatctaatacttacttcattgtattttcttttttctaacatccagagttgagtgtttatcccttaatttttaatttttcttttctattatatgcattttaaaatatccaagtactgcttgagctgtctcacatagattttgatatgtagtattgttatgctgtagttcatactattttctacatttcactaggttttcttccttgatccatgagttacttagaaatatgctattaatttctaaacatctggagattttagaagaagatatttatttattattgatgtctaattattgcattgtgggtagagaatggggtctgtaggaatattctttgaaatttgttgaggtattttattacttaaatgtggtcagtttttaaaaccattccatgtgtccttgagaaaaatgtgcattttaatttccctcgatggtattagtccatttctatttgtaactctggcaattttgttttaaatacctaaaggctagatacataaaaataagaattattgtatttttctagtcaatttttctttttgatattttgtaatgattctttttattcttagtaattcaatattcacctcaaggactattttatctaatattaatatagctataccacctttattttatttagtactcacataatgcattgattctctattctttaactttcactctctttgtgtctcaagttcaaggtgagtaatttgtaaagaagatttatttgcattaaaaaaattctcttacagtcattgtgttttacttgatagctttggtttacttaaatgtgttgatgttactgataattttggacttactatttattttgtgctattaccctacatttttcttatcttttttccccctttacaccttacttaaaattgaccaagtttcttttttctttaaatccattttagcacttactgacctggaaaagctaacatagtctaatactaatcaatatctttactatttccctataatacagaatatagaatttaataatgctttaaattcaatgattaatgtcccatcttacacatcattcttgacaaatacattaacttattttttgcctcacaaatatattattgaatatatttattatagatattctttaacaatcagtgtttgtccagatttgcccacgaagttattttgctcaccatttcatcttgcatctcagaccttctctgtgtatccacttcccttcacagaagatctgtggtggtaaacttatctttattcatgcaaaaatatctttactctgcagtcactattgagagattagctgggtaccagattaagagttgtctctaatcatttcaaagacattttactaccttctggctcctgttgctttgttgacatgtgtgttttcagtctaaaggttgttccttggtaggtgacctctcttttctctctggttgcgtttcaggcttgctgtcttttatctttggggttctgctgcttcactgtcatcagcccagatgtagatttctttgtgcttccagatttcagatttatatctttcaccaggattagaaaattcttaacctttaactctttaaatattatttttctcagcaacttatattcatattctttatctcaattagatttatgacagtttcttttgacaatctatgtcttttaatagtaatattttgtacctctctgattttacaaataatattttgggttccttatatctgtcttttaggacactagatctcttcccctttctaatctagcctgttcttttcaatggggaaatcttttagtcctagaaattacatttgcttctttttcaaggttgctagaattttttatggtgcttggttcctttttaactttttaatcattttgatattttaatcatgatcattttatattctgaattcaataattctattattaaagtattttagggttaaattcttttgtttgtttgtttgtttgtttgagatggagtctctctctgttgcccagacaggagtgcagtagtgcaatcttggctcactgcaacttatgcgtcctgggttctaatgagtctcctgcctcagcctcctgagtagctgggattataggtacccaccatcatgcccagctaatttttgtatttttagtagacatggggtttcaccatgttggccaggctggtcttgaactcatgacctcaggtgatctacctgcctctgtctcccaaagtgctgggattacaggcatgagccaccgcagccggttagggttaaattctcgttgcttgtttatactgactttcattcatggggctggtttcttaggatgatgtgtcactttggcttgtggactcatgtggaaattgttcacagcatgtcttaagggtgtgctccttcagaagggcacattttggttgctactaacctggaaatcctctatgttaatttcttgtcttaagatactcagggcttggttacaaattcacaggacagacagttttccccccacacagagcttaggccaatgtacaactttccttgtcatctcccttgctagaaagcagttatttttctagtccagcaatttgtaaggatatagccctgtgagggtgcctcccttacataagaactatcaaatacaacttcccaccttgaatgcattaaggtcttgtctcccgttccagcatgactattacagcttaatgtcttgattgataaatttctggttaaggtgaaatctaccagatatatattttcccttgcagtaagtaagtagcttatgatgagatattttgagacatgtaaatattctgtttcttattaaaatttcacctacttgttttagtgtctactgattcttgcctgagtcagtaactattatgatgtttctcaaatggtaatttttctaactccatttttcattctacatttattatttggcattctactgtaaagaagctttctcccttctcccacatttgtttttcttttcatatgagtatggactggtggattcttagtttatttgagtggattataatccattactatcattatttattatgatgctcaaattgttccagatttgctaggcgggaactatttcatgctgtctcttatgtcttttaaatatgttcccatcatcccttaagttatttcttactttctggcacaaactttacattctgagcgcttgtattttttctacctggccctaaaatgaaccatttcttccaggagtcctggcttctttttgtggagaatagtattttgaaaccaaaatatgggtactagctgtgcctattgcttctggagtgtcataccattatctctctgtctgtctctcattctctcattctcttgctctctagcaatcaatcatctatctatctatctatctatcatttatcatctatcaatcatctgttatctatcatccatctatcatctttgtattatctgtctctatctatctatctatctatctatctatctatctatctatctatctattttactgcatcttatatctatcttttgcccataccacagggtttattttagccctccttcttctaatatttataactcctctttcaagagagtgagaaacatggctcccaatattctaaatatatctactcatatggtcaatcatagaaatagttttagaactgctaatctgtgcatactgcaaaaagacaaacaaatctattaacgagttcaatgtttgcttttagtctaaggtatatcatatctgtgttcaaaaggatcttggattagttcttttcttgcctattcactgtggttttcttatttattttaatacagttaagttaatctgtgagtatgtaaaacattggcacatttccagaagttgaaaagtctacaaaaggatgacactgaaaaagaagtatcacatctgctattccttccatccagttttacttgcccctcctatataatcaaatgtgttagtttccgtcttatcctttgtatgttttctttttgtaaaaataggtttgttaatatttttaagggagaattttacaaggaagtttgtgggtttggattggcatttttttttttttgccacttgatgcttaaacaatggtgtttaaggtgaaatctgtggaagcctctgtggattagagtttggtgtcagaatttattagctatagctatgtattcctaaagtgtctcaactgctgtattctttcccctaacgcaccttcctctttcctttccaaaacctaggattgagtgaaacaaattaaaactaagaagtagacaacggaagagtgaggctactattggcaaatgttctaataaataccaatacacatttggagaaggaagattcataagcagtccatttccttcctcactggagatatgtttgaacatatgtttacggaggagttctttctgagcccactttcaggcaggcactatctcaaagggtttattgtagtgatgagaacttggggtagggcaagaactttcaggaggtttatggaaaataggtgtcttcctctttcagatgagggtttccatgaggtgtgtgccagggcagtgaggactttgtgagagcgctggttatgtgagagaattgtcttaagaagtaagttataaacaatggtgacaatccaggacagagttacggctcctaggaggtggaggggcatgcactagtgtggcccactggagacaaaagatgcccctgctccaccccaaccaggtcgtttatgcaacccttagcataagcccctcctccaagtcgtggtactctcgtgatccacatttaactatactgctctttgttttccctgaaatctacaattttcttgtataagagtctacactgatagtggctgagatacaatcagacgtattatacatattttacaattttagtttaaacgcagagttaagatccttaacagaagtggctgtgcagttaaagttacagttaagattgtttccaatctactgtacatgtttctttaataatgcaaaatgaactcacaaacaaaaatggtacttgcctttgagcataatattggcacatttgcattaatggctatttctctatcgttgtccaaacagctttctttaatcatttttggagttttgcacaagaatgcagaacctgattggaaataattaagagactgataggaaaaacagcatagggcttttttttccttctttttcagtgatttttaaaattaagatcaccagccttctttgttttgtttttaatggattttttaaaatactgtagtctctacggtgatataaggggtgactctcagtgttctcattttctgggggaaaaatgagatgagcttaaattattctttccagaagtcagcaaactatggcccatgggcgaaattcagtcttctattttttaaaataaggttttattggaacacagctatgctcattcctttacatattgtctatggctgccgtcccacaatatcagagttgagtatttgcaacagagatcatatggcctgcaaagactaaaatattttctgttttgcttttttcagaaaaagtttgcttatctttgtcttagaatgtttaaaatttttgaatgtgttggcacacaatccttcactaaaccaagtaatgaaatgcttttccgaggacaactgttctattttgctatttcataattgcataggctgtactcataaaaaaatacatatatacacatacctacctttgaacatttctacctcttatactcccatatttgattcttttttacttgaaacatgagaactctcaggagttagttgtgaagattgagttaaaatgtgtaaaatacctagtatatagtaagtgccacatattttatatatagcacttactacatgcgtaaaatagtttaaatacatatataaatagcataatatttgctgttaataatagcatgtatattttgcaagagctaagattatcatgggccaatggtttatattattgatttaataatgaatacatagaagagctggtaattatcacctagtgtcaagcactgaattagtttctggggattaagtggtgagcatgggaggcagaattctaccctcatggagcttacataatctagcagggctcaacacatgtgctcaatgccttctcttggagaagggccagttctgaattatgcagtcattatggttgagtgtagcctgggcacatgagtatttttgaggtatattttcacttactgggatctctcacctcccattaatacttttatggttcttggctcacagtcaagagattgatttgaaattttaacacctttccactagctattgtgggacttagatctggcaaacccaggactgtgagttcaacatggtaaaaatgggactgttagggttttaatttccattaggtaggcgtcaggaggtagctaaagtacagggaactagatgggtcttgtaggttaatgctggcaagagcctgactccactccaagattaaaggggaaggagttgggttcagtcataaacaggacattggggttaagtgtgggctagaatttatgcattaaggggtttgaaggatacctggatcatagagtatgctctattagtgcttcttcctcttcttctttcccagttttctcctcctccctttccttttcttcctcccactttctcctccttattctcattgttattataattattattatctagatagttgacatggtgttccagcaacaacatcaaggtgaactagaaaattgctccttatccatgcagggaggccctgaggaagccactctgtatatgtctgtgccctgagtgagggaaaagtcttgagaatgcataaccttgggcctgtgccacacacagcttaggtattcaaatttacattcaccatgtgctctgaggcctgcccactcaagaaattaatataaaaatgccctgcagctggtaaaatcagtggaatgactggcagaagcaaacacaaaatcacatttgagccaaggcctgatgaaacaaggccaaaggagagtttgcaattcacaatttcaaaacatagaagtaaactatttgccataagtgtcagaagacacaaaagtggtggcctcagaattctatgaactttaattatggaatcattacataaagactatatagtaagggcctagtgcagtgactcatgcctgtaatcccagcactttggaaggctgaggagggtggatcacttgaggccacgagttcaagaccagcctggccaacaaggcgaaacctcgcttctggtaaaaatacaaaaattagccgggagtggtggcgcacatcagtaatctcagctactctggaggctgaggcaggagaattgcttgaacctgggaggtggaagttgcagtgagctgagatcgtgccactgcactccagtctgggtgacagagcgagactttgcctgcttcaaaaaaaaaaaaaaaaaaaagactgtatacatataaaaagactatatatatatatatatacatacacactatatatatagactatatataaataacaatatgattactaatctcagaaatatttgaaagaagagatgaaaagaatgaaaaaccatgataaggaaaataggtagattagaaaagggaccaaatgaacataaagagttctgaagagcataaacataaaagatagccacatccataatcatgttggtaaaactgtaggacactaaaatttcaaaagataaatggggaacacataggaagaaaagagccaaataagaagaaaaggacttattgaacccatttctaaatgatggagatctcactgtgcatgcagttatttgttcttcagttctctggagtattaaataaaacctgtttttttttttgtttgtttgtttttaatttaatttaagttctgggatacatgtgcagaacgtgcagttttgttacgtaggtatacacgtggcatggtggtttgctgcacccatcatctgcattaggtatttctcctaatgctatccctcccctagcctcccatcctctgacaggccctggtgtgtgatgttccccttcctatgtccatgtgttctcattgttcaactcccacttatgagtgagaacatgcagtatgtgtttttctgttcctgtgttagtttgctgagaatgatgatttccagcttcatccatgtccctgcaaaggacatgaactcattcttttttatggctgcatagtgttccatggtgtatatgtgccacattttctttatccagtcaatcattgataggaatttgggttggttccaagtctttgctattgtgaacagtgctgcaataaacatacgtgtgcatgtgtctttatagtggaatgatttataatgctttgggtatatacccagtagtaggattgctgggtcaaatggtatttctagttctagatccttgaggaaatgccacactgtcttccacaatggttgaactaatttacactcccacccacagtgtaaaagtgttgctatttctccacatcctctctagcatctgttgtttcctgactttttaatagattgccattctaactggcattagatgatatctcattgtggttttgatttgagtttctctaatgaccaatgatgatgagcttttttttcatgtttgttgcctgcataaatatattcttttcaaaagtgtctgtttatatccttctcccactttttgatggttttttttttgtaaatttgtttaagttccttgtagattctggacattagccctttgtcagatggatagatggcaaaatttttctcccattcagtaggttgcctgttgcctgttcactctgatgatagtttcttttgctgtggagaagctctttagtttaattagatcccatttgtcaattttggcttttgttgccattgcttttggtgttttagtcatgaagtctttgcccatgcctatgtcctgaatggtattggaatttctggccagggcaatcatgcaagagaaagaaataaagggtattcaactaggaaaagaggaagtcaaattgtctgtgtttgcagatgacatgattatttatttggaaaaccccattatctcagcccaaaatctccttaagctgataagcaacttcaacaaagtctcaagatacaaaattaatgtgcaaaaatcacaagcattcctatacaccaataacagacaaacagagaaccaaatcatgagtgaattcccattcacaattgctacaaagagaataaaatacttaggaatacaacttacaagggatgtgaaggatctcttcaaggagaactacaaattaccgctcaaggaaataagagaggacacaagcaaatggaaaaacattccatgctcatggataggaagaatcaatattgtgaaaatggtgatactgcccaaagtaatttatagattcaatgccatcccatcaagctaccattagaattagaaaaaactacttcaccatattagaaaaaactactttacatttcatatggaaccaaaaaaaagcctgtatagccaagacaattctaagcaaaatgaacaaagctgaaggcatcacgctacctgacttcaaactatactacaagtctacattaaccaaaagagcttggtactggtaccaaaacagatatatagaacaatggaacagaagcgagtcttcataaataaagccacacatcgacaaccatctgaactttgacaaacctgacaaaaacaagcaatggggaaaggatttcctatttaatggtgttgggaaaactggctagccatatgcagaaaactgaaactggaccccttccttacaccttatacaaaaattaactcaagatgggttaaagacttaaacataagacctgaaaccataaaaacactagaaaaaaacctaggcaaaacctctgtttttaaaaagtgatattaattgacttagttgaaaccatgacaatgaagataagacatgatttctctccactgggaatactactattctgtaacatattttaaatgttttcacttaaatgtaagaatccaactgatgttataaaatttggaattcccaccatttatttattggtcctcattagagctaattgaaatactgttttctttctcagagtctgtgtgggattcatttctcttctttttttagacttcatttctccttggtttaagatctacctttactgaaaaattctagacagcatattagtcaggaatccttggcttcagtagaaacacactctaactagtttaaggacagaaataattgtactggctcatgtaactgaagtatggctggacctagggtctcaatccagtatccgttgctctctcttgcttctccatctcctggctgtgccttcctctgggatggctttatttcttggtagggttcctacaatggcaatgaagtcccccccagagtttcaggttccagaattacataatagtgagcaaccccaatctcatatggtaggaagccttttttttttttttttttttttttgagacggagtctcggtctgtttcccaggctggcgtgcagtggcacaatatctgctcactgcagcctccacctcctgagttcaacagattctcctgctgcagcctcctgagtagctgggactacaggtgggccccaacatgcccagctcatttttgtatttttagtagagatgggtttccccatgttggccaggctgatctcgaactcatgacatgaagtgatccacctgcctcagcctcccaaagtgctgggattacaggcatgagctactgcatggtgggctatgaagccttttttaaggttagtttcagaaaacatctcaagaacagttttgattggtccagctcttgtgcccatctctgatccaattgcggtgaacaaggaaatgcaagaatctgactggccacaccaggagctgcaaggatggcattagccctaactgagatatctggattgagaatggaattgggcaaacacatttaagtcaactatggggagctttaaaatattttacaattctctttagattatctcccaaatgtgcactattaagatgaacttgtttctgccacatcatgaaaaaattgaagaatttttaaaaagtaaagtttcaatcatatggagcataatttgaccattaagaccacatttaaaatgatgccttaagttgctctgggtttcaggaagaaacaattttcttttacaaacaatgatgtaacacatacactctcaatgggagtgacatccttgaatgggcaaaaattgattttgggagtgaaaagtgaaaaatattaattattttatctgttaagtataagtatacaatacatacataaacagctatatggtatacctgtgattttaaaatttcatgaagaggtgattaggaaaaaatgtctaaaggcttcttatgggagtgataactaaaaatggttgagaaacattgatctaatgcaacacatgtattacagaaaggttctcctgcaattttagcccctttctcccctcacttctgctctctgagcattccataacattttctttttgaaacatagacccccccaaaaaatacaaaaattagccaggcatggtggcatgcacctgtagtcctagctacgcaggaggctaaggcaggagaattgcttgaacccgggaggcggaggttgcagtaagccgagatggcaccactgcactccagcctaggagacagaatgacactcctccccgtcacccccctccccgaaaagttatgcttatgcactcctgatgacaatcagatgaaattcttctagcgttagacctccagttttcctctagttcctcccttactgcccttgataagatagttttgaataattctgacacttttcctctggcctccagcaaagtttattattctcaacttgtgaattctccagtggtaagaaatcttaactctgtctgaaataagttttcaaatgtcttcattcttaaaataacttttaatatatcatttttaaaacaatcagataccttacagctatgaggactgatattgattttggcagagtgagtctcccgtaggaatgctcgggcttctcttacttgtaacttccttcttgtctaagaattttctattgagtatcttgtctccatacctgcagggctgactgttgtcaaattaagcgatgttttggcttcagaaattgcaaaatatcaggattggttcgttattaatgaattggagtaaccgggataattgagttgtgttttgtgaaaatcaccttaaatgaccaaagtaaacatacagccagatcatgtagtattatatacacagagctgaaaataaatgggaatataatacactggctcctgaagttgagcaaatttcattttaaaatagaggtgatcagataaaatagcctctcttgggtcaatattaacttaaggaaatcaggaaataactaggcaactctaccaataaaactttaaagcaaacttaattttttttatttttcttcgttttttttttttttttttgaggtggagtctcactctgtagcccaagctaaagtgcaatggcgtgatctcagctcactgcaaccttcgcccctggggctcaagtgattctcatgcctcagtctcccgagtagctaggactacaggcgtgtgacaccatgcctggataattttttgtattttagtacagacagggtttcaccatattgcccagggtggtctcaaactcctgagctcaggtgatccgcctgactcagcctcccaaaatgctgggattacgggcagaagccaccacgcccggcctaaagcaaactttatgtaaaaatatataaaaggatcacatattttcaaaggaattaaaatctgttttaggtatcttgtattgtggtagagtaggaagagtttggagagggtacattacaggagatgggggaataaaaattgagtcaaaagtttctgagatgttgttgggagaaagaagactaattgtattgggaggaagtgggagatatacatggacgggtcaagtggagagctttggaaagcacaatgaacagtttaggcttaatttggtaggtgaggaaggaagaaataatcttaaaatttaggtcactttgagagtcctgcagttcagccagtcacggggatggtagaggctcctgagccatttcttcaagggttgtcctgcatctgctgtcattaacagagattttagtatttcccaagacagtcatctttggacatcctgtctgtaattgagttgaaatctgtcactttacacactccttctgggcatatagaatcctcctaatcccttgtctatatgacagccctttacatatttgaagacagctgtcatgtcttctcccagtcccttccagtttagagcagaggagaaatgtgatgcatgtggtgtttacaggattgttagttattcttaagctgaaggtctctgagcgagtgctgaaatgttgtttcggctgtggcacaacaaccaggcttcatgttcctataaggtgtcatgatgttattcatcccaggtcgaatataggacaaatgcgtacggctttgatttcctgctatctttaattgcaaggcttgtccatattttctttcctttcttctttccttcttccttccctccctcccttcctttctccgaaatacttctcttctgtgatgggagttgaatggttcaggctctggagttagttctgggtttgaatttgaattcagcttttccacttgctcagtgtgtgatggtggacacgttatttaacctatttagttacttaaccattctttctctatgaaatgggaagaacatctacctcataggattaatactggacttagatgaaaatgatgtatgcagagcatctgatgaaagctatcactaagtggtaggcttttcataattattaatataaaaaaggaagcaaaggaaagtgtgtgtgtatgtgtgagatgtgtttgtggtgtgtgtgtggggggggaagagatttatttatttatttatttatttatttatttatttatttatttattttagacagagtcttgctctgtcgcccaggctggagtgcagtggtgtgatctttgctcaccgcaacctctgccttccagattcaagagatccttgtgcctcagcttcctgagtagctgggatcacaggtgtacatcactacacctggctaatttttgtatttttagtagagatggggtttcaccatagtggccaggctggtctcaaactgctggcctcaagtgacctgcccgcctccgcctcccaaagtgctgggattacaaaccactgtgcctggcttgagatattgatttaatataaggaattggttcatgtgattatggaggctgggaaatcccaaaatcagcagtcatcaagctggagatctgggagagtgaccatgtagtttcagttcaaatccaatggcctgagagccaggagagctgatagtataagttctaatccaaacactggcaggctcaaaacccaagagccagtgttttagttcaagtctcaaggcatgaaaagcaacatatgagctcaaggcagtcaggcaggcttctctcttactcagcatttttgttctcttcagtctgcaatcccttagaggcccatccacattagggagaagaatctgctttattcagtctaccaaaatcagtcagaaatactctcatagacacatccagagtaatgttgggtcaaatgtgcaggcaccccatggcctagtcaaattggcacaagaaattaaccacacgctgtataatatatttctaggaagacagaagttataggaggaaaaataaaacagggataaaaggagtgagtcacgggagtgctgttttagatagggcaggcatctgtcagggaggctttgaaaggtacatttccacccacgattggattaaatgggtattaacctcactcagattaatgtaaattccagacacagctgaaatgagccccttgctgcacatcccctacatggatggcttctgatgttgtctcccacagcagtgaccatctgtgttgcattctgtgaggacaacttccatggtagtgatagtgtgatatgttggaaaatacatattggacaaaacatttagaagacctgttgtggctgggtgcagtggaggtggctcacacctgtaatcccagtgctttgggaggccagggttgcaggatcgcttgagcccaggagttcgagaccagccaaggcaacacagtgagaccccatctctacaaaaattaaaaaacaaacaaacaaacattaactgggcatgtgatgtgtgcctattgttccagctactcaggaggctgaggcgggatcacttgagcccaggaatgcgagattgtagtgagctagtattgcgccactgcactccagcctgggtaacagagtgagaccctgtctctgaaaagagaaaaagaagaagaaaaaaatagctgttatccagtcctagctctgccggtaactagtaagtcagtcacttgtcctctctgaacctcaatttcattttcttttttctcttttttattttgagatggagttttgctcttgttgcccaggctgcagtgcaatggcgtgatcttggctcactgcaacctctgcctcctgggttcaagcaattctcctgcctcagccttctgagtagctggggttactgacgcctgccaccacgaccagctaattttttgtatttttagtagaaatggggtttcaccatttggcctgtctggtctcgaactcctgacctcaggtgatccacccacctcagcctcccaaagtgctgggattacaggcgtgagccaccacgccctgctctcaatttaattttctgaaaaatggggacaacatggcttctcatgggaatgttgtaaaagtcagactttgccaatgtattgaaaaaccctttcagaatgaaagtttctcgttgagtttttggcaatgtaaaatgaccttaactctttttataaaaatatcttcagtagtgtggctggagccaatctctacacagtaacagtgagcttccaagagttctactgtaccaaattcttagggattttcttttgctcttggtttggaaacttgaatgtaacctcacaggagacttaagtgaaaaatcgttctgtggccacagtattccttcaaatgtcttgtgtaatgaatggctgaggctgatattttgctagtggcatagaacaaaataattcaaagcccctaaatgaatcctagaccagttgtggtgaaatcattgtgaggttttctgactgaggttaagacagggtgaataaaaatagtacacactctcctttcgttcaacttagcctccagcattaggaaaatatcaaggaaggcaggccactttgatacaatctccctgattcctaaataactgtaatccactttcccagtgcggtagtgtggcagggcaggaggagagaacacatttaattgagccatcatggctcatttctctagtgccctgctggaagtgtgaactatgtgaacagaggaattattttttaacaacacaattcaatttagtttacctacactgatgtactgtatgtcaagagatgacccagataaagtggctaaaaagacaagttacaaaagtcctccccagtcaaggagttcagtctagtcaggcagatagaaatggaagccagtcataatattccagtgtgatgggcacaaaaaaaatgtacaaatccagagtcaataaagaggggcaggtaatgagttccatctaaggacagtaggaaaagattcatggagttggtaaagtgtaacctgggttttgaaggatgaataggagtttacctggcagcaaaagttatcttctgtcagctccgtcctttctatcttcactgactatgttgataaatacctttatctaaaaatgcattgtaaacatttcattatataaaccataattgggtctttaatttgaataccattagaacaaaaccaataatattgtttaaaaggaagatttttaatttggtaatttcatactattgccattacagtaacattaccccttgcccccacatagagttactctttgtatgattttgtttacttttataaagcgcttttttgcatctgaacctatgtcctttattatagtctatttcctctcactaagaatttaatcaccgagtggtgttaagagtcaaaataaaatgaaagaatttgaactgccagaagttgggagctttgttgtgttcccagttgctcagaatagtgcttggtacataataaacactaaatagattttcaaaaaaataaataaatttcatctaggaaattagttgcataacatcaaatgaataaacatgggtttggagtttctcatgatgtcagtaacacaataaaattggtgtaaaattattggaagaaggatgcttttcacatgggcaacttcactatgaaagtgcatttatttgggatggaaaaacattctagacaaataattggacatgttagcaaacagcacagattagctgtggacacagcaggggcaagccctgcagagacactgctttatgtaacaagcttttcccccttaatttctagatttacgtaacatagagtaccttcctgaagtcagtatatagccctgtggttaaaaacataggttgtggagacacattacttgggtttcaaatcccagctttgccacttcttagctgtgtgacaccctggacaaatcacacagcccttgtatgccatcctttctgactgcaaatgggaataatagtaatggtacctgttccatagagttgttgcgaggactaaatcaacagataagtgtggaaggcttaacttttttttttttttttgagatggcgtctcgttctgtcacccaggctggagtgcaatggtgcaatctcagctcactgcaacctccacctcctgggttcaagcaattctcctgcctcaacctcccgagtagatggaattacaggcacccactatcatgcccagctaattttcgtatttttgtagagacggggtttcaccatgttagccaggctggtcttgaactcctgacctcaggtgatccacccatcttggcctcccaaagtgctgggattacaggcatgagccaccacacccagacttaacatttaatataataatgtacatcatttccaaatatgaaatgttaagaaatcgctagttcttccaactcttctcatcacaaaactccagaaagtatagaagagaaaggggatcatttctcctggacttgtgcaattgttccttttgattctatctgtgacatgaaactattattattatctttgtaatcaaggccatatattgagtgcttttctttaagttcagctgcttaggcatttttaaaaacacaacctgtattttcagaattgcattttaggtaagacccatgtaaagttaagagctgaattaaaacacagttcaacaggtcatttcctctgtccctttgctttaattttaaatacaggcttgcagacaaaaaggatttatgttattttacaaattaatttggaatattgtcttagcaataaaagcttatgcactcattcctttatattatagatttaaactacatttagctgctggattttacacatttacctgggctcccaggcgtgtctggttttcttttctactacttgatttttaacacattttaaggtacttaatatattctttctgattgatgtctctctaagaatggtgaaatgggtaatgtgtttgccagtggagagtaatgttgtcttcagttttgaatctgggctcctgcttatagtaagacaatgatttgaatgcatttctttaaaaagattcactgtaacagctggaattatggttaaggtatatgattattgaacttgaacacagtggcttttaaattacctctttgtaccaagtatatgaacagctgtttgcccctggcacaggcaaacctgttgatgggacaaacattgtacatgtgtaccttatgatggaaatagccattagggttcattgtgtttatgtatgtcttagagctgctaacctggatttaggacacaagaaaaaatattgtttttacagttctcaagtgagtacgtactagtcttcaagaaaaatcatactttgcagtacaaaaccaatgatggattttgacttttgaaattgttgaaaaaatatcttcctatgagtctttttttttaattaaaatttttttatttattttattttattattattatactttaagttttagggtacatgtgcacaatgtgcaggttagttacatatgtatacatgtgccatgctgctgtgctgcacccattaacttgtcatctagcattaggtatatctcctaaagctatccctcccccctcccccgaccccacaacagtccccagagtgtgatgttccccttcctgtgtccatgtgttctcattgttcagttcccacctatgagtgagaacatgcggtgtttggttttttgtccttgcgatagtttactgagaatgatgatttccaatttcattcatgtccctacaaaggacatgaactcatcatgttttatggctgtatagtattccatgatgtatatgtgccacattttcttaatccagtctatcattgttggacatttgtgttggttccaagtctttgctatcgtgaatagtgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttcatgattgccattctaactggtgtgagatggtatctcattatggttttgatatgcatttctctgatggccagtgatggtgagcattttttcatgtggtttttggctgcataaatgtcttcttttgagaagtgtctgttcgtgtccttcgcccactttttgatggggttgtttgtttttttcttgtcaatttgtttaagttcattgtagattctggatattagccctttgtcagatgagtaggatgcgaacattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctgtgtcctgaatggtaatgcctaggttttctcctctttgtacctctggtagaattgccagctcctctttgtacctctggtagaattcggctgtgaatccatctggtcctggactctttttggttggtaagctattgattattgccacaatttcagatcctgttattggtctattcagagagtcaacttcttcctgatttagtcttgggagggtgtatgtgtcaaggaatttatccatttcttctagattttctagtttatttgcatagaggtgttggtagtattctctgatggtagtttgtatttctgtgggatcggtggtgatatcccctttatcattttttattgcatctatttgattcttctctcttttcttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttcagcaattttgagtgagtttcttaatcctgagttctaatttgattgcactatggtctgagagacagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccacttggtgcagagctgagttcaattcctgggtatccttgtgaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttacaattatgtaatggccttctttgtctcttttgatctttgatggtttaaagtctgttttatcagaggctaggattgcaacccctgcctttttttgttttccatttgcttggtagatcttcctccatccttttattttgagcctatgtatgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcattagttgatgcagtttcttcttagtctcaatggtctttacattttggcatgattttgcagtggctggtaccggttgttcctttccatgtttattgcttccttcaggagctcttttagggcaggcatggtggtgacaaaatctctcagcatttgcttgtctttaaagtattttatttctccttcacttaggaagcttagtttggctggatatgaaattctgggttgaaaattcttttctttaagaatgttgaatattggcccccactctcttctggcttgtagagtttctgccgagagatccactgttagtctgatgggcttccctttgtgggtaacccgacctttctctctggctgcccttaacattttttccttcatttcaactttggtgaatctgacaattatgtatcttggagttgctcttctcgaggagtatctttgtggcgttctctgtatttcctgaatctgaatgttggcctgccttgctagattggtgaagttctcctggataatatcttgcagagtgttttccaacttggttccattctccccgtcactttcaggtaaaccaatcagacatagatttggtcttttcacgtagtcccatatttcttggaggctttgttcatttctttttattcttttttctctaaacttcccttctcgcttcatttctttcatttcatcttccatcactgataccctttcttccagttgatcgcattggctcctgaggcttctgcattcttcacgtagttctcgagccttggcttttagctccatcagctcctttaagcacttctctgtattggttattctagttatacattcgtctaaatttttttcaaagtttttaacttctttgcctttggtttgaatttcctcctgtagctcggagtaatttgatcgtctgaagccttcttctctcaactcgtcaaagtcattctccgtccagctttgttctgttgctggtgaggaactgcgttcctttggaggaggataggcgctctgctttttagagtttccagtttttctgctctgttttttccccatctttgtggttttatctacttttggtctttgatgatggtgatgtacggataggtttttggtgtggatgtcctttctgtttgttagttttccttctaacagacaggacgctcggctgcaggtctgttggagtttgctagaggtccactccagaccctgtttgcctgcgtatcagcaacggtggctgcagaacagtagattttcgtgatccgcgaatgctgctgtctgatcgttcctctggaagttttgtctcagaggagtaacaggccatgtgaggtgtcagtctgcccctactgggcggtgcctcccagttaggctgcttgggggtcagcggtcagggacccacttgaggaggcagtctgctcgttctcagatctccagctgcatgctgggagaaccactgctctcttcaaagctgtcagacagggacatttaagtctgcagaggttactgctgtctttttgtttgtctgtgccctgcccccagaggtggagcctacagaggcaggcaggcctccttgagctgtagtgggctccacccagtttgagcttcccggctggtttggttacctaagcaagcctgggcaatggtgggtgcccctcccccagcctcgctgccaccttatagtttgatctcagactgctgtgctagcaatcagcgagactctgtgggcgtaggaccctccgagccaggtgtgggatataatctcctgtagcaccgttttttaagcccctcggaaaagcgcagtattagggtgggagtgacccggttttccaggtgccatctgtcacccctttctttgactaggaaagggaactccctgaccccttgcgcttcccgggtgaggcaatgcctcgccctgcttcggctcgcgcacggtgcgctgcacccactgtcctgtgcccactgtccggcactccctagtgggatgaacccggtacctcagatggaaatgcagaaatcacctgtcttctgcgtcactcacactggaagctgtcgaccggagccattcctattcggccatcttggctgccagtcctatgagtcttaatttcaagtgaaatatgcctagttgtagtttgcttttaaggtttttggtgcttaaattatgtgacataaacactcaaattatttttctagataatgttttctgcatgccagataggattatttccctcttcttttaattagttacttaattagtaatttttaatggtgtcataagcacccaagcccccccttacccccaaaatctaagaccttgaccataccccacacttatgcttttattttctttaagatgtcttttgatgaccaacttaaacatttttagtcttattaaacttatcaatcttttgatttatagtcaattagttctatatcttgtttaggagctatacagaatttgtatttccaagtcatttctgacttgaatgagctaaataaacagaaaatatctattggaagttattttttaaaccagaaaataccaatttcattacctctcttttaaataagcagaaagcgttccctttctaagatcctatccacatggttcccaattaatttataagtgaaataatatccccagtagttttggaaaagaaagaaaactactctccatttgagagtaacttttccccataaaaacagagaaaaatgggttcttgaagcttaaccagacttcaattttccctggttatgtccaaaaaacaaattaatttttatcccttgacttcttgtggcattccattttagcctttttcttagtgtggtacagtagggttgactcccaaatacaaagttaccagctgatggctctgtatttggtgattaagaaagggaatctggtgccagaaagtgaatacacaaactttggattaagttgtactgtttagcttccataatgaatattggagtatttcattggcaaattcattttttccccatctggtaaaagcatctaggtatcccatgaatatttatatctggaaaaagtcaagatcctttaagcaaaatgtggcctggtaggcgcagagacacgtatattaaactgcctatgccaaccataatagttcaactatttttttttaagtaaaagcatattcaacttgtttatgaatacttctgtattttggttttcattatatatgttaaaaaaataaagatttttttagaccagcaagaataaaaaggatacaggaaacccagccccaaacccctctgcccgccacacacacttaatgatctctagtcctaacatgaaaattcagcaaagttaagcagttctttggaagcacagaccagagttcgaagcaatgttgcgatcggtactaaaagtattggtctgttctcacgctgctaataaagacatactcgagactgggtaatttaaaaaggaaagcggtttaatggactcacagttccacatggctggggaggcttcacaatcatggcgaaagacaaaggagaagcaaaggcacatcttacttggtggcaggcaagagcacgtgtgcagagggaatctcccttttataaaaccatcagatcttgtgagacttattcgctattcagagaacagcatgggaaatacctgcccccattatttaattacctcccactgcatccctcccatgacacgtgggaattatgggagctacagttcaagatgagatgtgggtggggacacaaccaaaccatatcgacattgttaaggatttgtgaaacacttggagaatattcctttgtcttggctcggtgtgaatagaaatggtgagtttcccctaaagaaacacagacctaccctagatcaggcagcctcctccattgttgtagagacttaaccattcaccttctgcatttccccagcattgctgtgagtggggccttctctaatagtaaaacataggtaccatggccactgggcatcctcttctgaatctttgtcctgagtcctaactgagccatttaaaaaaatcaattatttacatgatctttaggagcaaaatttactgtcacatacacataatatgcaaaaaacatttgactttggggaaactctttggcctttttcccattatcttgttccaaaagcccttcctactttagaaaaagtctctgtacctttgttggattaaatacgtggctgtaatgtttccttgaattcagaaagtccgcatttctcttttttctatcacttcctgtagcataaatttatcaggataggagagccgtctttttgcctcctggccgtcttcccatctcggctgactggcacacgctggtgttgctaagacctttcctggaaagaatcaacaggcaaaagctcagagctggatgcttttgcacagacactactttctaaaatacacagaaggctgagttgtcaggatggtgtgaacctgcccagtattttcctatttccagagtactggctctactgccaacagttaccacaattttttttctagtaaaatacatttaagggaagagttgtaaaaagatggctgctcctacgggaactcttttgtattcttagcactaagttgtctaaaagacattaagatggactgtttttgaagttgctctgacagtaacacatgcgcttttctggtttgtgctttgcagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggtataatttctattattagcagtagcagtcagttgtcagtgcaaaactgctgggaagtattttaagaaatttcaaaaattccttacaaagtgactttcaggattgcaggatactcatggtcccctaaagtacatgtttggatcaataaatattatttattccttctaatttttgcaatgacactgtcattcaattaattattgaacatattttaatcttctgaaaagtcaagttcttctctgttactttaaaagttacagctggtttaagaatttattgcatagcagttttctttttatttaaaagaaatagctaaatctaggaaaatgttgaactagaaaattggcagtcatttaatagtacaagataacctttgccaaattaattctagcccagataagaagcaaaaaagttgtaaatctttgagcaatattgagcaattacaaatatttattatttgtaatcaaataataaaaataataaatctttattaaacaaagtctcctagtttaacttttaaatagccattaagaaaaatgactcctttgagaataaatcaacaacaaataaatctagaccttttatctacaaacatgatcagagttttttttaatgccaagtacctaattgggcgctcatttataaatggctaaaaaatatgtacactccctcaacccccgtatatgtctaacttgattcctttaattgatcttactcagcaaatctttttgaaaatttatagccaggccaaaataaaaaatttttgcaaagatgaggcctttcgtcattccagtttcttgagtagcccactagatttttgagtaacccattattcctggtgcgtttcctaatctttttttccaggtcttgcacagtatagtggtgaccccagaatagaatggcacttgaatgcatttagcacaaaagatgaagtgattgaagctgtccgaaacctcccatataaaggaggaaatacactaacaggtatgttttgttcaatccatgttataacaacatatctttttgaagaataattgtattacctcattttgccactttgtaagcgttatcataatgttttaattaaactagcacttaggattctttgatggctgttttcccaaactcagcattgagttaaaagccagatatctcattccttttactctatgactataatgtcccaggaagggcttggttgggctaggagaaaatgaagcaagccctgagaccaacagagtggagtagctgtctaacttttgtcagctaatctcttcgctacttttctcctcctgccatcctccaccctgttattcaaatataaacaaatttcttcttattttcaaagaagatattttctttgcccttattctgcaatcattagttatcatgaaaatattgtgaaataattttctaaaaagtcaagatcctctcttttcataataataatatggatctttggctcacagtatttttgatgaatgacgaatataagaatatttacattataatcatccatggcacaatcacaaggggtttgtaaaaattttcaccttgagacatgctgcaagctgagcatcccaactctgaaaatccaaaatgtttgagtgccaacatgatgctaaaaaaatgctcattgaagcatttcaggttttgaatttttagatttgggatgctcaaccagcaaatataatgcaaatattccaaaatccaaaaatacctgaaatccaaaacgattctggtctcaaggattttgaatagtggatattcaacctgtattgcctgccacaggcacatattagagatgctcagatgaagcaatgtagatgttgttattgatttttaggtaaaccagtagaatcctgatcattgctttgccaacttgaggcaaagtctcgtggaatttttgttaatgcagcaaacaatttattgaacacaaatcctacaacaatattgcaccatttcttatttttttctggatggaaagtgtcatgctcaaaaggcaggagtacgattaatgatattagatttgtcccttctactcctaaaaaacaaagagagggattttttggttctttagaatatcacgaacaaaattgaaaacctagtgataacgcactactgtgtgagtattcttgcttcatcctgaattataaaggttcagatctgcttgtacatgaaatctattatcatccattggccatgaattcagtgttctttataaatgctagtttctgaaagaatgcagtgtttaattattttcattacctttattccagtggattttagttccttgttgaatctgtgaaagacaacgttattacaaaaatgaagatttgcatgtaataaaaagtctatggctcaataggttacccatcttgtggttatatcttgaagaattaggagactttttattagagatagctggtgtttacttttccttgttttctccaaggtcttgctttgaactacatttttgaaaatagcttcaaaccagaagcaggatcaaggactggagtatccaaaattggcattttaatcacagatggaaaatcccaagatgacattattccaccatctagaaatcttcgtgagtctggtgtagaactgtttgccataggtatgtgctctttatagtcttgtttcaactaagggcatagacccacaaccacttaaaacaatatgtaatgtgaaatgcacttcactgaaagccaggagacctgagcactttctagtcttggcacttgtcataggcagccctgtgatctgagcccagcttccttacagttaaaatgggagtgatgctagctgtcatgtatcccatggtgtgaggatttctaagtgaggtgtcatatataaaatgctgtgaaaagcataaagtggcatgcaaaggtcaggtacatgtttgttactgtttagtaagtcaagactttctcttaagggtcatagctatctcttttctggtaatataggaagaatctaatttatcattttcaaggaaatacgatcctgcaactacgtaaagaagacacaaagttcaagatttgtagtagttcttatctgaaactaaccctttataaggtatccttcttgtgtgaaaaagcatatatatatatagatagcatacattcagaataactacaaaatatttagatgatgtgactttgctgttgattaaaatgttaacattttctttggcaatgggaacgtcttctatttagtagagaacaacaaactttctcagcagaaaaaatgcctgattcccaagcaacactgaaacacaaaccaaaatataacagcgaattccttaatagggctctgaagacatttgaaattggttatcatgaagggtcccttttattatgttttacatatttaattattttatttgtgatcaatctttagtccaaataaaatgcatttatctttctgcatttatcaagaatatggtgcatttttctttttgtgaactttccatgagctgtttcttctatcaaaagatagtactctctgctctgtagttacatacccagttatagtgggtgctggcataaaaactacatatttcagagtattattctactcttatgaaattgaactatccagggagaaggggcctgggaatacgtgttttaaaaccatacccagttctgtaccttaaaatcattctccagggttgagaactactggtaagcccaagggaatatctcctctaggtatactgtaagtttgtctcctttagagaaagatcctaaaaagttttcctatttatatatatatatatatatatatatatatatatatatatatatatatatattatttttcatcagaggaggtttctgatcattttttcagaacttgtttcctactagtatgtagccaagtacagtctaagaacagctgcagaagctgtggaaactatgatgttccctcctgtttcttttccttattcctacagcatctctaagcagtgagttcccagaggttcaggttgtatcttcttcactttttcatcctgatcacctatcccagtgcttgacacttaaaaagtatccaataaatggctgtttaataagttagtgctctaaagaatttctaagatagcattatttcccttagtattaaaaataaaaatattcttgaaagatacatgtaagagaagtgtattattattattcaagtaagtgatgtatattatcctatagtaatgtagccattactgctacatttttcatttacagaagaaagaacaaagacatccagggaaaaaattaaaaatgtattatgtttgaactttgttttggtaaattagaaccttgttattttgtgtgcatgtgtgtgtggtgcaggaggaggtagctgttatagctcagtgttgtgcaggagccagctcatgccagtttgcaagagccaattgtgcacaccttttcccaagtctgcatcctgtgacctcatattggtagtttggaataagctacagtggggtatttattctacagaaattggcaaacactacaaatgagggcagaaagctgactgttaaatatttacatttaccagcacacccctggaatttaaatgggcaataaatggatttaaccatacggtagcttcacttgtaaagataaatgtgaagttggtcctaggagttgagttaaatttgctgtgcaggaacatttcttaccctgaaatttaacagtacatcttttagagttatcaatgaaaaaaaaactttagaccctgtcctagatttgctattcacaatgtggcttatagaatgcttgattcaagaagtattagcttacatactatgtgccaggcattgtggaggttgttggggtacaaagatgaacaaggcaaaatccttagaaaacaaattcctccaaagtcgtgatgaccatttcctctcttttctgtgcagttgcaacagtcaaactattttatttgggaaggtgagggagaagcaaaattgggcctatttttcccagaatatttctatataagtccaaacttgttggattcaactgaatatcacaaaaaaagcattattggcactgcttcagcatacactcaatgttatattaattcagatgtacatttgagaagcaattgtagaagtccttcaggcaagaaccatcagagagatttattttcctgtccttttgtccaataaaggaaatctctgccaaagacttaaactaatggagaactaatttatatgtttattctccattttctgctcttgttaatgatgaataggtgagtttttaagcaaagctttcagtaaattcatccagatgtgatttagacttctctgaaaattacttggaaatcagcagtatttattaacctgcaacctcctaaagcaaatagttcagagacaactaatgctttgttgctcaatatgttggggttgaaagataaattaattggcacagccagccatctaagaagtaattcatgttgccccaggtaatttctcttccttgcttctatagaacctccttttaataccctccgatgattgaaatgacggggattataaagaaatcctccttgtttgatgaggcttggagaagggaaatctacttcatacccataaaacttaacctcatgcctctcctttcctatctctaacattgttggtaaatgtttactcattttaatgtgcagtcttctgagaggcagtataaaataggggaacaatagttccaaactcataggattgattgtcaggattaaaggtgttattatatggaaaacacttactatggtgcttgggggcacagtgatcacactcttttttaagggttcgtgttcactgctttctgtcctattctattccctgctgtattccagacacccaactttgtgcttgaccatggtattcagtagatactgtggaaggaccaggaattttctatttacattagtaaaattgcagtggttactagacagcaaattgtatttgagtatgttaaaaaataattttccctagctttctccttggcttaatgctatacaataataataatttcaaatatatatatatatatatatatatatatatatttgttctagcagtatttctcaatttcagtaaatttattttatagaaacttaaacctgaagctttgatagtttaggatgctggtttaattactattgcttctgcaatattcatgcaaaacagaagttagttttattaagtcatcttcctgttatgatgtattgagtaaaattaatatctaatcatttaaaaacgattctgcaactgatttctgtaaaaagcaatctcacatgaaatgttcctctttaaagtggcagatgcttttaaccaaatccaagactgcaggtccaccagaagtggggagggtaactgaaacagcctctcagatgggggtgggggggggtcccaagtgttgtttaccagaacacaagcatataacagctttcatcttggcaatggtacatatgctcgctcttccctttttttgcttattttctttctatatgaataatttgttagaatcagagctattgttttgtgttatataatagatatgactatattttttcatttcatcggtttatttcgtgtgcgcattttaaataaaattttaaatatatatatacaagtagcagatgatgctttgactgcagtgaagattgactgactgggtcagatcaggcccaccgcagtcactctttccaagggggcataaaagtcaccattctcttttttgtcctctgtgtaaggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaaggtaaaatgagtgacagagcagtcctgtggatgtcagtattatggtgcacaagcctattgtgaattgggaaaattcttttcatttttcatgttggctttttgaagaccccttattcccctaagacctgagccgtcagagtagaaaagggagtatattagcaggctttgtgggggtgaaggagggactctttaaacacaagatgattttctccataatgttacatttacatttatttaaaacttaaacttttaattttaagatagttatacattcaaatacagtttgtaagaaataatacatagaaagattgtgtgttctttactagttttcccaatggtaaaatcttgtaaaactaattacattaccacaagctgaatacttgtcattgacacaggcaagacacagcacatttccaccacaaggatcactcctgttcccttttatagccacactcacttatatccctcactctctctccctaatcccagacaaccactactccatctccaatatttttcatgtcaaaaatattacgtgaatggaggtatgtggtatgtaacctttggggactggcttttttcatgcaggagaattccctggagattcatccaagtcgttgcatgtgtcaacagctctttctttttaactgagtgccagattccatgatatggatgtgccacagtttgtttaaccattcacacattgaggggcacctgggttgctttcagcctttggctatgatgaatcaagctgctgtgaatgttcatgtggaggttcttgtgcaaacataagttttcatttctctgggacaatgcccagtagtacaatggctggatcatatcccggttgcatgttttgtttaatgtagttttcattaagactggcctccttgctactggacggtggtgaaagtcctgactcactgctaggtctcctctgacactgtcacagagtgagggagaatggtgcctcattactcccaagtggggttgagggtccaggcaggctcttcatgtggtctctcttgatatcatagataggattgtaggggaaaagattcattaccatctgctggggatgaatatctcttctctacttgacctctcacaccaacctagctggcatgagggggttggggtggatgttagggcaccctattacagccaaaaaaggctggaattttgacttcccactaggcctttgctggcatgggtaaaggtgtggccacattttttttttctgtgttgattgtctgcagtagaacaattattaccaaaaatgtttaaaacgtttcagtcttggtaggctggccatttcctggtcctttgctagagggagaagattttgttagcaatttttagtctgtatctgttggtgtttctaggttgccagatactttagctccatgtctgggatatatgagtaaaaggaagtgggagctcaccgctgggagctcctgagccctgtagttctgcactcattgaccttcttctctctacttttcagcatcttcttatgcttgtctttgatataatttccagagtttttagttatactcagcaaaaggaatagagtaaagcacttactttatttggagagatatcatatcattggtctgcagattgtgcttgccttatagagttgtaatctgagaagagggtaatatccaagtcttctttcaagagtctggttttatttgctgcctctgttgtaaccagtgtgaaatggttctttctggctacatgtccttctctctatcatcattcccctttccccaggctagatcttgtggggctgggctgggcacccaagcagtatgatcctgaacacatttctctgagcttcaaagtgaagctactttagagctcagtttttccaaaatagtctacatgtggttgatgatacagcatgtaataaagttcctgcccatagtttgtgttcaaaacagtattttaaaaattgagattattaaagtccctttgagtaagtgctcttaaagggtgagaaattctaaagtttaagctctttattataatttacatattgtattccccttccacttagattttgcatgtcccaaatttttatagaatcatttgctttaacatgtgtaacacacacacacaaatgcttacctagtatcgagctcatagtgggcatttagtatatgttagttgctttttctttttttaaatttttaggtattagtcacttgttgaattgaaatttttagtatagagcctgtgttcgctgatgcttaaaaacatagactcttgtgtcaagcccagatatcaatgtcaactctgatactaattgtgagaccttggtcaggttagctaacttcactgtgcattgattttctcatatatgaagtgtgaacagtaataggaactagggagaagtagatgagataaaaaaaacttcttaagactctgaagagtaccttttgatacacacatgcttagttaatgtttgtttgtttgtttgtttgttttttggaggcagagtgttgctctatcccccaggctggagtgcagtggcacgatctcggctcactgcaacctctgcctcccggtttaagtgattctcctgcctcagcctccaaagtagctgggattacaggcacctgctaccatgcacgctaatttttgtatttgtagtagagacggggttttgccatgttggccaggctagtcttgaactcctgacctcaggtgatctgcccgcctcggcctcccaaagtgttgggattacaggcatgaaccactgtgcctggctgttaatgtttgtttttattatttattaacaatgaccttaatttaagaaagttctctggagtcaagaactatgtcttatttaagtttggtatcctcggaacttagcatagtacctggcacctaatagacatttaaatgtttgaatgaacaaatggataactgaatcaacttatctaaagaggaaaatcttagaggcagcataaaatcaatatttatttctgtctaatgagatgtcttagcttcataagaaataactttgggtaagaggtttatttgatatgtttttttaatttagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtaataaggagagagtattttcaaaccattctttttattctctcaagtcttctacaatagtgagaacaaggcagaaatataaatataagattattccgtcacagacattttaaagaatttgactgaaatacatttccacttgttcatattgttctcccctatctctgagttatggcaattacatctttcatctctccaaataacactcagaactggtcaggtatgaatttctaacacaacgtatttttcttcttaaaattaataagttctaaagtaaaaggtatcagtagctaattatctggccaggaccccttttgctatttgtgcattttttctacttgggagtggtctgagctttctgccttagttaagtctgtgaattccaaagtacgtggtcatatatggactagtcctccaaggcttggagttttccggacatttgtagggattagtgcaatggaaaagccataataaagccgctatggctggcatatttttatggcttggccaacacaggcgagaacacctattgccagatgattagatccttcccatttcctacctttgataccacaattcacaagcaataagttaaaacacgatgaaattcttttgtctttttctttttgttgttctagcctctgactgacctcagcatatttcacaatgttctgtgttatggtaggatttatgatattttttaagtgttagaaaagtagattgtggagtcttaaatcatttggaccaaaaaaaaaaaaaaaagatccgagtgcttccaatgattcttttatttttcatgactaataaatcttttaaatgtttcccaaagctctatggaaaaatatcatgtttactgttattaagtggatgtaaataggataataattagcctggtattgacacaattatttctattagatatgaattaataagggacttctagacacattccataaaaggtgcatcacttcacttaggaattcaaagagagttgactgccacagtggaaagggggatgtggcacaaacaagaaaatattcaatgaaatatttttgctggacgtattttcgctttttgatttcaattctgcgtgtaagatattccatactctcattactcaaactgttctttaaacaggtggtggtagatggaactgtatcttccacagtgttgaaaaacttgatgtctttaactgaatatcagatagcagtctttgcaatctatgcccacactgctagtgaaggcctacggggaactgaaactacacgtatgtatttaattctaccccacttctaactttgtagagtgctgcttaggaggcctttcttaaattgaaattctgctcaggtcatgttgatagacatcctgaatcgaattcaatcaaattcatagaagacatttgtcgtgctatatgtgatactggtccatgcttgatatagtcttgccggtgctatgtcttgaaaaagttgttataaatctctgataggtttaagagcaatcttggtggtgaagagtacaaaaaacattcattcatttattaaataagtgtttagtaaatgcctattatgaactaagaattgtccttgaatttgtcagtagaagtagagaaaaaactccatagctctcccgcccaattgaatgccaaggaaattatgttactgctatctttattgttcatatcattgtaggtaaaacaagcttctgaatactaataattccctccctgggtaggatcgtaataacacaccatgacaacatacacacataatacacacacgcacacagaatcatgagaagagataatctttaaaaaaagatcgaacatcttatagtcatttctaatattaacagagttcctattacatgcaagtcactatgcaaaattgctctaaaaaatctgcctctgatagaacaataacagtgtaaacaacactaatcacaatgcgccaggcactgtgatcatcactctctgaactttcttggatttatccctggcaacaatctgtcggatgagtgttaatgccctcactttgcagaaatattttagtgacaatccttattctcaaggatgttttagtgagcctgggcaacatggcaaaacccgatctctacaaaaaatacaaaaattagctgagcatggtggcacgcagctgtggtcccagcttgtgaggctgaggtgggaggattgcttgagcccgggaggtagaggttgcagctaagattgcaccactgcactccagcctggatgacagaggaagaacaggtctcaaaaaaataataaataaaagaaaaaggatgttttagtgtagtagggggtggggacgcaatccaaggacatgcaaacagattagtgcaatgaagggctgtaagcactctcatagatccctgtacaaggagctggaaatgtcagcaaagtcctgaacttgacactgtggttagaagagtagggcagggtcacattagggagggtctagaaccatatttgaaaacagcagtgtttcctgtttttcatcagcattgtttaacccaggaacttgcaatttattcttaatccctttctcccttcccctcaaatatggtcaatcttatttcttgataatttcatttttctcaaggacacatatataagtggctcaacatttaaaaaaaaatctcttgcagttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagaggtaaccacttcctacctattacagtcctagaatcttttatttccttaaataaaataaaatttttattgtaaaaatttaatgtagaaaatttagaaatttcagattagccaaaagaaaaaaaaacacttataatcccaccactgagagatagccattgttaacatttaattaacagtctttgtcgatgcattttgaaagcaacacatggaaatggtttcgtagcctgctgttttcattttatttgttgtgaagctctttccatgtcattaaagaacattttacaaagtcattgtatacacccatagtattctactgttggtttgaacagatcatgtttaatcaatctatgttattggatatttagatagcttgctatataaataatgcttttgtgaatattcctaacatatgtttttgcataattgtttgattatttccctaggataaattcctagaaatagagtttatttttcaaagggtaggcaaattattaaggtttatactcagtattgccaaatggctctagagaaatgttatatgttttgctttatgtggtgcataagtgactgttttctccatatacactgaattaagttttttcttactaatttgagaggtagataaacatacctcattggtgcaaaattttgaatttattccattttaaatgatgaacctttgaccttcagatgactttcaaacattttagtcctcatttttaatttgtagtggacaatagctataatgcagacatttaaggaatgaagaggatgaatctctggcacttggaagtgtaatgaccaggcaggtggagttaataagcaaagcaattcagagaacttgattgtctaaaattgtgtaaagcctgtccctgatgattgaaatctttagggtcaaaaaaatggtgaatctgagtgtcaagaacagagtattggtgacatgtgtctttttatttccaaggcttagatggcttttgtctatttgaatttaaagttgatctaaattattttgacaaaagagagacttacaaatagtgctgagaagatgctcagcctcactatgaaagagaaaaaaaaaaggaatagtagtttaaaaccaatagattagcaaaaaaattttaaagtctgataatactgtgtattcataagcacacaggaaaagaatcgctcctgtaactgctggcgggcatatagattggtacagctcctttggaggatattttgaaatatttcatcctgttgaagatatatactactttttggaaatgtatcatagggaaacatcttgcaagcatttttcaatgcaggcacttggttggaataaaacattgcagacaactaacaggcctgttaatagaggaatggaaaatagtggtatatttatagaaaagaatatcataaaggaattaatgatgtcaactctgtccttatgtatcaacatggataaatctcaaaatgtaatattaacacagaaaaaataacaagctgcaaaaagattgtgttgatatgatcccattatgtgcattgtgaaacatacaggatcatatattgtttatagatatatctatacacatacagaagtacaaaaatgcagcagtaagatatacatcaaccttagggtggaggtagtggacagaaagaatgagaaagacctgttgttttatctgaatatattagttttttaaaaaataaaatctgaagttgatatgacaaaaatttgatatttatccaatttgagtaatgggtacatcagtgtgtattatattattttctgtaagtttatgttgtatatattgagatagttcaaaattcaaaattttaatttgatgattaatcctggcagtcatgtgcctgtagattggagatttattttttccttccaaaacataaaactatctcgtcactctactgtcacacaactgagaatgttggatagtttgaatccaagggtcagaaaaggtgttcaagaatcaaaaaagcaaattgccaagttgggtgtcaaggtgagttgatctcttctgaatactggaagtaacttgcaattcaactgcgtggattctcttgttgaatggggacacaaaactggcccagcttcattgagtttgaagcaaaaactgggcatctggccagagcactggttagtattagccaaatactgaaagatgcccacttggccttgcctccagcacactggcctggagctcacagtctctagagaacatttctgattcaatcccacccaccttctcctggggagcatatactcaacattgttattctggctggagttgccatttgtccagatgtaaagagttatcctaacacagttcacatggtacttttcgacttatatggttccataatatctgttcctagtataaaatgacacaagacaatttaaaaattatgactgaagcctgtttgatgaaggggttgtaacaggacgtaaagtcttatcccatgaagtctcacctttgttctgttccactctgatcagcatgaataatatgtattggcaaatgatctaacaacatgtgttcttttcagatgaaaattggagagacccacacagatattgaattgagtgggttgttgcccaatacagaatacacagtcacagtttatgccatgtttggagaagaggccagtgatcctgttacgggacaagaaacaacatgtgagcagcacagccattcagttgggatgctgtagtaaaagcccacatgaatgtggggattctgaattggaactactagttttgttgaaacctcttaaaagctaattataattttaaaaatctcatgttctatttagggcaaggaaatgtatttcttatatattatattattatgagtgataaggttgccagaaccaagcttcagcatcctccagataattccacctatgtctttctttgtctaaattcaaatgcaggtcagaatctagagggaagagtgtaggctttgcaagatagcagctgagatgggaatctcagctcaactcatattttagccaggtgacaatgggtgattgatacaacttttttgattgtataaaaggaagaacaataatcttgcagcatgtggttggtataagattaaatacagtagtatatgtgaaaacactcagcacatagttactgaatatctgtttattttccactcatatcaaaattaacaaacattttttcctaaaaatctttgctgtctttaactgagcctattactattgtaattcattttcaattgagtaaaaattttgttggtaaggctaattttggataaatgtagggaattcctagaactttttgggaaatgtatgcatttatttttaaaaatatggtataaacaatattactgtggcatactgataatacttaccacatactattaaaatatggctctattcgtgatcttttgaaacataagaaagtgcagggagacttggggtcttgctcaccactcttctcctagactcgggagatgaatagcacaatttctacaatgcctttctcattaagattccatttgggaaaacaaaatagaagtttaatgataaagaagtttgcacacatccactctttgttagtcaagactatgttattcttgctcttcggagaaagaccaatgtaattaaaacaacaaagaaacaaacaaaagctctgggagagcccaagaaagaaaaagaaaagaaataaatcatgctagaaagcatccaccacataagtgaattctgggactctaaccatttgaaagaaaagctttccccaacagcccatctctgtttcactcaaagtgttcacttctttatacttcttaaaaatatgtacaactccttcccatgattagcaaaaaggtcctaaaaaatgatatcctagatacttgttcctgaggctggcatttttatgtgctaagtaaattagacactattctattatattgccaaatgtaatagaattccagaaaaatttagagccaaatgtgcacactacttaattatattgcttttttttcttttctacactttctctctagcaccttaattattaagagattcactaactcctacaagatctttattgtcaaagaatcagtatgtattgaattaatgaaagaactgggctttgaggttaggaaacatcatgcttcgtggctatggctggtaattgtcatgatttgtcttcaagttttttgctttgctggctctatcagcactgactttgtgggatgagagagtgtgagtaagagagagaaacagtgagagaggagaaattagcatcctggttaatatcatgggctctggaatcagttaatcaattttctaggttaaattctaattgctcttctgttcctagtaactgggacgttggccaagttacttcaattttgtgatcaatatagtggggataattgcaactctatccttgcattctaatgtaagaatttaataagttaacatatgctatgtgtcagactcatggacaacactcagtaaatgttaacaattatttttacaataagcctgtaaagagctcatgaagctgtcaaaaattatggacaatttttaatttgttgaattagataggggtccttgaagaggttcaaaaagctatggaattgacagttaggaatctgcagaaatgccaatacctctttaaataattttaaagcaatagtaagatgtttatttttatttgtctcacaaagccactgtgatttattcaggtcaaataattacccattgattcaatgaatgtttattgagtacttgctatattggggatagatctgggaacaaaatgaaaccaaattatctaaccccctgagattacaatatcctgggggagagagacaataagccagaaatatacggtgaaaaaaaatagaacagaagaaggagacaggtagtatggagtggaagagctgttgcacgtaagatgatcatagaaagcttcaccaagcaggtggcatatggtcagaaacctgaaagaggcaaagaaactggctatgcgtatatctaggggaagagccttgaaggcaaagagaaggcaagtgcagtggcctatgaatgagcatgcgtggcaggttccagtcacagctagtggcatggaaaaggcacggagtagtagcagatggaaccagtgaaatagcagcaggccactgatgtagggccataaagaccattctaggcttgctgcggtggctcacgcctgtagtgccagcactttgggaggccaaggcaggcagatcacctgaggtcaggagttcaagaccagcctggccaacatggtgaaacccccgtctctaccaaaaatataaaaactagcaaggtgtggtgacacacgcctgtaatcccagctactcaggaggctgaggcatgagaatcacttaaatctgggaggtggagtttgcagtaagctgagatccttccactgcaccccaccctggatgacagagtgagactctgtcagaaagaaagaaagaaaagaaaggaaggaaggaaggaaggaaggtaggaaggaaggaagggaggggaaaaaagaaaagaaaagaaaagatcatgctaagaactgtgggtttacgctgagggagttgggaaccatttggaaggttttgtgcagagaagtgaaattacctggctgacattttaaaagaagcactctggctgcttgctgaggaataattatattaatagtagggggaagatggaagttgggagattggctgggagaccatggcaaaaatccaagccaagaggggatagtggcttctaccaagatggtggcagtggaggtgaagagaaggggtcagatctggataatggattagaagtgggttgcgagagaaagagcaatccaggaggctccaaggtttttgactgatcagtgggaaggatagagtttccatttgctcagaggggaagactgagggaagaggcaagaggggaaggcatcaagagtcagtgattctgtttggactggttaagttggagttgcctaatagataccaacgtggaaatggcagatgggcatctcattttacatgtggaaaattgtggagcttagaggtagagtggctttgccagagtcacatggtaattgagtggactagctaaaattttatttcaagttactttgtttttaatccattaagtttcctacttacatcaagctagagtgataggccgagaaaatttacctaaatcctatttatttctaaccatgtgtaacttattactgctatttattctctacaaagaaaacttttttctttgctaattagagaacattattgatttttatgagacaatacactggttatttcagtgttataagttattatctaggtgacacttttcatatgtaaatagtttagaagtcaaagatgcaatttctttttacatgtatgtaatttgacattttaattattttctattccatttactgccaagtggctttaagtccaccaagaaacctgagaatctccaatgttggctctaacagtgctcgattaacctgggacccaacttcaagacagatcaatggttatcgaattgtatataacaatgcagatgggactgaaatcaatgaggtaagttccgggacataatgtatattttttaggtagtggcgtgctagttatttatggctacataaccaatcatctcaaagcctagtggcttaaaataatagtaattatttattgtctcgcatagttcctgtatgtaggtcaggaattggggtgtggattgcagttatcactggaggaggggtgctccccagtgaggttagggccagatagtggctggagctggagctatctcatggcatctttactcatgtatctggtgcctggtctggggagcctggaacagctgggagctgtagcaggtctccatatctctaattagacccttcacatgatgccttcagcatgcagcttcaggggagttggctcaggagtcccatgacccatgtccaaacagagagagagctaagtagaagctgtaccaccattaatgacccagcctctgaagtcacttgatatcacctctatcacactccattagtatgagatgtcaccagcttcacccagatttataggtggggagaaacacagatcctacctatggtgggagacaggtcagtcacaggataggaggagcatatagagaagaagatattcattgatgtggccatctctggaaaatgcagcctgccacaggggatgggggtggggaaggtgtatgttcatggaagcattgtattaaaaataatgtcactgttgtctagtttatcctgcttttgagtaaactggcatctgaaaggctctagttagatgagcctaaatttaacaaataattcaagttttatctaagaagtactttcagataatggaacttgttaaaacccatgaagatacagtatcttgcatgcagtgactaatactttcaaaaaagtgtttccttggaaatgtgttttagcaaaacagcgaggttatttttattttattttcccttatcttggtccagtaagctaaggcaaagaaggaaatatgttagattgcatcatttctattttctgaccaaataaagcaagtgtttttatatgcagagacaaacatttttctaaaattaaatccaagcaatattttacaaaatgcatcctcatgagggacattgtgtaatggacgggcagtaagtacacatttgctaacatatagaaatactgttcaatatccttcattaaacctttgtaaatcttgagagtaaataatcctgaagagtctggtcatttggatgagttgctttgttattgaagatagcagcctggagcagtaaaaagattgaaataaaaaaacactgagctataggtgtctctttgtcaccagaaatacataaactactttcccaagggttaattcaactgtgtaggaggatgaggaagataatataaatgagtgaagcatgccattaaatctgtagaagcagacacacctgcaaagaaatactctatgttttgcttgacacatgaggctaacttaggctatattatataatatatataatttaaatatataatatatatttacaaatatatattatatatttaaattatatattataaatataaataaatatatattatatatctatttttatgtatctatatataaatatataatatataaatataaatacataaatatataagtatatatctatataaaaatatataatatataaatataaataaatatataaatataaatatatataaatatataagtatatatctatatataaatatataatatataaatataaataaatatataaatataaatatataagtatatgtctatatatatataatatataaatagatatataatatatataatatatatcatatatatatacatatttgagatggagtctcactttgttgcccaggctggagtgcagtggcatgatctcagctcactgcaaactttacctcccgaattcaagtgattctcttggctcagcctcctgagtagctgggactacaggcgtgcgccactgtgcccagctaatttttgcatttttagtagagacagggtttcaccatgttgtgcaggctagtctcaaactcctgacctcaggcaatccgcccgcctaggcctcccaaagtgctgggattacaggcgtgaaccactgctcccagcctaacttaggctatattttgtcttcccattttgaggacatgaatgcagaagaaattctctactgaaagaaagacaacaaacaagactaatgataagtgacaacggacagtgagtttcaatgacaaggatactagggactggtggatgggaagtgtgtgcatccaggacgcagccagtctcagcttctacttattgctgctcgatagaaatccaggcaggggctgccagatcttaagattcctggagagataccagtgatttctatttttatataaaacctatcaatttaaaagagttgactcattgaacaacgaaagtaacatgactatattccccaataaatatttgttcattgtagagcatcctcctttggtaataatttttaataaaacaaaaaacaaattttcttatatatcagttatatttataaatataattatataataataatcataagcattcttttagtccatttggtttactgtaacaaaataccttgcctggggaacttttgtttatttatttatttagagacggggtctctgttgcctaggttgaagtgcagtagtgtgatcgtggctcactgcatcctcgaccttgcaggctcaggtgatcctcccacctcagcctcccgagtagctgggactacacatgccaccatgcctagctaatttttgtacagacgaggttttgccatgtggcccaggctggtctcaaactcctgggctcaagggattcatctgccttggcctcccaaagtgctggaattataggagtgaggcactgtgcccagcttgggaaacttaccaatgacagaaatttattgttcacagttctagaagctgagaagtctaagatcaaggcacctgcacctgaatttgcaggtgtattcctcatagttggagctttctacctgtgcccttacctggtggaaggagcagacaagctcccatgggcctctctaatgtggacattcatccctcatgacctaatcatttctcaaagaccccatctcttaatactactgcattggggatcaggtagcaacatatgaatcttcagggggacacaaccttccagaccatagcaactgctatagcttcttctactattttctgttatttgtctttgcaaagaatagccccagactaacatgtttgttgagaacatatgtttgggggtttttttggtagtgtttttcagtcttggggaagctgctagcatttgctatttctgggaaattagaaagctatgtttggtaaaaccaaacttaaaatatgagaaaatgggctatgaatgaagatttgagaaaattttgagtaaaatgcataagccatgcatggattttgtaacatcggttttgactagggtgtgtatgtgtgtgtgtgtgtgtgtttttcttatttcttaattcatagccatgctatagatacttgaggttgctggataagcatcttttactgaagtgaagtattactgtacctaattttagaatatataattttaaggatgaatatttctattagattttgctttaatttctatgaatttaagcttctatttatagacaatgcaacaattgggtttttaagaaatcctcaaaaaacattctggaatgaactgtaaaatgtcccaattaaaatctgcttagtacccaacatgcaattgatttttttttttttttgagatgaagtcttgttttgtctccaggctggagtgcagtggcacgatcttggctcactgcaatctccgcctcctgggttcaagcgattctcctgcctcagccacccgagtagctgggactataggcacgcaccaccacgcccagctaatttttgtatttttagtagagatagggtttcaccatgttggccaggatggtctcgatctcttgacctcgtgatctgcccacctcggcctccaaaagtgctgggattacaggtgtgagccaccgcgcccagcccatgcaattgattattaacgcttttgatttacactcaatattttctgcttcgcttcctctcatcttccttctctcacttcctcttcctccctctgcatcttttctgcattacccctctccccaactttttggagaccaggaagaaaaacgaaacaagtatttcaacaaatgtctatgctgctgctgctgctaattgatgatgataatgatggtgatgatggtgatgataatggtgatgatggtgatgatgatggtgataatgataatgatggtgatgattatggtgatgatgatgatgatgacaacgatgataataatggtgatgattataatggtggctaacatttgttgagtgcttcccatgagccaggcactgttccgagtgctctaaagagaatatctcatgtaatccttacagaaccaaatgctgacagcatgacttgtcaaactacggacagaagtcatctcaggtagcatttactgtgaaaggattttggaagtacacaaacatgatggagaattaagtgctgccatttgagttttataaatgcaaaggccacagtttttggattttgagaggccggttcctaatagcagtgactcagcagtagagcctggagttgagcccaaatcccttgttcctcatcagggcccttttctacatcccttctaaaattaggctgaagttaaacttttagctagactgattgaggataattctcagaaacagtttcataacaatgagatcatggttatttgttattatttcctcaaatttttcttctacatcttaaaatactaccagcaaaatcagttctgggactaatcgtttaaaacatgatattttaactaatataaataaatgatacctaaaggtcttcattagatgaagtaaaataatcaatgctgaaattatgtaaaatatagtctattcagcatcaaatatttaataaacaatatcctttttaacagatacacacacacacatgcacacacacacacacacacacacgtttctccttttagtccttcttcctctttggtgtacctaaggatctaggacctagattttaactgcttttgtgtatatttgatatctttgcaaaattcctatttgtcacatatttgaaacttagaaacaaggtcaaggcctaactagacattccagttaataattttttggctcagggcaagttagttaagctgtttgggcctcaggttttccttcggaaaatagttgtaaaagcacctagtgtttgataggtaaaggtgggtgggagagactctaaataagacaatatgtatcaagtccctgactctttgtaagtgctcaataaatctcagccatgacaattcaaaacatcagaaagcaatatgtaactagaggttaggaaaatatgtcttgaactcacatttttttaacatgggttgtattttctgtgagcttaaataatgaagccatactttaaatagtgtttaagagcataggatttagagcctgaaacacctgtgtttaagtcctgtgtactagctgttttccccttgggcaagttccttaatttttggaatcacatttttccattttcaaattgggagtaataattagctcccctacaggattgtgataaggattaaataagtgaatgcatataaagcatgcagacagtttgcaggctgcagcaaacaataagtgctaaaaatgacctataatgttatcaatccctgatttagaagaagataatccatattttcaattaaccattgccgtgtaaccaacactacagcttaaaatacagcctaggagcatgcagcttgggcagaactcagcagggacagctgggctctgccatgtggtgtcagctggggtgattcttgcattcatctgggagtctgacttgaccagaacttctaggatgacttcatatccatgtgtgacccctcaactggagtgtctgaaaaggctgggattctctggccctctccagaagagtggctcagtacagcacaatggtacagtacaatgacagctcttttttccagggttggcactcttttttgacctacagacgtgtagattctttagaggtgtatttggcttctggactggcccttagattagagaagacctttctcacctcttttaagaaacagtttttttggtgccttcatcttcattttaatttacttattctattcactcaaaaaaaaataattcaacatacagtggtgaagaaactaaacaagttcttgccctcaaggagcttaaactctatgcaggagatagacaataaacatgtaggtaaataaagtaatttcaggttgccattggtgccaaggaggaaacaacaaggccggtgtcagagaataaccctacttataggtggaaagagaaatctcctctgaggaggtgatagttaagcatagtcatgatagaggaagaaggcctaatttcgacaagagctggggaatagggtcacagacagagtgaactgcatgtgctaaggccctgaggtgggaaaggcaaggacctgaaaggaggccagtgtggctggaacccaaaaggccactggagtatggcagaaagaaaaggtgctgccccagattatgaaggccaagaggtatctcagggtgcttggttttgattcagagtgcaatagacagccaatgaaggtttaagtagagaggtgacattttatattttgctaaaggttactttgccatgagcaaacacatacagtgttgagcttagtgaccttcccctgaacctcaggtagcatcaagattagtcactgatagtatcataaataagagatcttggctgggtgcagtggctcacgcttgtaatcccagcactttgggaggccgaggtgggtggatcactagaggccaggagtttgagaccagcctggccaacatggtgaaaccctgtctctactaaaaatacaaaaattagccggatctggtggcgcatgcctgtaatcccagctacacaggaggctgaggcaagagaatagcttgaaacctggaggcggaggttgcagtgagccaagatcgtggcactgcactccaacctggctgacaagagcaagaacctgtctccaaaaaacaacaacaaaaaaagggatcttattgctctgctcaaatgtctcatgagaacattttaagcagagcttatttttggcagaggttgctctcaggtaaatatggtcatttcttaaattttccagagtatcaccacagttggggcacctcattatgcattattataagtccttgtgaggattaaagagaatatatgtgaaatacctaggtgtgggccccatatatgtggtctacaatatgcaccctgtactatgcagcgctgcagccccgtgcccaacacctcagtgacaaagctgcatctgttctttctcttgccttgagggtgccttctagaccctgccctcatctcctttttttttttttttttttttgagacagagtctcattctgtcacccaggctggagtgcagtggcatgatctcagctcactgcaacctctgtcaccctggttcaagcgattctcctgccatggcctcctgagtagctgggattgcaggtgcgcaccacaacacccagctaatttttgtatttttagtacagatggggtttcaccatgttggccaggctggtcttgaactcccaacctcaagtgatctacctgcctcggcctcccaaagtgctgggattgcaggcgtgtaatcgtgtagcacaatatctaatgaggagtttgctaacacaatgctggttaagccacctactgtgaaaaggaaaatgaatcctagggctcagagtactgcgggggatcatttggtgttgctcccgtgaagcccaacccacccatcttctcttactttatggtttcttttttcaatgtatgttttttgttgtcaagttctcttttctaatccttaatttttcttacacccttgatctccattccttgggatttcatcttttatatgccccaaagaagttggaaaatattttcaccaaatatgtctttctgtggaagatagaggaatgtttcaaatatttactattttctttagtattaatgttccctgattctttcccagcatcattgctcacctgtacaactcttataggagctatcatgtattacttagctatggggccaggagagcccacgcagtgaagcaaaaaactggctgctactagcagatctaactggaaacattatctctatttatgtctgcctcttaagttgtctgcactttgtgtctggaatgaatggaaagaatattgattgcaaagttgtcctgagaattcactgatgggtaatctaagggtgtaagatcagaaatgttcatacataaactggttttataattcagtaatttgttttgcagtgtttatagctttgctgtcagctaagcgagctacagacaataataaaatgattcttatacttagcattagatagagctgttattatgacttatttctttgacaggttgaagtcgatcctattactaccttccctctgaagggcttgacacctctcacagagtatactattgctattttctccatctatgatgaaggacagtcagagcctctgactggagtttttaccaccggtaagcagcctcattatggtttgaaaagttttgagagtagctattaatatatagaaaccagaacctggagcaccttctttatttgtgattttgaagagattaaattttaatttttatttcttttatgttattaaaaaataaacaattggatgactattatgtgtagtggctaattattttttatcaaagcaaggaagagagagaaaagaccacctaaattcaaaaggtctgtttttaaaaaaatgtatgtttttctcttcctaatcttatatcttttactttcattccttagtgtaaaacttctacatccttcttccattcaaatgagtgtgtgtattaagttgaatttccaaaattgctgatctccaacagttttggcccacaaaaatgacagtctcatactatttagctcaatatatcagtcgatgattttccccgagcctgaaatcttcatataataataagtaatattttaaacactaaaattaaatataagacatgaatacattatttttcttttctatatgtaccctgtagccactttttatctcttggtggcaacaattctattatttgctttctgaacttatcatggattgcacttggaaacaaatgtagtctctactgaggagatgagacggtaatttggagacagatgaaaaagaagctggattgagaaataatgtttgtggaaaaattcagtaatttaaccaaatctccagaaggctaattctagttgggattctcatggtgtcctatcaaaaagttgggtttttatgtttttttttttgtttttaaactctgacttcaaataataaaaatcaattctttgataatttattttgggtgcagttgggtgttatactttctgttgtacatcccagaagtgtgtaagctctgaaacagtggaaggcctgataaattctatttcatttctgatgaccaccatatgtacaagttaaaagattgaagtttcttttccaggattaataccagggagcaatttagccactaaagcaaatagaactaaaagggaagctttcttaggcccctattttgttaatttcctcaagatacttggaaaataatatttaaaaaaaaaatgaatatggcactcttgttttttatagttaatgaaaacagccaaatagaaaagctaagagttttggaaattactggaaaagttttaagatctgttatttccatggtttccctaatttatgatattggtgaatgctggaaacagaaatggaaggccaccctggactgatgggccccagttttccttctttcctgtgctttcctaaagcaaaagattcctcaaagagtcttctacacccctgggagatacttgggttttggctttcttgccttctcatttccctaacaaaacctccttcctcggtttacagaggaagttccagcccagcaatacttagaaattgatgaggtgacgacagacagttttagggtgacctggcatcccctctcagctgatgaagggctacacaaattgatgtggattccagtctatggggggaagactgaggaggtgagttttctgaaacagactgaaaattaatctggagcattagtgaatacctactgctgctggagttggtcttcactttaaaatatattaggaatcccagaagtaattagtattttacatggcttggagttttagaaatgtcaaatcataagattttcctaatattatgatgtattgttgccagagctttagttatatatttatatattttcagattctttgactttaataaatgacatttaatacaactttaaaatgtcacttttgcaatattaataatttatttgctgaggggattgaaaggaataaagtctctggcttgaccttaaaatggacttcgacagccttggagttctttatgattggttgtttcttgcttatgctcagaataacactttttctttacttttttttcaaataagcatagttactaagcaccaaaatatatttcaggttgtcctgaaagaagagcaggactcacatgttattgaaggcctggagcccggtacggagtatgaagtttcactattggccgtacttgatgatggaagcgagagtgaggtggtgactgctgtcgggaccacacgtaagtcttggtctggccacagtgcgttttagctgctcccacaatccctctttaccccatcaatttccttccccatctgctttatctttggctatgtaagcttcaatttctctttgtcccccagaattcttcatatatcttcactttcaatgaaaccagtatgtgaagcatcttagcttcctagataatgatcaacatgaaggcagggaccatatctgtgttgctcaccattatattttccaggacttagcacagtacttggcacatgttaactgtagagtaaacacccatcaaatggatggatggatagatgaatggatgtatgcaagaatggataaaataatttacaaatgaatagattgccaaacaaataaacctagggccaacatgtcaaagagtttctggaattttccaagttgatattggttccaagagtcttgtacaaaatttacttgctgattcattcatctcttcatttttaaaatatgaggtattgaccacatattaaattgcctttgcctgggttccctggaaccagattctagacagaaattgcagccagaaagtttattgaagagtgcagttgggagatgcttacgtaaaaaactgaggacagcaggagggggcatgggaagaagttgaaactgaaccctcagctaatcttattataatggaggtctagtgctgggatgacccttctgagttgtcccaaattgagacaaaggggctgagacttcatacccttgcatccccagtcgctggaggtgagccattccctgacagaggccatgaactcaggcgagacagttcccagagctgtgaactgttggcaggcagtgttccagcaccaagtggattggtgtgttgaccctaaaaagaggatctgggaagagcaccacatctgtacttcattctgctatatgcccacggtggctgtaagaaatagaagatgcattgcttgtccaagcacattgcattccgtggtggtcctgtttggcagccttttcacaacttggtctacagcactgtctaatttcccttaattaccatggctgtgcccctatttcaaagtaattgggtggtttcacaattctgtagatgtagttcaaatgtttatatgaagcctggtatctgtgatgagaaactttaacattctttgggtttcagttttcttatctgtggcacaggtatgtctgccttacttacaattcatttctttcgtcttctaaccattgtcatgtttgttgtgggaggcaagtgagataatataggtgaaatgttctttgaaagctacaacatgctatagaaaaatggacagttgtttttgcagcattttaaagtaatatattgcttttagttgacagtttttggacagaaccagctacaaccatagtgcctaccacatctgtgacttcaggtaaggtcaaatagtagcctgcttaaccactttaaaaattttctttaaacagatgttatattatcctggttttatttattattaactaggaaaagagatgaccctcccttccttttctggcacactggttcaaatttcacgcctctcagagcctctcaacaccttccttgccactaaatgcccatggatctcctagtcaactgatctcactgatacatcactctacctctttcatctttgtctggatgctcatgcaccttacctgggatgttaacgtagctgcctccccaggggtctttgccctcctcttttttttttctttttattttattttattttattttatttattattattatactttaagttttagggtacatgtgcacaatttgcaggttagttacatatgtatacatgtgccatgctggtgcactgcacacactaactcgtcatctagcattaggtatatctcccaatgctatccctcccccctccccccaccccacaacagtccccagagtctgatgttccccttcctgtgtccatgtgttctcatcgttcagttcccacctatgagtgagaatatgtggtgtttggttttttgtccttgcgatagtttactgagaatgatgatttccaatttcatccatgtccctacaaaggacatgaactcatcatgttttatggctgcatagtattccatggtgtatatatgccacattttcttaatccagtctatcattgttggacatttgggttggttccaagtctttgctatcgtgaatagtgccacaataaacatacatgtgcacgtgtctttatagcagcatgatttatagtcctttgggtatatacccagtaatgggatggctgggtcaaatggtattgctagttctagatccctgaggaatcgccacactgtcttccacaatgattgaactagtttacagtcccaccaacagtgtaaaagtgttcctatttctccacatcctctccagcacctgttgtttcctgactttttaatgattgccattctaactggtgtgagatggtatctcattgtggttttgatttgcacttctgttgctctctgttgagaattccccttcttttctctttttttcttttagagacagggtttcattctgtcatccaggctggagtgcagcaccacgatcaaggctcaccacagccttgacttcctgggctcatgtgatcctccagcctcagccccccacgtagctgggactacagacatgtgtcatcgtgcctggctaatcgttttgaattttagtagagatgaggtctttccatattacccaggctggtctttaactcctgagctcaaatgttccttcatccttggcctcccaaagttctggaattgcaggcatgagccaccatgcctggccttgttgagaattattcttaccatgttttccttgcatttctgtgggtaactgacacttggctggtctattgtttttcctacattagttgtttcctctctcagcttagctttccccttcactgtaatacacctcccaactagctgtcagagtcaacttggtaaaacacaagtttgataatatcatttatttacttctctaagacacttcaatggctctccattacccatttgttgatttgttcattcttcatttaatccttatcaagccttctttgtgctttaaagtctttttcacagcatccaagatccttcctagttgggtcctgcttcccttcctggcctcaaccatatttcctatgcttcccccgtttttctcttgcaatcccgaactcctttccctaaatgtgagaagttccctcccattcccattgcctggtagcccccctgcaatgttgccaggtaaatgtcaaccccctcctcctctgtgacacttttactatttttgttgagttaataactatataaaaaccaaagccctaacagtctgacacacagaaaaagttcaatgaatattttctaaatgaattaatagatgaatgaagagaaaggagaatgagaaaagatggacaaagggaaatgaagttagggtagaagagaaaagaaaaaaatgcaacaaataagggagcaggcaccttgagagatgagcacgaatgtgccaggaaacacaggtaaaggagtttggacaagtaccagagaaaagatcgtgtctgtgtgggctgaatggataaaggcagcctgagcgcagatttgtgctttgaatgacaggtgttaaaagagaaatggaggtgagggcaggtgattgggatgtgtgttggatgctggattgcacacagaggtggacaaagtctggcccactgtgcccacttgtccacagagcactagtgtgaggttctcatgaccactctttcctttgggttccatgggctgtttttctagtctcagggcttcttcccagttctctttactagtgcacatacagaactgacagttttgagggctccatggtctcatcttgtaagcatctcttaattccacttttatttgctgctagtaggtatcatgcctccccattaagcaccatagctgagcccttcttgcctcatatacaactatattacagggatacattaaatgatgcttgctgtcaccccacaggtattctctgtggctcattttggaatatgatatgttaaaagttttttaatccttggttgtgtttattccagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggtctgtataaattcaactgactagaaactctgcagatgttactaacacagctaataagactgtcttcggagatcaatgcaaactttactgctcttttctcagtgactctgccatctccagaaactaatgttctctgttaatctgactccactactggcttcttagtgacctttataaatccaaaacttgctccatgtacaacttgctccaagttaataacctctgaacattgtttcaaatattgcttctcttctgctgccttgcacctgttcgagcaccaaagttgggtcataaaaggccatatgcacttgtgtctgtatatatgtatgtatagacatgtataaaagtttaatatagaaaataatttcttctgcccttggaaatctgataaaaaaacttttaagcaaaggacacagaaaaggtcttctatatggtatagtgaaaatattcttaataaaataccatccgttaaccaatagttatatttttcattgacatcaactcgtattgagtagatttatagtcatttctaattattcgtaacatggatgtatcccctcagggatttagatttttatacattgagttttctttgagttgttttatctatctttcctttttctaaatgatacactctttttttctaatttatttatctttttttaatatacttaagttctgggatacatgtgcagaacatgcaggttttttacataggtatacatggaccatggtagtttgctgcacccatcaacccgtcatctacattaagtatttctcctaatgctatccctccccttgccccacaaccccaacaggacccagtgtgtaatgttcccctccctgtgtccatgtgttctcattgttcaactcccacttatgagtgagaacatgtagtgtttggttgcctgttcctgtgttagtttgcagagaatgatggtttccagcttcatccatgtccctgcaaaggacatgaactcatccttttttatggctgcatagtattccatggtgtatatgtgccacattttctttatccagtctatcattgatgggcatttgggctggttccaagtctttgctattgtgagtagtgctgcaataaacatgtgtggatgtattgttatagtagaatgatttataatgctttgggtatacacccagtaatgggattgctgggtcaaatggtatttctagttctaggtctttgaggaatcgctacactgccttccacaatggttgagctaatttacagtctcaccaacagtgtaaaagtgttcctatttctccacatcctctctagcatctgttgtttcctgactttttaatgattgccgttctaactggcatgagatgatatctcattgtggttttgatttgagtttttctaatgaccaacgatgatgagctttttttcatatgtttgttggctgcataaatgtattcttttgagaaagtgactgttaatatccttctcccactttttgatggagttgtttgtttttttcttgtaaattggtttaagttccttgtaggttctggatattagccatttgtcagatgagtagattgcaaaaattttctcccattctgtaggttgcctgttcactctgatgatagtttctttagctgtgcagaagctctttagtttaattagatcccatttgtctattttggcttttgttgccattgcttttggtgttttagtcatgaagtctttgcccatgcctgtgtcctgaatggtattgcctaggttttcttccaggatttttatggttttatgtcttatgtttaaatctttaatccatcttttcatttttgaaacatgcggtgtttggttgcctgtttctttttttgtctaagattcatttttgtataaggtgtaagaaaggggtccaatttcagttttctgcctatgcctagccaggtttcccaacaccatttattaaatagggaatcccctccccattgcttgtttttttccaggtttgtcacagatagatggttgcagatgtgtggtgtcatttctgaggtctctgttctgttccattggtttatatatctgttttggtaccaataccaagctgttttggttactgtggccttggactatagttttaagtcaggtagtgtaatgcctccagctttgttctttttgcttaggattgtcttggctatatggactcttttttggttccatgtgaaatttaaagtagttttttctaattctgcgaaaaaagtcaatggtagcttgatgggaataacattgaatctacaaattactttgggcaatatggccatttttatgatattgattctagctatccatgagcatgaaatatttttccatttgtttgtgtcctctcttatttccttgagcagtggtttgagttctccttgaagaggtccttcacatcctttgtaagttggattcctaggtattttattccctttgtagcaattgtgaataggagttcgctcatgatttggctctctgtctattattggtgtatggaaatccttgtgatttttgcaattgattttgtatcctgagactttgctgaagttgcatatcagcttagggagatctggggctgagatgatggggttttctaaatatgcaatcatgtcatctgcaaacagagacaatttgactttctctcttcctatttgaataccctttatcactttctcttgcctgattgccctggccagaacctcgaatactatgttgaataggagtggtgagatagggcatccttgtcttgtgccgattttcaaagggaatgcttccagcttttgcccattcagtatgatattgactgtgggtttgtcataaatagctctttttattttgagatacattccatcaatacctagtttattaagagtttttagcatgaaggggtgttgaattttattgaaggccttttctgcatctattgagataatcatgtggtttttgtcattgattctgtttatgtgatgtattatatttattgatttgcgaatgttgaaccagccttgcatcccagggatgaagccgccttgattgtggtggataagctttttaatgtgttgctgaattcggtttgccagtattttattgaggattttcgcatcaatgttcatccagggtattggcctgaaatgttctttttttgttgtgtctctgccaggttttggtgtcagcatgatgctgacctaataaaaagacttaaggaggagtccctctttttctattgcttcgaatagttttagaaggaatggtaccagctcctctttttacctttgtcagaaattggctgtgaatccttctggtcctgggctttttttggttggtaggctattaattactgcctcaatttcagaacttgttattggtcttttcaggaattcgacttcttcctggtttagtcttgggagggtgtatgtgtccaggaatttatccatttcttctagattttctagtttatttgcatagtggtgtttatagtattctctgatggtagtttgtatttctgtgggatcaatagtgatatcccctttatcatttttattttttgttgagatggagtctcactctgttgcccaggctgggagagtagtggtgcaatcttggttcactgcaacctcctcctcctgggttccagcgattctcctgcctcagccttccgagttgctgggactacaggcacctcccaccatgcccggctaatttttgttttttttagtagagatgggttttcaccatgttggccaggctggtctcaaactcctgaccctgttatctgcctgccttggcctcccaaagtgctgggattacaggcatgcaccacccctgccccctttaccattttttattgtgtctacttgattcttctctcttttcttctttattagtctggctagtggtctatttatttttttaatcttttcaaaaaacaagctcctggattcactgattttttgaagggcttttcgtgtctctatctccttcagttctgctctgatcttagttatttcttgtcttctgctagcttttgaatttgtttgctcttggttctctagttctttaaactgtgatgttaggatgtcgattttggatctttccagctttctcctgtgggcatttagtgctgtaagtttccctctaaacactgctttagctgtgttccagagattctggtacattgtgtctttgttctcattggttccaaagaacatatttatttctgccttgattttgttatgtacccagtagtcattcaggagcaggttgttcagtttccatgtagttgtgcagttttgagtgagtttcttaatcctgagttctaatttgattgcactgtggcctgagactgtttgttatgatttgcattcttttacatttgctgaggagtgttttacttccaattgtgtggtgaattttagaataagtgtgatgtggtgctaagaagaatgtatattctgttggtttggagtggagagttctgtagatgtctattaggtcctcttggtccagagctgagttcaagtcctggatatccttggtaattttctgtctcatttatctgtctaatattgacagtggggtgttaaagtttcctactattattgtgtgggagtctaagtctctttgtaggtttctaagaatttgctttatgaatctgggtgctcctgtgttgggtgcatatatatttaggatagttagctcctcttgttgcattgatccctttaccattatgtaatgcccttctttgtcttttttgatctttgttggcttaaaatctgttttatcagagactaggattgcaacccctgctttttttttttgctttccatttgcttggtaaatattcctccatccctttattttgagtctatgtgtgtctttgcacgtgagatgggtctcctgaatacagcacaccagtgggtcttgacttttaaccaatttgccagtctgtgtcttttaattggggcatttagcccatttacatttaaggttaatattgttatgtgtgaattcgatcccgtcattatgatgctagctggttatttagcccattagttgatgcagtttcttcgtaatgtcaatggtctttgcaatttggtatgtttttgcagtggctggtaccggtttttactttccatatttgttacttcctccaggagctcttgtaaggcaggcctgggggtgaaaaaatccctcagcatttgcttgtctgtaaaggattttatttctccttcacttatgaagcttagtttggctggatatgaaattctgggttgaaaattcttttctttaagaatgttgaatgttggcccccacgctcttctggcttgtagagtttctgcagagagatccgctgttagaccgatgggcttccctttgtgggtagcccaacctttcgctctggctgcccttaacattttttccttcatttcaaccttggtgaatctgatgattggggttgctcttcttgaggagtatctttgtgatgttgtctgtatttcctgaatttgaatgttggcctgtcttgctaggttggggaagttctcctggataatatcctgaagtgtgttttccaacttcgttccattctccctgtcactttcaggtataccaatcaaacgcagatttggtcttttcacattgtcccatatttcttggaggctttgttcattccttttcattattttttctctaatcttgtcttcatgctttatttccttaagttgatcttcaatctctgatatcctttctttcacttgatcaatttggctattgatacctgtgtatgcttcacaaagttcttacgctgtgtttttcagctccatcaggtcatttatattcttctctaaactgattattctagttagcagttcctgtaagcttttatcaaggttcttagcttccttgcattgggttagaatatgctcctttagctcggaggagcttgttactgcttaccttctggagcctacttctgtcaattcattaaactcattctccttccagttttgttctcttgctggcgaggagttgcgatcctttggaggagaaggggcattctggtttttgaaactttcagcctttttatgttggtttttttctcatctttctggatttgtctacctttggtctttgatgttggtgacctttggatggggtttgagtggtcgtcctttttgttgatgttgatgctattgcttcctgttttttagttttccttctaacagtcaggcccctctgctgcaggtctgttggagtttggtggagggccattccagaccctgtgtgcctgggtatcatcagcagaggctgcagaaaagcaaagattgctgcctgctccttcctctggaagcttcatcccagaggggcacctgccagatgccagctggagctctcctgtatgaagtgtctgtcgactcctggtgtctccccatcaggaggcacgggggtcagggacccatttgaggagactgtctgtcccttagcagagttcgagcgctgtgctgggaggtcctctgctcttttcagagccagcaggcaggaatgtttaagtctgctgaagctgcgcccacagccaccccttcccccaggtgctctgtcacagggagatgagagttttatctagaaacccctgactggggctgctgcctttcttttagagatgccctgcccagagaggaggaatctagagaggcagtctggctacagtggttttgtggtgctgcggtaggctctgcccagtccaaacttccaggcagctttgtttacactgtgaggggaaaactgtctactcaagccttactaatggcggacacccctccccccaccaagctcgagcatcccaggttgacttcacattgctgtgctggcagcgagaatttcaagacagtggatcttagcttgttgggctccgtgggggttggatctgctgagcaagaccactgggatccctggcttcagccccctttccaggggagtgaatggttctgtctcgctggcattccaggcatcatggggtatgaaaataaactcttgcagctagctcggtgtttgcccagatggccacccagctttgtgcttgaaacccagggccctggtggtataggcacccaagggaatctcctggtctgtgggttgcaaagaccgtgggaaaagcatagtatctgggctggatagctctgtccctcatggcgtggtccctcatggcttcccttggctaggggagggagttccccaactctttgtgcttcctggatgaggcgacgtcccaccctgcttatgctcaccctccatgggctgcacccactgtctaaccagtcccaatgagatgaacccggtacctcagttggaaatacagaaatcacccgccttctgcattggtctcactgggagctgcagaccagagctgttcctatttggccatcttgcccaggcaccaaaatcaatgatacactcttaattgtggcctggtacacttttaatcatggccttcccatgtattctaaatttacactatatcattcctttcagtctagaacctgaaaattctttcttagacatgtttctaatcaaaccaggtaactccagtatgcatccagaagaatttttcttttgagtcataaaatatgtttatttagctcattacttgcatttcttgccctctgctgcattatttctgacactctgggaaagaagtctacaaaatttattattgctcaagtataacattatcattcctttgccttcctcactcaaaaagccttcaatgggaagttacttttatttatgtgcttacataaacaactatttgaccccagaatcctttaaggaaagtacttcatttctggctgatggaggaaatattacaggacacagtgacagacccaagaagagccacacctactgtgaatagccagaaggccattacactgatctgggagtacttttgaaaagttaatggattcttaaacaaaatagattgaattacaaattcactcagaccatacacttcaaatggttcatgattggcaaattcaaaaaataaaataaaattatggttaggaatggtaattaaatatataagttgtgatttttttttctgtgttatttttctcatattgtaattgagttcctaaaaatgagacccgtggaaacttcccaaggtgagaggctttgttttgttttgtttctgttttttgttttttttttgtttgtttgctttttgttttttactttttctgagaaatacattaagcttcttagtgaattattcctgttaatttggaaagaataaaaatttaatatcatgcatgcacttgtaagctatgcaaggtaaaataataataatatttactttgggttgtctctagataatttttccttttctagtttctttcgtttcacactgtttatttttgacatagttggacacctagatgaagggaaaaaaagatcaaaagtcttaaacactctgacccagttaaacaaacctgtagtaaaaacgaaaaatattgataaatttggtggtgcttatttgctttgcaaaactgtttttttttttctctctctctcttttgccttacagaagaacctactgtagaattctttaagtatcaagctcctttagaggattttaattaaataagatatgtacacacttgatttacaggtgccctctcagggactcacctgagggttctttgaaaatttgtatcagtgttttatgaagtgttactgtgatacaaatgtaatgtgttatgactggagacagaaagtggactgcatgtaaatttagattatgaaactaaggtggacaggcagatgcacatctctattaaagtctgagggtcttgaaatcacatggaccaaatgacatcttaaaataataatgtatggcgcagaaagacagatggctaagacatactatgaaagcaagaaaggaaatgtgtcaagataagaggaataccagaccttccttaactctcaaggctgattaaatttacacaaagaaatgataagcttgtgtactgaagttggacaatagtgtatgtatatgttatacactgtgtactataacattgtagaccaaatttcagcttaaacatatgtaaaacaaggggaatttaatttacgtttccagttgaggtaaatgaaatgtttctatactttctagatataattacatctatcaaatacttctaggttaaaaaaaaccctttgaattcttagaaataaaactatagtacctgtcaaatattttgtaaggattgactttcaactctgtcttggaatatggaggagtggcaatgacattgccatacattttgttgtcagggtaggaaggtctctcatttattttaaaaggctagtcaggatttcagaattttctagagcctcagtgtaaaaatctgtagctctaacatgaattctgggttgcaagaatacgtctagagtaagaatactcaaagtgtgactcagtctcctacatgactgcatgatagtttcagatattaagattaacattttagaaacattgatagccatttgacattactgcaacaacctgagaacatgatcacttttctaaccacttggttttatcgtattttacaaataaattggtctgcaatggatgggaattaaaatgacaccaccaccaccaacaatagcaactagtccttcaccacaaagagtttgagaatcactgcctagaactgaacttcataagaggggaacacagcgagatgcagggcatcctctttctactgcaggaacagctggttggatatggtccaggttgctctgaaaagctttgggtgatattagagccagacatgaaaatccatttctgaaaaaaattaaaagcatgaagctcactggttatatttccatcccacttaaccatgaacattttttacagaactgttttataaataaaaccagcatctgttctgacctgcagcatttgtttttagtaggagcacatttttttactttgctttgtctaaacaagcagaggccaagcaagaggaactttgcatacccaagaggagatggttttttactcttgaaaatgaatatcaatagggtaagaaggttcaagtggtgcagtcatgtggagtagaggacaaaggcccagacaagattcttggggtttcggtatggctcttttactcaatatctatatgggcctcagttttctcatctgtaaaatgaatgtgatgataccccttatttcaaaaggtggtagtgaagattaagtgaattacagattgagaattcctaatcataaaattcaaaatctgaaatgctccaaaatccaaaacgttttgaacactgacatgatgctacaagtggaaaatttcacatagaagtaattaacacaaactttgttttacgcacaaaattattaaaaatattgtataaaattaccttcagattatgtatataaagtgtatatgaaatgtaaatgaatattgtgtttagacttgggtctaatcctcaagatacctcattatacatctacaaatattcctgaatctaacaaaatttcaaatccaaaacacttctggtctcaagcatttctgataagggttactcaatctgcatatgctgtattagaatgcttacagcagcacctggcacatagtaattgctaggtaagggaagcctcttactataaatcacagcaactattcctggcaagctaatgagtcttctaaaacagtcacactgctttttagtattccatgtgctaaatttaattggttagttccaagaccatgggcttctcagtttgaaagaagacattatttaacatcaacatgggtggtttgttagatggacaaattgaaatgaatgcccaggctctgcttcagaggggttacatttaagagaaacaccctgagggaagctatgttggtggagtaatgcaagtcagggcaacctcaattcttctcttacacgttcttagtgctagggccgtctaactcattctggaataaagcagagcttctttgtaaatatctccttctcaggaccccgagtccacacatcaattcagacctgtacatttcaatggccctttcctatgaggagcaaaatcatattaatctcatataaaaatcatctaatttagatttccttgtttcatatttaaaatactgcttttaagggcttagcaatatcttagcaacagctgcttctgggttcaactcgaggctttctagggcttattccatgatttataggttccttccttcatccagaaggagacagcatcgccctttgcctgctggcattttacccagcacttgaatcgaaaagtaactccagctgtcctggtcttgtgactcccttaaacccgtttgagtcagttcttacatcctagcacttttccagccatgattaagttctttaaatggcccggtgatgggccagcttctcactcctggagcacagacagaaagttttgtggttttagcactgagaacatgtggcttttctggtccagacgattcttttcgaggtggcagagttcacaagccaccacatggagccctgcactcacacttgcgcgatgtcgaacccactgctgcatttcttttttgtggggacagccttttagacacagagtgatggtgattctagattgaggaagacaactcctttcagaaataaaaaagctgcaccgttttttagtgttgctggtaaatatgcttcagctcaagaaaacttggctttgatgtgtggttctgttgctcttggctaggatccatcctttctaactgaaagaagaaaatgctggggtctgattatctctgaaggaggaaataatggaaggctgactttgcaagaggatacttaagtaaaataaaaaatgataagcagcaggctggattatagaatgagctctcccaatctataaacacctgctatctaaacaggccattattctctcttctggatactttacaaatgccaagaagatgttgagagaagaatattccttagagcttaagagtgtcaaatttaaaccttctgtattagtgattataaactaagggttactgtgatgggaatttcagggagaaacgcttttgcatgagtgccctttcttttctcctcactctcaaagcacatctcttttcttttgattatttcaaaatgcataaagttatgctccattaccaaatcagtggaaacgggtctcactaagactgcagtcctttgcttttttgttcaggttatggtgcctggaagccagaacaacctccttctgaagcctctgcttcctgatactgaatacaaagtcacagtgactcccatctacacggatggcgaaggcgtcagcgtctccgctcctggaaaaacctgtaagtgaagctttctccctttgaatacaagccgactcattaaatggaaatgcttgtcccctgtaatgcaccctgaaagatacagtagattgcagtgaagaaactaaaagatttgggaacaggaaatctgtctgcatcctgtctttacacacacaagctatgtgactttgagcaaattgcttaaatgttctgggctgcagtttctttttctgtggaagtgaagacttgaaaaacaactacatctttctcttccagagtttaattcgtcaaggtcctgtgattcatcaaaatgtattctgcatgcctgatctctcttcatctaacaggtgtgctctagtccaagccacactctctcttttattttcattttatttaattaatttacttttatttccataggttttggggaacaggtggtatttggttacatgagtaattctttagtggtgatttgtgatattttggtgcactcatcacccgagcagtatacactgaacccaattggtagtctcttatccctcatccccttcccaccctttcccctggagtccccaaagtccattgtatccttcttatggctttgtatcttcatagcttatctcccacttataagtgagaacatatgatgtttggttttccatttctgagttacttcacttaaaataagtctccaatctcatccaggttgctgcaaatgccattaattcattcccttttatgcaagccactctctctctcatccagatgagtgtactagcctcctgtcaggtcttcctgcttctactcatgccatctcctattcttcttatagcagcttgaggaggttttcagcagataaatgatctgcacctctgttttaggcctcccaatggcttctcactgtacccaggatgaaatcttatgtccttccgtgccttacaaagatcaacctaccacctggatcctgccgatctctttgatctcccctcctggccatttccccattcatacctccctgtctgctctccactggactctttgaagttgttcctgccttaggccccatgccctagcgattccttctacatggtatatgctttcccagatatttgcatgtaagagtttttctggtcatccgggtctaggctcaatgtcacctcctcagccttttctggccaccccatgcaaagtagcccccactgtctatgatattatccttttttgtttgttgtttttggtcatatcatggcactaattactccctggtattttcttatttattcatgtatttgctcactttctgtctcccatccctggaaggcaaagtatcatgagagcctggggcctcatcaatactgttcacctctgcatgccaagctcctatagtgctgggtggcacagaggaggcgtcatgcaacgcttatttaagatggattgaccatgttcctcaaatgagaaagatgcatgaaaacccttggttaaagcactgcagagtcatagttgtcttcattattgatatgattttctattcttgcataaagactgctctagaacttaatggcttaaaacagtgaccatttttttttatcatatctcacaattgtttgggtcaggaaattaggcaggacttgctgggaaagtctgctccacatgggattgatcagtgtcacctggtggtattcacttgagggctgggctggtctggatgttacaggacaactttacccacatgtctggcatcttggtgggggtggcaagcaggctggacccagctgagtgcctctctctctcccttagtctcagagcttctccatgtggtctttccagcagagcagtcatatttcttacatgtcagctcaggactgtaacagcaagagttccaagaggcataaaatggaaactgctagtgtcacttctgctgcagtctatttattggtcaaggtagtcatagaacccactcagatccaaataaacagtcatagtgccacctgtcaatggaaggagggttgaaaactctgtgaccatctttatccatcataattaccaaatggtgacatgtggttaggttcaaaatggtgtcaagggctgaattatgtacctgggcaccgaagtgtggagttttcaactaagtttgcgaaaatcattaaaattctgaagcccagagtcctgattctgctcagctgggcaaataggtatcatctcctcatttaacagtgctggcatctctccctcctcccgtgcttatgccgtgtgcctccacccagactcccaccaagcctgcacattttgctaaaaatcacccagagtattgtgagtccttggagctgctatagttgtttcctcaagggacatgaggaaggagagaaggaaaacagaagagcagagctatagggagatttcaaacttttcactccacctttaccagtatattggcatcttgatttggtctatgcattggaatttctagcatatgttggtatgttgctgctaaataaatgtttgaaaaccaaaatcacagacttaagcaacaattaaagaaaacatcaagtagtattttacctagcgaggtaaatacttgctattatgtatttatctttaaataaaaactatttaaagattattagtatgaaaatagggcttaaatcttattacagaaatgccattacgtcttaaaaatctctatatagtaaaattattttgaagtgttagtggatgatctaagcagtgattaaggagtggccaacacaactacgttttatcaacaacaaaatgataatgacaaaatgcatacaaatttacaacagtcctccatataaatgactgtaatgttttgataaaaatggataagcaataatataaaacttcaaacagtataggaaatatgaagatgaaagcaaaaaataaaatcagaatcttacctctgagaataatcaccattaacattctatgaacacacccccagtattgctgttcacatatgcttagtggaacacagtggcatggagacagacatttctaataaacacgattgaattcaattatacctaaaattaactgatgaatagggaatcaaaataacaatgaaagacttctacatttcagataaaagtattttgttctaagagcaattatttcccatatatttaatattgaaggctgggcatggtggctcacgcctgtaatcccagcactttgggaggccaaggagaatggatcacaaggtcaggagatcaagaccatcttggctaacatggtgaaaccctatctctactaaaaatacaaaaaattagccagacgtggtggtacgtgcctgtagtccaagctacttgggaggctgaggcaggagaattacttgaatccaggaggtggaggttgcagtgagcggagatcgtgccactgcactccagcctgggtgacagagtgagactctgtctcaaaaaagaaaaaaaaaaattgaaaacaaccacagactctcaaaggcttctcattgtgtgtttcagtgcactttcacttttaaatatttttaattttgtgggaagatgtcttatattttgatggcatcagtgtaggacataaagaaggaaattacactgaatccctgtttttccttttcttttctactcagtaccatcctcggggccccagaacttgcgggtgtccgaggaatggtataaccggttgcgcattacgtgggaccccccatcttccccggtgaaaggctatagaattgtctacaaacctgtcagtggtaagtaatgctttgtaaataatgttgataccatgagtagtcacttaaaatgtcttttaagataaattgttttcttataacaccttatgtttggttgtatttttttaaagaagtagggagaacctcttacttgttttggaaaaataaagtgttttagtatggtcagtgatagggtagatattatcaggatgatgaagctatgacatcacataaaaaactactgggcacatcaattagaagactatatattgggtatatacatgacctaatcataccctagaccaggaaccaatctaaggaaatcttgactttataggaataggaagctttatgctcaataaagacataaattctaaacatttggaatctctaacttcaaagttctcttctacctcttacttcttggattagttggaaaattttcatttaccaacttcttagtctcctcagtttggaaatggaatagggggaagaaaaaaaaaactcatcacggtagtaaaatgcttttccaccagtctcttagccacctccataagaggatccctctcgcctctacctcccacatcattatatcttgaaggcatgaaaatgatacaagtagaaagcgatcgtacccttggtctgtatgcctgtgaagaggagaccgtatgccccagcacctcttacagtaccatctccccattcttagcaatctcacaaagtttaaacaggagactagaattgatgttattaaggtcttctcagttttctagacctgggcctgcagtactctagttgttcagcagaaagggcaggaaaattttaaaaacattcttacggtcattaaaacattttctgctggctgggtgtggtggctcatgcctgtaatctcagccctttgggaggctgaggagggtggattgcttgagtccaggagtttgagaccagcctgggcaacatggtgtgacccagtctctacaaaaatacaaaaattagccaggcatggtggcatgcaccgtacccccagctacctgggaggttgaggtgggaaaattgcctgagccagataagtcaaggctgcagtgagctgtgatcacaccactgcactccagcctgggcaacaaagcaagaccctgtctcaaaaaataaaaataaaatataagcactttctgccttcaaaaactccattagtttcaatctttcttttttttttttttttttttttttttgagacggagtctcgctctgtcacccaggctggagtacagtggcgcagcctcggctcactgcaagctccgcctcccgggttcacgccattctcctgcctcagcttctccgagtagctgggactacaggcgcccgccaccacgcccggctaattttttttttttttttttagtagagacggggtttcaccgtggtctcgatctcctgacctcgtgatccacccgcctcggcctcccaaagtgctgggattacaagcgtgagccaccgcgcccggcctagtttcaatctttcatctgagatatggttctcgccccatatcaattttcagccttttctattgtgcctcattatccaggtgctattgtcttcaggcccgtaagactcaaatactcccacctccaatttctccagacaaacatccttataactaggaaaataaaacagtaagactagaacatgggtgcactagcctgctccaggctcattctctgggacccatcaccaatgtttttgtctgtttgctttaggccggaagcatgcgttaatttgtaagacagccttgcttaatttgttttttggatcattttacaaatattgatcaggctttctaagcacaaaaagctttattttaggccagcggttctcagttgatgtcatttgctcccaaacggagacatttttgattgttacaactggtgagagaggacttgctcctggaatctaatgggcactcctaaacatgctacaatggacagtactcctctgccccagaataaataatttttcagttcaaaataccaatagtagtgaggctgagaaatcctgttctaggccaagtgggagaaatatacatgtatggtcatttgcattgtacgtgtggggcatgggaaaattgctactgaggtaacacatacagagatagacatataaatgtattgttggaagggggcttctggaggaaagtgatgagtattttgagaacttgtcactaactcaaagctcttaaagaatgagcatgcatgggaagaagcaggaggtaaataaatttgtataggctttagcaatgaatgtttttaatgcttcattaaagaccccactagattgaagaagaggtgaaaacatacagacctgaaaatgctagctaatcaagggccttggaataagagcataatctgtctggtattaaacatcctaaaaggagcagataaaaataaagtggtaacattgatgctggttcacaatgtggcaaggtatggcctggtctccatgataaaatttgctatgactgccgcttgtgtgcctgctgggagcaaagttggttaccttagaagggacaattgagaattatttctttaattggactaattcctcaattgcctattacaacatagtacataacaatatagcagatggtagactgtgaggtggaccaatttctttgaataagtacaaggataaaactatatttagggaaatgactaggtccctaaaaataacctttagcccagcagtttttagagctagatgagaccagattcaaacctcaaccctgctgtctgcttgctgtataatcccaggcaactgaaaagcagtcaagtgaatacaatttgatctaagagtgcttctattttcccatattttgttgtaactaaaatatatcctctttcttctttagttcctggtccaacactggaaacgtttgtgggagctgacattaacaccatccttatcacaaacctcctcagcggaatggactacaatgtgaagatatttgcctcccaggcctcaggcttcagcgacgccctgacaggcatggtgaaaacatgtaagagccatttccgatggcctcagccgcatatgggtttttgttttgttttgttttttgagatggagtctcgctctgtcgctcaggctggagtgcgctggtgcgatctggactcactgaaacatccgcctccagggttcaagtgattctcctgcctcagcctctcgagtagctgggattacaggcacaagacaccatgcccagttaattttcatatttttagtagagatggggtttcaccatgttggccaggttggtctcaatctcttgaccccgtgattcaacctcctcagcctcccaagcacatggggttttgctgctttgttttcactgtaactttcactcaaccctgcttccatttggtcattcatttttccttttcctctgcattgccctttctggatggtgtttcatggaaagaaaggtgtgctttttatttggggtagttcagagtcctggttggcaggcgggatgtcagtacctggctttcaaatagacttgatgattgcagataggatttccttctggaaaatctgtgttggcatttttcaaattaggtgaaattttccaaacagcctgtagcccgagatggccaatgtcaaagttggagcaggaggaggtttgtcttttctcagaggggtcactccacccccttgcacgtgcacatatgccatccatcaaaagtacatgccaccccattctcagcacttccttctctactcctttgagggttttcacgttgtctgcacaccatctgggactccttagtggcatacaccactcccagacacccacacaataatgcaatgttttccaaattccagcacctgtgtgccatattcctgaagtttgttatacctccgcatgatctgtttatttatttggattgacttacagtttttgacctaaatacttttcaaaatccatgtagttaccctaaacagaaaatcagtatttttattttttaatatattaaaaaatattttctcctctactagctttttagttaaatatccaaattttcatagataccctagagatttcaatatgaatccttagcttattccagtctaccttaaattactgctttttggcttaagaattttataacaatgtataatacctttttcctttttgctactctttttctatctattttgtaactctattgctataaaccccttaagatattattgttgttgtttcaaatactcactattctttcattttttttctagctttattgaggtataattggcaaataaaaattgtatatattcaaggtgtagatacatagatctgcaatcttcaatgtgatgatttatgtttacaatgtgtaatgatcaccacaatcaaattatttttgaagtatacattttattttcttttttgatagtcaaatgacatctttattttattttatttattttaaaaacttcaatatcccttagggtacaaggggtttttggttacacggataaattctctagtggtgaattctgagattttagtgcacccgtcactggagcactgtatactgtacccaatacatagtctgttatccctcaccccgcttccaaacctcccgtctttagtccccaaagtccattatatcactcaaaatttttaatcacattttaaaatacacattaaagacaacatataaatgaccaaaatacaagtggtttggctgtatgctagtctagatagtcctgagtgcaatcaacagcacatgccccactcttgagatcatagtcatggtattgtcaaaagaataagcctcaaatctgctacttgttagtgtggccttgggcaaattgcttaacttccctcagcccaagctttttcaattctaaaatgaagataataataaccatcgttcaggcaaattgtgaggattacagagaaaaaatgtatgtaacgtgcttacgatgtggcaaatattcaataaataactactattattattgtaatgatggggctttatgcacttgccctatatcttaccctcatccctaaaaaataattaatctaatcaatactgtcaagcaagagtgggccatatattaagccagaccccagcgccccccgattgcatatagggccagcccttttatagaagaggtgtcctgaactctctgtcgtggaatatcttgagaccttaaaggctagacagtgaataaatttatcttaaaagaaatagtctccatcttcaacaggcctaggaagcctttggttggggttctgatcttgtgcttggctgttgatgtgacactgttgtggcttcactaatgaaacctccaagtatttcctctgttttgctcctatggcaacttcacagccttccttagttataccacagcatctcctatagctgggattacaagcgtgtgccaccatgcatggctaattttctatttttagtaaagacagggtttcaccatgttggtcaagctggtcttgaactcctgacctcaggtgatccacctgacttggcctctcaaagtgctgggattacaggcgtgagccactacgcccagccctgtgattttttactggtctctcttctccctagtctttcttgtctttttccatcctcttttctctgctccctcttcaattctgtttcctctttcttctctcccttaataaatatattgagcattccaaacatattttaaaagactgagattgttgaattgttttatagtcttgtccttaaaatataaattagtgagtttattatttattctctctatttctcccaagcaaaagaaaatctcccacaatggcaaataaattaatataaggtattttaaaaatattttgtgtggttacataaatcattaacattgataaaagttatataaatcagggccgggtgcagtggctcacgcctgtaatcccagcactttgggaggctgaggcaggtggatcacctgaggtcaggagtttgagaccagcctggccagcatggtgaaaccctgtctctactaaaaatataaaagttagtcgggtgtggcggcatgcacctgtaatcccagctactcaggaggctgaggcaggagaatcgcctgtacccaggaggtggaggttgaagtgagctgagattgtgccactgcactccagccagggtgacaagagcgagactccatctcaaaaaacaaaacaaaaaagttatataaatcaattaacattaatttcatttgtttttgttaggggaagagagattgtttaattggctttaggaaaaaagtcttctttctttgctgtaacagaaaggaacagtgtaaatgtataaattatagttagacaagattatttttaccatcttgaaaagataattccgaggtatttttattttgtgagtaagctaagagagagagagaaataatagaaaatgatatgaatggaagtcagaggtcattaggaaaagtaaatatgttgattttctgcttggatccaaatgataaacactggctacctacttttctattgtcttgtagaaacaatatcttattgcctccccaaacaacaatttttgcatatcacaatgtctaagattaataggaacctatgtattttaaaaataatttgtgttatctctgtaaaatcttttatttttaaattttcaaaagtgtttattcaatcgtgttttgaagaccagtccttgtgaaactgctcctgtttgcagaacccttccattttgactattttactcttctctttttaagccatggctatcccattggttgataaatacatactgtatttacttttttattatacaagtattacatatttattgtgtaatatttagaaaacacaagtatataaagggggtaagatttaaaattacccaacatttcatcatcctttgcatctggtcttttttctatcaatatgcacttcctcttctatttaaaatgcatacagggccaggtatagtggctcacacctgtaatcccagcactttgggaggctgaggcaggcaggtggcttgagctcaggagtttgagaccagcctgagcaacatggcgaaacactgcctctacaaaaaaaaaaaaaaaaaaaaattagctgcatgtggtggcacatgcctgtgatcccaactacttggaaggctgaggtgggaggattgctggagcccaggaggttgaggttacagtgagatgagatcatgccactgcactccagcctgggctacagagcaagaccccatctcaaaacaaacaaacaacaaacaaataagaaaaatagcagacagaccacatcatgcataatgttttgcaatctgttctctcaagtcataaaacatttatcttttgtatactaactcattgtaaattgatggatttcccagctctgactatgcagctttgaatgaaaatttttccagaagttaatttcagattcagggatgcttgtgtgttgtctgcggtgtgatacagttatgtttctatttcattccagtgttcttgggtgttaccaatctccaagccaaacatgttgaaatgaccagcttgtgtgcccactggcaggtacatcgccatgccacagcctatagggttgttatagaatccctccagggtgagtacaatccatcacttacgtttttgtcaagcatttgtgtatttgattctttgcacaccactgtgtacaacacacaagtagcattagacaacagccctcttgtcaaggaagcaatttgtattggtcagtcatgctgcatatggggtctgactggttgggtaagtgaattactaaccctctggaaacctccctttttcttatctggtaatgagtatagccatagtgctgattttttagagttctgtgaagataaagctgagatattccacataaagcacttgcagtagtgctttgtgcactggaaggaccccaaaaatgttagcagccagatagccaagactagcatacattaaaattatattgtactctaatttgggtattcactctctagggatcaagtttaaatttaatgtttttcttagtgtttttttttttcttttggggataattggtgaacaacaaccctcattccagagatttaatgtatctacagcatcatgaacaagttcttcagcattacagttctcatgtacatccacaatttgggacttgttccaaggctgaaacagtaaaaatgtctcactgtcttcattaaaaatatcgagaacaacaacaaatggctgattccccaaaaatcagtatctagagccggttaatcctcttttcccaacatcagcatggacactatgcagaagatgaaatcaaataataaaaattacttaatcagatttatagaaacaatagaaaagctatatcttattattttatgggattataggagatgctaaagaatcccaaatgattttttaaaatcttccaaacttgggagtaaaattgttaaaaatgtagcctgttctttctgggcaaatgatcttggtttccccatttcagaaaagcaaaatgacctaattatttctagtccagataagactgggtttagtagcccatattcctgactatagctatattcaaaatccataaatcccatttttgatccaatccataaagtggaaagcatagtttaggagagcactgagagcatttggaaatatgtcccttgtagaataagaactgagatacgtggaacatacgagaagaaattcctgccaatcccagccaagatatcatcatgatagacatgtggcaccactgcttccttgagtccctctctatgatgtaaggatccttccagcctgacattggcttgacatttgggagtggtattaacctggaacaaacattgagggatagaaagtgaggataagtcacatggattttatggttatgttaaatatgatttatgggatgccaaaagtagataaagcacaggcaacaatttgagaaacaactatgaaatcttgagttatgtttcctatatttctttaagtcacgctttaatatggaagggttggcatttaatggtatttgctaagcctaagaaaaaattctaagtgtaataatcaccctcccaaactatcccacagttcttttatatgatttatccttttatatgatttaggaaattgaaatgaaggaacgtgggttcctgtggatattcgttgcctttcataaaaatttatcactatatatgttgacacaacgatgtataaaaactggctttatcaatggaatcaataagattcatagttttttaaattaaatgcttttagtttagcatatttgcaaagcagccttgagagttttatcagaggatatgattgatttgtctgataatactgaactggtcatctaaaaccacaataagctctttctgaagccaagatctttgctggcaagtaaatgagtccacagttgctttttatcttcaagttaagtgaacttatactccctcagtattattttcaggctgccagaaactttttcagctgaacctttatagtcttaattgaacaagaacgaacaaaagtgttgttcaatgtacttctcatcaacatttgttgctgagagattagatttgtgaacaaaattagccacatttcattcacacagttgtcttactgaatattatttatcaactggacagcaaaagattctaattgacaactggaaaaggaatgtttgatggaggagtgagtgtgggggtggcagtaggaaatgtgtttggatagtttaactcatacaaattagatcaaggaatagtcttcctactttggaatggagaagaattaggttgagtttcattatcttataggggaatgtgttcaccattctgattcactgactttaaaggacttgtggtaagatgcccattcttccacaggcagatgagtctcagaccctcaggtgttttgactgtaatattggctacatatgcggtctctgcagaaatttcagtctttccactccaggcaaaggagatactaggaataaatgagacccaatttccccatgtgttggaatgaagctttatcccagttgacctctttctgaatgcctccgtcaaatccttacagtttgatgggtaattttttccagtttttttcccatatattttttcatagcttaagcatgtgcacttttattctgagattaagtcagtaatgaagtctctactgtaaccacaaccgctggtcaactttcttctctgggcttcagcttctgtgaaattatttcatctaagtctattaactgaggcaataactgcaattttgcaaggtttttgtgagtagaatagccacgttgtatcattcaggcttgtttattaatattcacagaaatctagataaacttaagccgaagggtcaatttattggctagtatactgagaagtccaaaagtctctggcttcaggcacatctggacctaggtgttcaatttcctagagataaagtcttgctccttcttgtgttctgctcttctatgccttcattttcaaccaggctcagtgagtcagatccagaattacattctcccagcttccagctttaacagtcttggtgaaaagagagcttctctttctcaatagttccaacagaagtccaggaactgagtcatattggcctggtttgggtcacatgcctctaaatctgtcattgagtgcaagggcatgaaataaactgactgtttggacctggttgccttccacccctgtatctggtggtggtggctggaggtgggggtgttattcaatcctccccaaaccataaagaccaagactgaggaggaatggatgcaaagaaagagatttcagatacaagacaggcaaaagcaacagatgtcctttacccatgtaaatattatgacatttttatggccaagaaaaaaaaaagattaccagaaggacaaagtcttctcaggaaagactgaaataaaatctgcttttgactcagtcatccatttgccaaattaaatgataggtttttggttaattctaggacagcccaaagtgagagatttttggttggccttgggtaattcagagccctgtgaggtcctccattagttctgcagatgctatgggattttatccctctctccagctgtttttgagttgccttggcacctaaggttgacttcaaattcatgcatttattaatatatgccacataggcccaaacactttattcccaccctaatccccacaacttgatgaacttctttgtaacctgcttagataaaggtttagaggatgctccacttgtccctatttaggtgctgagatgtcagctttgcagtattatttattgacaaggatagagaactgcagcatagtggagagcctaccttaccaaagaccaggtccacagaaagcatcatatggaacaaaacctatgatcagaattaaactttctgaagcagtgacattatggggagtataattatttatatcataaaattctaccagagtagttacctggatgctggatattctttgcttgtggaactcaataactacttgtaggacattttgataagtcaagctggtggcgttataattataattatacgtttataatctggagaatggatttagtgttgcttcctaagaatgagtgcacaaataaagacagattttttccctgtgtttcaaaaaaataaattaacttcctccttttggcatgagaggttgaggaaattagtcaccatttggtcagtttgaatgttttccttaaggcaaagccaataggcctgaattgcacatgccaaaagcaacatggatacacccccattcatggaacccctctttgttagtattgggaaccaaattgatactgtttgccattaatcttatagtgcttgttccagttttccaatgtttatagatttattattttagcagtaagatctacttatattctgttttcaagggtctttaaagtccatgggtttctacatgaaataggaaatgtgacagaaaagtgcatttctagaattgactcctggagagtccccggaaggtttgtggaggtagatcagtatgatccacgcataaaattcaggaaatgtttgtattacaggtggctcacagaagcttttaggaggctctaagggatagctaagggtcaaaaagaaacagttattgtgggattcagagcctggaaaccatagactaaacttggacctaagcaaagcgaaacactgagttgactaaattttacttactatcaaacccatttcacataatatataatctcacaaacactttaacaatttttaaatgttatcatttttcataatataggaacaagaaatgattaaagttgacactatttactttgaacaaatacattaataaaaattctgttataaagttcccttctgaaactaatattcacaatatataaaaatgaatttaaaattctatttaacaaatagctttaattcatttatatttttaaaagtctatatttgtccatagacaaaatttaaaataacatatatcatgtttattctgatatatgcatattataatatacatatctttgcttcaatatatgcatatcaaaatatggatggcaatttaactaggtttgatgcttataaaatagacaaaaattgtgtaaaatttttgcattttacagttgaaaaagcaactggtatgcttttatatattgtagattctgtttattcttcataaactcctctgcaaataacattttgaaggagcggatagttctttttaaccactaaatgatatgtgtaatatatttaatcaatgcagtttttaaacactagtttttcagcccctagaaataaagcgttatgaggctttgattaaacaaatgcaatttatggataagatgatcaatctagagggaaatttgaataattgttttttcatggtagcagtgattcctcctcttaatcagttgtccattgtggtaaaaacaacaacaatgctctgtgcctacgaggaaaacacttgaaactcttcaataatgaaagccacccaagtaggctctgtggagtgataaagcatcatctaatctctagccatcatgtttgtacattttatatgcactcaacagctctcagatggtttcattttggaaaactatatatttcatttacatttgcttagaatatatcagtggaaattaaagcaacgtcctctgaaactgagctttagagttctgaatgcagggggatgagcagaagtgggtcaaggggtagaataatacagttaggtagaaggagtaagttttagtgtttgatagtacactagggaaataatagttaacaacaactgtatatttcaaaatagctggaaaaaaagaattgtaatattcccaacacaaagaaaagataaatgtttgaagtgatggatattccaattacctgatttgatcattgtacattgtatagaggtatgaaaatatcacacaaacccccaaaatatgtacaactattatctaccagtttaaacaatctcagttctgctaattagaataaggacttgaagaagttattaacttttctgacctttagtttcttctctttaaattgggaataattataaatgttataagaatcaaatgagataatacatatgaattccttagaatattgcctggcacatgataagcactcattaaatgttggctattattatctttattgctgttgttataattaaatagcaagcacagaacctggatataataaaccctcaagaaatgatgaatataattaatccagattcctcagtctcaggacctaagggccagcactagttcttccaggagatgtacagcaatttttctatggatgtgggaacaaagaaacgagccaatagttagtcaggtctccagagttctttgtgcctctgtcatggtggagaaaaagacagagaaggtgccatatgaattggctgtgtatgacatgtctccttggtagataaaaaaagaaccagaaattgagactgaactctacagcatatatggccctatgctatgtaagcaccatgtcccttttcctcaattaaaggattttcagagtggatgcagggcatttggagaggcccctctgaactccctgggaatgtcttttgcaattgaaggaaaccactggtatcagttaaaagtcaaggctgagagggagatactgggcagggtgaggactccttggtggtcccagtgctgctgcaagctcttgcctgctgttgtggcagctttgaagacaacctggacccatggaccagggcttctgagacccatacctgtatctttagaccactgcctagaagggtggtctgttgggtggtaataagttatatgaggccaaaaggaagtatctgtttatgttatataacattgggctgtgttcagaaaatcatatcgaataaaagggagttcagatttaaaaaaaataggccaggcatggtatctcgtgcctgtaatcccagcactttcagaggctgaggcgggtggatcatctaaggtcaggaattcgagaccagcctggccaacatggtgaaactgcatctctattaaaaatacacaaattagctgggcatggtggtgcacgcctgtagttccagctactcaggaggctgaggcaggcgcattgcttgaacccgggagtagaggttgcaatgagctgagatcgcaccattgcactccagcctggatgacagagtgggactccatctcagaaaaaaaacaaaaacaaaaacaaaaaaaccccacaaagattaaaaaactaaataaatgccctcacatctgcatctgtccaaaagatcagttaggatgtgtgcatataattacatgcattaatagttctccattaagtaaagagttgatttcagaagtcttttaatagtaaacttcatttttggacatataaaatgtgattttccatagaaaaataccagtgaatatattaactctttggaagaagatacaatacttcaaacaaatataactcattctggagttatctgatgtgggctaacatgtgaagtattttagaagcaaatcatctgccaatggctgtgtttcaaaaatttcatatgtgtgtgtttttgttttgttttgtttttattatagataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacacgtaagtcatgtgtgttctctcctgatccctctccccatgaacaaacagaatttcaggcatcctgtttccttatcccatttagaaaaatattagctattgctgttcaggaatatacgtaatacaagttttgttcctcttactcaaccccagaattcattgcatatggcccactgatgtcatcaatatgggttttttatttccattctccatatatgtttcacaagagactagaaggccacacgatagtaaagcagttgagacaatgacttacattgtgatccagatccataaggaacatttgtggcatgtggagtgtgaaatgcagtttgaggacgacttggctctgacattaaaacaatggcatattaccacagccatgaggatgggaagggagccaagatgttccaactggatgaccctagagttactgcttgcctaagaagctcttgcactttttccaagctgactgcagatgtgatgcactaaagggaaaggcaaagtataaaattaaaacaaagctctttttacatgttccaaagagcaaggagagtgtcaacttcttgaaatggcttctagtcaaagattcttgaccccggctccacaaacattaaaatggtttgaaatgcagtgaattctgggggacatttgtgtgcttaactcagtatgttgaatttaaacttgaaattccgggaggatttgtgtctgaataggtgttgggcaatgggctttcttggtgacccgtctatcatgtacatggcatttagaagggattactatctgtgtatagctcttccagcctctctggcacttgcagagggaaatcatgcacatgtaaccttcaaaaagagaggataaaagtataataaattaaatcatcttcttttacgtaatacaaagactttatttcacaacacttaaatatgcagtatttcatattccacatgtatttttgaggtataatttatataacataaaatttaagtaccattttaagtgtgcagttcaataatttttagtacatgtaatgagttgtatcagcatccctacaatccaatttcaggacgtttccatcaacccaaagaacatttcctgctatttgaagtcgatctcctttcccaccctgagcctcagacaatctactttcttttattatacatttgccttttctggacatttcacataagtggaaatatatcatatgtagtcttttacatctggcatctttcacttagcatatgtttttgtggtttatccatgttgtagattgtgtcagtagtttgtttctttttattgctgattagaattccatcttatggattgtaaatcatatagttttgaagttaataggaacctgatagtacacaagacttagagtcaaatggtttgtttgaagatcttgttctgcccctttctagcattatggctttaggcgattcagcatctctgagcttttcactcatcaataaaattaaatacctactctcttgcctcaagtggtggcagtaaacaaccaataaaagaatactcattgaagagcttttcaacccatatgtcatctagcaagtactttttgtcattaccattattattttcttaaaggtcataaactaaaggctagatctcactatcaggcatgttttctccagccatacttttttaagttttaaagtagtttttgaaaagtcagaatatcttgcagcactaagtatctatcttcatggtgccaatctgctggaaccaactaaatgctgtctgtttagacagtgcatgtgcgcttaagttggctaccacaccttaatgttcacgctaagttctttgcgcttattcgttgctcacctgacccctagaaacatttgtgtttaggacccctgatctactttagcttctcctatccttgaccccgcactggttaactgctaacctagggttaaatccaatttggatagctctgtttgatgtaaatgttttccttatgttggaggcatctgtcttcttgtagcttccacccattggttctggttcaaccttctgaagcaatgcaggtaaagactattccctctttatatgacagcccctcacatccttgaagacagggacaatctgtatgccacatatagaatataaacatgtgtccccagttcactgtggttcttcttacccaagagattctttagccagatgttctgcccaatcgtattaatctggctgccatactctcttactgatttcattcttgatttattgaccagacttaggagatgccttgattttccatgttaaagaagatgcacaattattaagatgactgactacttccacaaattttaaaatttaaaaaatggctttagaaacattttgtggggttttaaagaaagttttgcaatcctagttacaaaaaaaatttctcattttttaaatttggagagtttttagcttcaaaaattgcctttaaaaataacagtgatatatatccataatagtaaaacagaaatgtataaagtgcattgtcaacctccctctttccttgttcttccttttcagaaatatttccttttcacacacacatatatatacatatttatgaaaaataaaaagcacatatatataaaataaaaaaggtatatatatgtgtgtgtgtgtgtgtatgtgtgcgtaagttttatttttcacaaatgagattatgccatggtattctgtgacttgtttatttcacaaaataatcatcttgaatatttttccatttagtaatatatagttacctcattcttttaatgttgaatccttttatttaaattattttattttattgaaccttaaagttggaagagaccttacagctcacctcttagccttcctgacaatgaagaaactaaactcccctttataaaattcttggcaaatagtcagtctgcctgagctcaaatccttctagctatttggtgcttagtatcgcctgaggctagacatcccctctgtgaatggctatgtttagtggagggttttcctgagtattaaactgggatagcgagaagaattttcttagtttttcttaaatctttagtgtcaaataagaattagaaatgaatacgtaataacatcgtattttatgtttacctaatgacatcaaaacttcctgatgctttgccacatgagctggaatgagaattgataatcactactctgatctaactgtccccagatcctttaaccaagccatacctctgcagagtatgtggacttctcatcccacataatccaggctgaaaagacccaaacacactttagcctgccaatgtttacatttggtcctcaaaaccaaaagacatttccagatgcagtctgagcagagcagaatgaatcagagtccactggtgaccagtatcctgggggatgcaggatggaaagggaaaagtgctattgagcaaggattgatggtgaatccttaggcagaatggaaatgaagtttattgtgtgtgtgaaagcaacaggagacgaactttcaaatgggttggcaggattcctgccttaaatcaacattagaaccactttgtagttgacagtttgatttcattgactcctgctgggtaaactgaatggtggcaaaatggcatttcaagccttcagtctgaggatgagacgatggatggagtcagttttcacaggctgcggctgatttatagtactcattaaattctcagagaagacagttgtcaaaatcattgactaccctgaatatttattactccatgaccttccgctcttccccacagatgagatggtgaactgatgtcctttctccctttcctttacagaatcacttcctacacgaccaccaacttttcctccaaccattccaccagcaaaagaaggtaaaagaataatagaataattatctgattctaggtttaggatttgtgttggttttgtttgcctgttcatttcaaaccaggatattaataaagtatatttattgtgctacctaattttctccttaatacaaatgcttatcaaccatgatgggcttgaatgatatccatttaatatcaattctgcacacaaagagtggatttactaacagaattgcttaatactattttttttgaaatatcagagcagttaacattcattaaggaagcatagttacataatttgtaagtgaaaatccagtttgtagttcctcagatacagtaatagtttcccagcctacctctgaagtgtctctttcagtcgttttttctttcctcatcacaacagttcctcatcaccttttacctaagccattaaggtaactttaaaaaggccctcaacaaagtagtgatcattatttttttatttcaataatgaacatttattaatcctgctatttattctcaaggctcttatagtaggcatgggaaatacaataataatacatgattgctgctctctgcttatttttagtattaaagagaaataggtgcttgcctagataaataccagtcaagtttatgagttataaaatagcagttgtattatgtaccacccagaagtggtaatggttaatactgctgcagattaatgactcataaggaagaggcatttgatctacattttgaagaatgagtttgagagacaggtattgggatgaatagcactcggtgtcaagagtgatccaactgcttaatggatttagtgaaccataaatgctttagtgtggcaagaaagagaaaagaatgacagtagagttatggagtggttaatgtgacaaaattaggaatttgggctttatcctgtgggaaatggcatgttgtgagaatttgtaagaaggaagggcgatctgatgaaatctatgtttaagaatgataactttggtgaaatagggaggatggactagaagaatgagaggagaaagtagaacacattagaaggttgtattggaagagctcttccattcacaatgcatcttaaagtgcctgttacataccagggaaacaataaaaaataagttgttgagagcttaaagccagtagattcaaatgctgcagagagtagaagacacaaataaacagaggcaattaagaactctaataaagctcaacattcatcctaggatggcatgcagagtcttcacaaatcaatctactttgcagtattatttcccagaatacattatataatagcaaaattgtacaactcagggctccccatacatgtcttatgctgtatctttgaaagctattcactctacctggaatgccaaattctttcttcttccagcttcatatctagccttctttagtctcaacatctgtggttattctcactattggaactagaaacagaatcctaattgataaatttactaattaggcacttctgatgcagatattacagaatgctctgtaatatctgcatcagatcagagtatttttatttatagctgagtatggatattattccgtaaacattcatgaatgcttatagaagacttatgtgatctggaagggtctgtggggttaaggattgacaaagtagaaacattggttctgagattttcatcatgatggtttagatggtgcttttgcaacttgaatgcactgtgtattttaggctttgtttgtcctgggtatatttaatttaaaagccaataaatttgtattattaaagtaatactaaatatttattaaacgaacattaaaacgtagaaaaaacttaaaagaacagcattaaaaacacagctttctaccccagaggtaactccttcatgcatgtggatatattttctttctttgatttactaactattcattttgagtgtattttttaatagaatttgctctcattttgaaagtgaaacctaattttcatttttatctttccatggaaacagagaacctgtttataaactcataattagcagatcttgttattcctttcagctttaagttcaaaccacaaatttgtaaaattttataaatcgcagaactcaaccttatcagatccttactgcccctaaagtattagctcacttggagatggtttattttatattataaatagctttaagggaatgaagttgtacttcataaaataaaaactaagtgaggtttttcttaaagaaaggagaaaggcacattatctcatagaatatttatgtgcaattggcctaagattaaaagattcagactattgaagagcaaattgtttgcttcatcataaaacagattcaactgcaatgatcagccctaatgaagaggaggagaggcatagataatctgaaatagcacatgataccaaaaaagaacttttaaaaaatgttctcagtagagtaggtttttattggtgtagtttgctttgtttaattctttttgcttgtttgattgctttgttgatatctgtaatacctactgataatactttcccttggctagcattagtgtacatttcttgacatatatcagtgggctatagaaggacagagacaaaaatttgttttaaccaagattagaatttgtttgcttagggcctcagcccaagtgaatatcaaattataattagattaatctggttccattttatcacatgcttttctgctgaaattgaatctctctgacattaacttactaattcaataagaaaaggacagggtgcacagagtgatagtatgtccttttttccaatcagttggcactagacagtgtttgctgatacttcgatctctgaatccctgtagtcccatcttttcctagtccttcattttcattcttttgggctgtggttggtggacagttttttctttctctatttccacacggataatagaagcttcttagtcatgaataagaaccttgagtataaaagagtaattacagcaaagaagcatagtgagcaggagtttggaatatgaacattaagaagtttatatctttcctttgaaaaagagcttcacttagcagagggcaaccattatttgtcttattggtttaataactactaacttttccccttatctctgactcaaaattcattgttggtcttcagtatgtaaggcggccaaggctgacctggtatttatggtggatggatcctggagcattggagatgaaaatttcaataagatcatcagctttctatacagcactgttggagccctgaacaagattggcacagatggaacccaagtaaggctaataaataattaattcattctatgtatttagaaattatttctccagctcttattacagctacttgtcagggactataggtcaagaactgtaatgattgggttcaaccttaaatgaaaggatagacaggtatgtgtttggaagcagcttgttgatgcctggcaaagctccagaggatgcttatccttaaaaggtgttgagttcggcaaactaaaacaaggtagaaagtccatgtcagggtgttatttttacatactagggtagaatgtctcctttaatgatacatacaatattttccctgcccttaagcactttaaaatcttgaaaggaaaaggttaaggtcacaccttactatagatcatgtggaacatgaaactaactcattcatttaaaaaatatgtatcaaggatttattatggccatgtactatactgtcataatgaatgtcaatcaatgtctctaattttgtggggctcatattcttaaaagtaaggacagaagacataccagtcagaatggctattattaaaaaggcaaaaaataacagatgctggcaagattgtggagaaaagggaacacttacacatcgttggcagaaacgtaaattaattcagccattagataaagcactttgacagtttctcaaagaacttaaaacagaattcccaaacccagaaatcccactgttggatatatacccaaaggaatataaatcattctactgtaaagacacatgcatgcacatgtatgttcattgtggcagtattcacaatagcagacatgatattaacctaaatgcccatcaatagtagactggataaagaaaatgtggtacatatacatcatggaatattatgcaacaataaaaaagaatgagctcatgtcctttgcagcaacatggatgaagctagaggccattatcctaagcaaactaatgcataaacagaaaaccaaatactgcatgttcccacttataagtgggagctaaacatcgagtacatgtagacacaaagaagggaagagcaaacaccagggcctacttgtgggtggagggtaggaggatagtgaggatcgaaaaattacctgtcaggtaacatgctgaatatctggatgataaaataatctgtgcatcatatcccatgacttgcaatttatctctctaacaaacctgcacatgttcccctaaacctaaaagaaaagttaaaaaaaaaaacaagagaaaagggacagagacagatataaacaggcaagcaaatagattcacaaggtagggatgtaagctatgaaaacagagtgatgtgatttaaagatgtcaggggattactctaaattgtgtgtgacagttattttaaattgtatggtaagcaaagacctctttgaggaggtgccttttgaactgagatgtgaatgatgcagacttaaagatctgagaatagaatttccagacagagaaaatgataagtacagaggacccaaggtgagaatgagttttgaaacttcatacaccaaaacttgtggctagaatatagtaggtgagagtgtgaggatagaacaagtggaagaagcaggcaaaagccagatcatcttgagtcttgtggaccatcaaaggagttgagtattatcataaatgcaactggaagtcactggaaggttttaaggagagccaagatctgatatgtttcagaaaaaaagattaccccaactgctttgtggcatgtgaattactaataagaataagagtgcaagcagatagaccagtcaggaagatgctctcatggtccagcagagtgatcatggtggcctggactagggtggtagcaatgaggtacactgaaacaaatggatttggaatatattgtgaaagaatggctaagaaaatgtgggcacaagaagtaccgtaagaggataatggatattttgcagaaaccttacaagacaggagagattagggtcctatttttagcctccttaaacaaaataactgtcagccaagaattctgaatccagcaaaactaagttttataaatggaggaaaaataaagtcattttcaggcaaacaaatggtgagagaatttgtcactaccagaccagccctataagaaatgttaaaagaagttctaaatttggaaacaaaaggttgatatacatcagaatataacctcttgaaagcataaaactcatagggcctataaaacaataacacaatgaagaaaacaaagtacttaggtaacaacatggtgactggaactgtacctcacatctcaatattaacgttgaatgtaaatagcctaagtgctccacttaaaagatgcagattagaagaatggatacaaaatcacaaaccaaatatctgctatctttaagagactcacctaacatgtaaggatttgtataaactcaaagtaaaggggtaaaagaagatattccatgcaaatggaaacccaaagcaagcaggagtagcaattcttatgtcagataaaacagactttaaagcaacaatagtagaaaaaaaagacaaagaaagtcattatataatgataaaaggattgatccaacaagaagatattacaatcctacatttatatggacttaactctggagctcccagattcagaaaacaattactgctagacctaagaagtaagacaacaacacaataatagtggggaactttaacactccactagcagcactagacagataatcaagacagagaatcaacaaagaagcaatggtctcaaactacactctagaacaaatggacctaacatgtatttacagaagattctatacaagaagtgcagaatatacattcttcacatcagcatatggaacattttccaagctagaccatgataggccacaaaacaagtctcaataaatttttaaaaatcaaagtcatatcaggcatcttctcagaccacaatggaataaaactagaaatcaactccaaaaggaatcctcaaaagtatacaaatacttggaaattaaaccatttgctcctgaatgatttttgggttaataataaaatcaagaaggaaatttaaaaattatttggaatgaaagataatacttacacaagttgtcaaaacctctgacatacagtaaaagcagttctaagaggaaaatatatagcactcaatgcctacatcaaaaagtctgaaaaagcacaaattggcaacctaatgtcacacctcaaggaactagtgaaacaagaacaaaccaaagccaaagctagcagaagaaaagaaataacaaaaatcagagcagaactaaatgaaattgaaacaaaaagcaataaaaaagatcaatgaaacaaaaaattggttctttgaaaagataaacaaaattgatagaccattagctggtttaaccaagaaaaaagagagaaggttcaaatagtctcaattagaaatgaaaatagagacattacaaccaacaccacagaaatgcaaaagattattcaagactattatgaacacctctatacatagaaactacaaaatctgaaggaaatggataaattcctggaaacaacaacccccctagattaaatcaagaataagccctgagcagaccaacaacaggcagtgagattgcatcagtgattttaaaacagttttccaaaaaaaaaaaaaggcccagggccagatggattcacagatgaatactaccagacattcaaagaagaattggtaccaattgtatggaaactattaggttggtgcaaaccacaactacttttgcaccaacctaatattctaaaagattagaaggggaattctcactaaatctttttgtgaagccagtattacctgatacaaaaaccagtagaggacataatgaaaaagaaaattacatgccaacatcccttgtgaacatagacgcaaaaataatcaacaaaatactagctaaacaaatccaacaacacatcaagaagataatacgctgtgatcaggtggatgtcatcccagggacacagagagggcttaacatacacaagtcaataaatgtgatacatcacataaacagaattaataacaaaaaccatatgttcatctcatagatgcagaaagcattcaataaaatccagcatccctttatgataaatactttcaacaaattgggaatagaaaggacatacctcaaaataataaatgctatatatagcaacctcacagccaaaatcatactgaatggaaaaaagttgatagcattccttctgagaactggaacaagacaaagatactcattttcaccgcttctattcaagatagtactggaagtcctagccagagcaatcaggcaagagaaaataataaagggcatccaaactggaaaagaagaagttaaactattactgtgtgccaatgatatgatcatatacctagagaacttaaagacttctccaaaagactcctagatttgataaacaaattcagtaaactcttaggttacaaatcaatgtatacaaatcagtagcactgctatacaccaacgatcaattctgagataagagataaggcctgaggatcaaatcaagaacataatcacttttacaatagctgcaaaaaaaatagacatacctaggcatatattatacttaactaaagagatggaaattctcttcaacaagaatcacaaaacactgctaagagaaatcagagatgacacaaacaaatggaagcatcccatgctcatggattgaaataattcttatgaaaatgatcatatttcccaaagcaatctacagattcaatgcaattcctatacaaatatcaacatcgtttttcacagaattagaaaaaaaatcctgaaattcatatggaacccaaaaagagcccaaatagccaaagcactcctaaacaaaaagaaaaaaatctggaggcatcacattacctgacttcaaagtatactacaagaccatagttactaaaacagcatgatactgatataaaaataagcacataaactaatggaacagaagagagaacccagaaataaagtcaaatacatacaaccaactgatcttggacaaaacattcaaaaacataaattggggaaatgacaccctatttaataaatggcactgggaaaactggatagccacatgtagaatgaaactggatccctacctctcaccttatacaaaaatcaactcaagatggatcaaagccttaaatctaagacctgaaatgataaaaattctaggagataacctgcgaaaaactcttctggacattgacctggcaaggaatttatgactaagactccaaaagcaaattcaacaaaaacaaaaataaataaatggtacctaattaaactaaaaaccttctgaacagctaatcatcagagtaaacagaaaacacaagaatgggagaaaatatttgcaaactatgcatctgacaaagaactaatatccagaatctacaagaaacacacacaaatcagcaagaaaaaaacaaatatctcatcaaaaaatgggaaaatggcatgaataaacatttctcaaaagaagatacacaaatggcccacaaacatatggaaaaatgctcaacatcactaatcatcatggaaatgcagattaaaaccacaatgagatacctccttgcccctgtaagaatggccattattataagtcaaaaaacaatagatgtcggtgtggatgtggtgaaaaggaaatatttatacactgctggtgggcatgtaatttagtataacctctatggaaaacagtgtggagatttcttaaagaactaaaagtagatttacctttggttccagcaatcccagtactggctatctacccaaaggaaaagaagtcattatgtcaaaagacaccagtaaacatatgtttattttagcacaattcacaaatgcaaagatatagaaccaacttcagtgcctgtcatccaatgagtaaagacaatgttatatatatatgtaaaaaaatatattatatatatattttacacaaacacacaccatggaatactactcagccataaaaaagaacaaagtaatgtactttgcagcagcttgaatggaggccattattctaagtgaagtaattcaggaatggaaaatcaaataccgtatgttctcacttttaagcgagagctaagctgtagctacacaaaggaacacagggtggtataatggacttggagactcagagtggggagggtggaaggtggatgaaggataaaaaaactacatactagatagaatgtacactacttgggtgatgggtgcactaaaatctcaaaccttgccactatacaattcaaccatgtaaccaaatacccttgtactccaaaagtattgtaaataaaaataggttccccaccctgtgtccaagtgttctcattgttcaattcccacctatgagtgagaacatgcagtgtctggttttctgtccttgtgatagtttgctcagaatgctggtttccagtttcatccatgtcccttcaaaggacatgaactcatccttttttatggctgcatggtgggggtaagggggagggatagcattaggagatatacctaatgtaaatgacgagttaatgggtgcagcacaccaacatggcacatgtatacatatgtaacaaaccttcacattgtgcacaggtaccctagaacttaaagtataataataaaaaaaaataaaataaaattaggttattaaaaaagaggagaataggtaacatgctgaggcatgtcagaaagaagcaagttccctttgaattgcaggagactttataaaaatggtgacatgtccagtagactgataaactggcagcagcttaaggcccatttaaacaaagctctcgaaagatgctatctttacttattaaatcataattctgaaaaacaaataaaaaacaattaaaaatgatccaaaagttccacaggaataaaagccagttgtaagaactgaagccagaaagctttgtatagtagtggttaagaacatacattttgacctagaatagacctaacttcaactgttgactctgccagtgaccactcttgtgatgtgcaagtaacttgtcttttgcagctcagtttcctcaagtgtaaagtgagtagaatagtagtaattacttcataggtttgcttcataaggaaatctttgtaaagagtctaactctgattttcggacatttgtcaagttaccaagcttaggctgccatttttaaactgtcaaatgaggtggcaaaaatcctacaagcttgaaagatttttaaaaaactactttctgaaagtactgagagacacatgcactcctatgttcattgcagcactattcacagtaacaaacatggaatgcccatcaatggtggactgcgtaaagaaaatgtggtgaacatacagcaagaaatactacgcagccataaaaaagaacaaaatcatgttctttgcagcaacacgggtgcctctggaagccattatcttgtgcaaattaacacagaaacatgaaaccaaatactgcatgctctcacttagaagtgggagctaaacatcgagtacacacggacgtaaagacgggaacaatagacactaggggctactagtagggggagaatagaaggaggctgaaggttgaaaaactgcctattgggaactatgctcactacctgggggacagaatcatttgtacaccacctctcagtgacatgccgtttacccatgtaacaaacctacacaatgtaccctctgaatctaaaataaaatttttaaaaaagaaaagatgtatttaatttgtcttcaaatttggtatgtaacttgtatgaaagaaattttaatccaagcagattttgtaatgagataatgaagaaattaaaactacaggtgacactgtgctgttgctctctgacccagtggaagtctacatatgtgtgaaaatgaatacaccttctctctccaggttgcaatggttcagttcactgatgatcccagaacagaatttaaactaaatgcttacaaaaccaaagagactcttcttgatgcaattaaacacatttcatacaaaggaggaaatacaaaaacaggtatgaccaaaagaagcccagctaaggctcaaagtaattcattatttgtaactactgaaatgaccttttattttaaggcatagtaattttttaaagattttttttttcattaatttaagaactttgttcccaccctttcttctccagaaaaacaaaaatgggagggagtgaaatcaaactgttgcctttctttgtttcaggaaaagcaattaagtatgttcgagataccttgttcactgcagagtcaggtacaagaaggggcatcccaaaggttatcgtggttataactgatggaagatcacaagatgatgtgaacaaaatctccagggagatgcaattagatggtaagatatataaacaatagtggctaccaaatatgatgttagaattgttattttctaaatacaaatttataggctatatcagcattacttaaatgttttaaaatatttcttcatattaactagacagtgtaatttttaaaatactttctggtatacaaatctgtaattgtactgctttgttagagaaaataggttattttctctaacacttttgttacatacaggatgccctttatatggaactctagcaattaagtactgtaagaaaaggaccagggaaagaatcttattacagaaactcctcagcctcttaatcatacccaaatgtccatcgatgacagactggataaagaaaatgtggcacatataagccatggaatactatgcagccataaaaaagaatgagttcatgtcctttgcagggaaatggatgaagctggaaaccatcatcctcagcaaactaacacaggaacagaaaactaaacaccacatgttctcactcataagtgggagctgaacaatgagaacacatggacacagggaggggaacatcacacacgggggcctgtcgggggtggggggcaagggagggagagcattaagacaaatacctaatgcatgcagggcttaaaacctagatgacaggttgataggtgcagtaaaccaccatggcacacgtatacctatgtaaaaaacctgcatcttcagcacgtgtatcccagaatttaaagtaaaattgtgtaaaaaagaaaaaatattgattgaatgtatatatatatatatggaccagggaaggaaccttattacagaaattcctcagcctcttaatctgtaaaatagagattctcacaggactgctgtgaagattaaattacataagttatggcaaatagtagttctatttacttgccaagcattgaatggtggcccaccttaggttgctaggcctattaatgtctcagcttctacttctgaaaaaaaaaaaaaaaactgagataagctcagtgtctctgtttcaagtatatttcataccataaatgttaaaagtaacttttaagaatatgcaaccatagagatattactcaaatgcaaactacttcgtctcaggcacaatttggggccttggtcttcttgggtttctttaaaatggaaaatctctttaggggatgatggaatcattatcacataatgaaatatatacatgcagaactctgatgaactgtaaagaatgaattatccacccccatgggccttcctaaataaacatattttaaacagttggatgtgtcttatattacattatttgtgttttgtacaatttaaagtaatcggaaatctgttctctgtctgccacaggctatagcatttttgcaattggtgtggccgatgcagattactcggagttggttagcattggcagtaagcccagcgcacgccatgtcttctttgtggatgactttgacgcctttaagaaaatcgaagatgagttaattacttttgtctgcgaaacagcatcagcaagttagttctttggaatttgtacttactcatgttgcttaacagctgaaatatttgacactggttaaatagtgagtccgatctagatctgagaaaagaatattgacttccagtactgcttgttatatagacattaagttttgtggctttgagcatatggaaataaacctcccctcctctgtttagagtttagaatgataaaaaccttccctaatcagatgacagtctatgtttaaaagcaactgtgcttaaacagatgtagtaaataattttcaatgtattaagaatgtattaagatgtaaaatgtattaagaattctcatctgggcaacatattacaagggagatgtgccccaatacatgctctcaggtgataaccactgattttaatgaacccaggagagaaggaagctgtggtcctttagttgtaataagggaccttagcacatttcaatcttcatgaaaccacagaaaaccatagtcacatttgatttgtattctctccacaatcaacttctggaaagattgtattagtttcctgttctcaggacagggaaagagtatgtttgtgaaatatccgaattagagttttattttgtttgtttggttttccagcctgtccagtggtacacaaggatggcattgatcttgcaggtatgcattatcacaatcttttcaaacacaaaatatattacaggcctctcaattggggatggggtttctgtttttgtttttaaatccttaatagaaaaatattaaaatttaaaattctaaagtgccatattccttatgtttattctttttctactttttttttttttttaggatttaagatgatggaaatgtttggtttggttgaaaaagatttttcatcagtggaaggggtttctatggagcctggtaccttcaatgtgtttccatgttaccaactccataaagatgccctggtttcccagccaaccaggtatgtttctgttgaaagattttaaagtcatcgtatgtttattatatctcactgtgaaaatgatgtcaacttgaaatatggtgtaatagtcccaggtaggattttccacgacatttagagtagaagatatttacatttctttgtttaaaaacaccagactcacacataatgcgggttgaactttaacatctgctgatctgagacaacatataaaaatgattgctggatgctgtggctcattcctgtaatcgtaacactttgggaggccaaggtgggaggatcacttgaggccaaaagtttgagagcagcctgggcaacaaaataagagtctctacaaaaacataaaaataaaaaaattagctgggcattgtagtgtgcacctgtagtcccagctactctggagactgaggtgggaggattgcttgagctcaggaggttgaagctgcagtgtgccatgatcacgccactgcacctcaatcttggtgaaagagcaagaccccgtctttaaaaaaaaaaaaaaaaagttgatacttatatagcactactcccagccatctttctaaatgcttatgtacactaactcactcaaacctccagacacctctatgaaagtagattctattattatctaaattttacagataatgaatcagaaacacaaagaagctaaatgacttgagtgagctcacatagttaaatggcaatgttggaatttatatccagctatcaagctccagtgctcagatcctgaaccatttcatgatagtgctatatggttcaaatggcttttatctttgagacagtcacaacagcaactctagaaagttgaagagtagtaatcaggtttatataaaaattgcattacttagctactttatagacacatttgccttattcttgtttctttttttttattatactttaagttttagggtacatgtgcacattgtgcagtttagttacatatgtatacatgtgccatgctggtgcgctgcacccactaacttgtcacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaagccttattcttgtttctatctctggatccccagcaaattagatggtgtctgtccacattgaaggcagatctgccccacctagctcactcagactcgcacgctaatatcctctggagacaccctcactgatatactccaaaataatgctttaccaggtttctagatattccttaatccggtcaagttgaaacctaaaattttccatcacaggacctttgtcagtttatttgctgatgtatcttaaatgtctgttacaatgtctggcatatagttggcactcaaaaatacttattgaatggacaaatgaattaatgaatatataaataaatgaatatttatttttatctatgcaaaccaaactttcattttcaaacgcacgctaaacttgcacatttatttattcaattaataactattatggggttcctactatatgtaaagggttgtatttttttgcttggaggaagatttaaaaagtaaatgagtaaaagtaacattagttgttagaaagagagacaagatgatattttaggttgggctcttcaggaagcagattttctgggagagattagcatgtgggaagttgatgagggtgttccctcatggaagggaacagcaggacacaggacaagccaagagggagaagtcaagctgtgaagaatctcagtaaaagcctccacccacccagaagagttctgaaaatggtatggcccctcagatctgtctcccattgggttcaggggttcaggtccttatacttcctcaatgaccagtcattgaaaagaggtttcctagtaaggtggcatgaccttgggagaggcatcctttttcagccaagacaatttctgaagggggattggtgtctgaaacctgtctgcagacaacactcccaggaccaggggtaatgtacccttaattttggaaggtggatctggatggtgcaacacagatgggaatgcaattgactacaatatgtagtagaaagtgataatgtcataagttatgttttacaaaaggataatagatcaacatagtttattacatgaaaacctttgacactactaaaatgttcagtgagaagtgactgattaggtaagtgataaaatagccaaacaagagaagactgtacagccatgaaatatcatgctcttaaaaatatttaaggaaatggaaaatgactattaaatggtgctaagaaagggacaaaatgatataaattggacaaatgcacacattctttactaaattagatcaacagtgatctagttggtgttaatggtggtcttttctgtttttccaaatcttgtgtaatgaaaatgtatttgctttataatcaaaggagtaacttttttgaggaaggatacaatgaaacatggttttctttctatgttcaggtacttgcacccagaaggattgccctccgactacacaatcagttttctattccggattcttcctgacactccacaggagccatttgctctttgggagattttaaataaaaattctgacccattggttggggttattttagacagtaagtatatttattgagatcacattcacatatacatgtatgagtaatgtatgtggcatgccattttgcctgtttgtgtatattacagagtaactcactaatcttatgtgatgtgtaaatactaaacaatgaattatatagcagttggtttatccatttattctcttattctttcaacaaatatttcttgagttcctattttgtgccaacactaagcctgggatgcagtagtgaggaaggagaagagagaaaaacaatttttactgggagagggaaaactacagacagagcaaggcccttggagggtcaatgggaggggtgggaccacagttcattttttggacatagacataataaaagtaagatgcatatttgatatcccagaatggatgtcagattgacagcagcatatttagaaagaattctgggatggagatgtacatttgaaagttgtgtgtctttgctatacaagccatgagactgggtgggatcaactagaaaatgagtctagaaagagcagagaataagtctggaggctgggaaatgccaatgtttggaggttggaaacgtgaggaagaaccaatgaaggaagcttcttaaccttgtgctcttggatgttgtaccatcaacctcaagctcttggatgttgtacatgatgatcacttaagcagatcaactttttggttaatatcactgaattttctatatctagttttagtttaggattccaatgaacctaggaaccaaaatttggaggctattactaggtgctaagtcacacattcggataaggaaagtattaagcttatttccgactagtatttgtaaaaggatttttcagtacatggaaactaatcaacaactaaatatgatattgtggaagcattttgcattgatattaaaactaaggaaaagctgtagattgaaagggtatatgttactaacttcatatatacctgggacttgaaaatgaagaattttcttaaaatgattaagactagcttgctccttttgaaaacagaggtattaatttgtagcataggaatgaattagaaagaaaaaagattagataaatgaataatatgaattattctctcacaaggttagtaatgctttgtatgcatatattctttattctatttgctattgaacaaaggcatttaaaaaaaaattccatagggctttggatctcaaatttcagctggagtgagaatcttttctctttctaattcatagtatcttttaaataataaaatattccttgtaataggaataatttaagattagaaaaatttttgcttgtttgttcataatgaatgaaatatcttgggtggtgtaatttgcacatcctaggaaagttggttgctgcagtgggttaaaaagacaaagggccggccaggcacggtggctcacgcctgtaatcccagcactttgggatgctgaggtgggcagatcatgaggtcaggagatcgagaccatcctgaacatgaggtcaggagatcgagaccaagccgtctctactaaaaatacaaaaaattagctgggcgtggtggcgggtgcctgtagtcccagctacttgggaggctgaggcaggagaaaggtgtgaacccaggaggtggagcttgcagtgagccaagatcatgccactgcactccagcctgggtgacagagcgagactccatctcaaaaaaaaaaaaaaaaaaaaaaaagagacaaagggcctggtttctattctttaagatttgataaacttaaagcagctgtgtctgcctctacttccagctttggacagtttctcccaggagagtgatgggaatgagagtctgggcaaggaagtacagaggtaagagtatgtgtaggagtctttgcctcactgtcatcaccaagtggcttaatcagttcatgtaaccaactaaaagtctgcggcaacctggggactgtagaacacttccttactcatcacatcattctaaatacagtttcaaaacaatcgatgcattgttttgttttgagttgaattttagaaaacaaaattcacctactttaattatttctaaaatatttttatttttctttcaatagatggtgggaaaactctaacatatttcaactatgaccagagtggggattttcaaactgttactttcgaaggacctgaaattaggaaaattttttatggaagctttcacaaggttagtaatgctttgtatgcatatattctttattctatttgctattgaacaaagccatttaaaaacaattccatagggctttggatctcaaatttcagctggagtgagaatttcctttgtgcttgttaacaatacctgtgcttgttaacagattctgatttggtagttctgagagaggaccctgaaatgtgcatttttttttttggcaggcactcccgaaaataagggggcactttcctctttgaggaaaaatgtagttaaggatatggcattaccaagtggacagttgctcatttgctacattaggtgcgatgtagaaaagattgctggtctagctggtacaactagctatctatgagtgcagaagaaagcacaatcagctgaatcatcttaaaatgtgcagatagggataactgattgcaccaatacttttacatatatacaagtgcaatccatcactgtcatcataacagttaccctgcggaaaaattttataaaacctaagtttacttgtcattatttaatttaatttatttatttattaatttatttattttgagatggagtcttgctctgttgcccaggctggagtgcagtggcgcgatcttggctcactacaagctctgcctcccgggttcacgccattctcctgcctcagcctcccgaggagctgggattacaggcatctgccaccatgcttggctaattttttgtatttttagtggagccaggatttcaccatattagccaggatggtctcgatctcctgacctcgtgatccacctgccttggcatcccaaagtgctgggattacaggcgtgagccaccgcgcctggccacttgtcattattttaataactcagcacttgtggtataactatgttccttaacatttgcttctcagaaacacttacctgtggtgatcattggggtggacatctaccaacatctactgcttcctttgtatttgaataatcccactgatctgtagtgttaagcagtgcagcacctacgctgcaggatgagcagaacatttactaggtggtgtagaaaaatgctttgcttcctaaccaggcccttactgcccttttaaagtgagagaagggatgctgcatagcaattttcttggctcctgtctcatggcccagaatgcggtcaaatcaatctaatttatgcaactttgctactttctgtggttttgaatatcgtaattgcataccacataattgcataagaacagttgctaaaaaaaaaaaaacaacttgctttttttcctgtttaataggactgtactaccagaagaaaaggtatctgaaaagcacatgagatacagtggagatttattagttcatggctcaaagtggtcccattagcagctcttaggacttaacattgtttactcaccaaattcctcttggcatgtttattttcttggttatggagagtgtattgcaaaatagtaaaaaataaaattgtttgggagatgaaaagcgtttgagatttcatgagtgttaaaagaaacattgtcattttagcccatggtttaggcatgaacttgtaattctcattccaaagaatcctttgtaagtcttaggtgaaggttaagctttatttccttaccagaagaactcaagaagtgaggttcattaaaaatcgatttaaaatttataaaccttcaaatttttaaaagttatatgaaggaagacttccctctactttaagtgttaataaagccaaaaagccaaacaaggaaaaaaattcaaaaaaggcttctcatgtgacaaaatactttataatagacctattaatagaatatctcaatgcaaattcaatttgtagaagtcgaattctatttgttcatagacttataaatgaataaatactttatcttaatttctcattgattttcagttagttttattttttacactttggctatgaagtgtgggcccaaggtctctttcaaaaagttttaattatataaatgggcacttaagtgcaaccaaagaagcaaaatatctttgaaaaattttcaatatctccttttgtaaagcaaaaaaaaaaaaaattaagcatgtgaataactccccacaagttaacaattcttaaggcaggggtactagaaactaagttttctagcacccagtatgaaaatttctgtaatctataatattggaaagtgttctaaggctcaaaaacacataagagttgaattatactctagtaaatgattgcaacagagatgttaataagaagcaaggaatgtggtggggtttattccatcaatgtttccatacttgggcaatagttaattcctttttgaaggaaaaggattctcaagagtcccactgttgacttacattatttgtatcatgatctaactcaaataaaacatgaaataacaattggtgtaagtccatgtgctttcagctcgtatgcaacaatgaaacaaaaatgaagttgaacaaaaccagtaaaattaaaagtaacactatcttaatgtgaaagaggacattatttcattgacattcaacctgtacttacaatgtgaatacactgctagctactataactcccataactttgattgtattgcccaagattgtttttctttgaactaccatgataccttaccttaaacagatttgtaacttcttttggcttttacttagggcaaaaccgttatttgcctattaatttcaccccataaccttgattgtattgaccaacatggtttttctttgaactaccgtaatgccttatcttaaacagatttgtaacttcttttggcttttacttagggtgaaatcattatttacctattaatttgactcttttagctcatcagtctgccaaaaacaagtactgtagtactcgtgaggttaatgccattgtaagttacaatgcatatataagcactgaaattttatggcagaacttggacatagagtagttatccagttcatctagaatatacctaactttgactatcacctaaataagacagattttacgagtccttacaaagaatgtgtcaactcctgaaaatatcacggacctccagattcttgagattctagtttgagaaaaatgtaccatacactaagctaaacagctttattttatttgaacctgggttcaccagaaagcattccttcttccccctcagattctagatcccctttcctcatcctaaattaaataaatatttttgaagtgtggtttgccaaccactcgtggtgctttggatgattgttggtgatacatcaacaaagatttttaattttaatatttttgtgttaattttaatgtgcattcagaaaaggcatggctagtacagcagtcctgtaatttcaaagatgcgattgctctcgagttaggccggactttaaaaagtgaatcctttcaaagccattttagaaagaagtgttaaatagataaaaatagagatggtacttgaatatgggaaaatcatggagatgataaaagtagaaattttctcttttggcaaaatacatggtgacagaattctttctcttctctttcatactttgtaatgatgaatcatacaattatacaaatttggttgatatttccttctgtttcttacctcctaaaacatcttacttttacctagctacacattgttgtcagtgagactttggtcaaagtggttattgactgcaagcaagtgggtgagaaggcaatgaacgcatcagctaatatcacgtcagatggtgtagaagtgctagggaaaatggttcgatcaagaggaccaggtggaaactctgcaccggtaagtgaataaacccgtgaagctgtgttattgttaagggagagaaattattttaaagtacattagctattttccaggggaaaggtttaacaaaaagatgaatggataaatggatggatgaatgaatggatggatggatggatggatagatggatggataaataaataatggcctctttaaatgaattaagacatgtacattcaaagcttgtggtagtatgcttccactgtattatatggaatatgcattaggaattaggctagtttattttctaagtgcattttaaaatttaaatagtaaaatattcatcacatggtttggggcataaatggtttttagaaaagaattacaactgcaaatgaacctcatttatataagcaaatacaaatccacacaaaattagtgaatattatacacaggaaattgacataagcctcttatttgggttagatttgggcattttaaaactaggttttgctatcactaatgtaaagtttaccctttaattattgtgattattgagtaacataccattctaagataatatattttttaccttacaacatggaatttaaatctgagagacttccagttggcaaagaaatcacattcccatcactcattacccacaaaaaaaagaatagtgcacacagttttttgtgttaatactgtgtattcacagctaattagcagcattctctaatttgagtcattctatagtgaggcattttattcttgtaaacaatcccaactgttctaatctacacttctcttatgtaatagaacaatcaagataattatgaattactattgtctcccactttcatagatctgtagaattagccagttatacaagagctggtagttctccaagacttttaaagctgaagatcactttgtaaaaatgaaatcctatactatgtcaaataaataaaacagacccatggttctaattccactaccattcacttagtacacaggaaatagtccaagtgggagagtgatttactttggggcactttgctattttgcagcatttatttttgtggtaacaatagaagtgaatggtagcaatgtgtccccttatgtatagggggacactgaagctttcagaccttgataggtagatgatgctaagtagtttaacacttacagttgaagtatctttaaaagttcctttgtttctactttgctttggagaattatggattagatgtttaggaagagaatgtgaaagctatggaaggctctcttgttctcagttacagtaagagacttttgggaatgtttacatgatttcaaaaacttgtctcctcctaatgtgtggcatttcatgataattaaaaagcacaccatcttctgcttaatggaggatactcctatgatagtacatgaaggaatttataaaaacacagaattatcaaactaaggatatcttgtatggataaatggatatatagatggatacttggatgatgaatgaatagactctaatttaagaaagagaatccgggccgggagcagtgcctcacgcctgtaatttcagcactttgggaggccgaggtgggtggatcatgaggtcaggagatcaagaccgtcctgtctaacatggtgaaactccgtctctactaaaaatacaaaaaattagccggatgtggtggcacgcacctgtagcccacctactcgggaggctgaggcaggagaattgcttgaccccaggaggcggatgttacagtgaaccaagatcgcgccactgcactttagcctgggtgacagagcaagactccatctcaaaaaaaaaaaaaaaaaaaaaaccaaaaaaccacaaagaaagagaaaccattctaggtatatgagattctgggcccagatcacataatactattattaatattttcttaattttagaaataacgaatataaaattcctgaaagttagtaggcgttcactgaagagcaactattattattgaagaaagtctataacacattctccatcctccatcccaccttttctagacttctagcacttgattattgatagtcacatactattttgtttctctttcatatatctacatttcactcctctaaccagattataaatgcctcaaaatagaaaccgcgtcattgtctttgtttaaaaccaccctacatcacagtgtctactcaatactgatgaacagagtaagttctcaagaaacatttgatagaaattaaatagaatgttgtctgttcaaattgtattatatcttttcttaaaattttgttttgcatatattccatgtgtgatgttgacaatagtcccataatatatattgtaccctctcctaattattttataattataatatatttcacaatgatagttttacaattgtattttaacgtatactgtatgtaataattatgctccaaagatatgaccaactaaatatcaactaatttctttctgaaagtaaaaatgcctcaggtttcaggcctactggtgatcaatctttacttttggccatgagagaaatggaattaaacagagcactctctgtggttatttccaactagtagtagacaaaggagaattatagaagtcaataattaaagagttctttgtaaggctagtaggaaaaaagtcatagcatttgttgaatctagaagtctacaaaggattactaactagattttcagtctgcccacttactgaagaatttgattatgttgaaatgaatgtattaagttagatctcaagaatgtgattggaaactcagacttgctttttgagggatattacttaatcatttcagtacaaggtaagagaagtctcagttttcaattttaaatttagaaatcacagactgccaatctaaccttgatatacatttgtactctaatatccagcaaaagggaatgtatgttgtgcaaattctggattattctaggaggagtaattattatataagagagattagtaacttataggtctccattccctgccaaatccaacaattattcaataaatgccagatggtggaagtctaaacatttagtctttaaagaaactgtattctttttaaaccataattgagtggaagatagattaatgcatttaaggatacagtaactactcgatagaaattacgttcttaataaaatcaactggtgttcagcaatgcaagattgtataggcagtaacagtctctactggggctaacctaacaagcaggcttaacttagctgtctaaatacatgtggaatgaaacttaacaactgtgcttctcctttccaaacttttttctcctaaaaagtttctcctgcattttctggtacctaatgaaatgattctagaaaagttttgagcttctggcatacaatcatatttcttagtgcctttcttctacctttcaaatctaatacttaggtaattatccaactggcatatatttagctccctgctgttcaaataacagagacatatgagttatgctatggagttgcctatcattttagccactgagttacagcttttatatataaatcaatagtagactagttgatgattctacaaacacttgtttgaaaataagtgttgttaaattgctaaaaaatatagtatattttcatgtgaattatctattttaagcttttaaaattataatgatagctaatagttattacatctctgctaggagctaggcagtgtgtattttcctgggattatttcatttaatcctgtaataatccttgaaagaggtacttgcatcttccctactctgtagatagagaaactgagactttaagaagctagggtcaggtcccctttcaaaaagtgagagtactgaaataagagactgtatccaacttctataagatcatctgcctttcattcctgtgcttcttccattaggacagactctgataattatagaataaaggcagagaaggaagtttggtttgtactagagactatatgtcctatctgtacattgacaggttcaaagatttaccattatttgaattacaaccttgagagcaaagtaatcaaaactaccccccaagtgtgtctataccttaaaattctaattaataccaacaagtacaatagctatgaattttattttctaatttaatcagtgccttcgtggtttcccttaaattcaataaattgattgaaaacaagttaaaaacaatcagttcaatagttgacaagtggtaaatgcacaatcttagttttgtgatggcgtcaataaaggttagacatcaaattacaaacagaaaatggtttagttcctctgtactctttcaccagtattcttgtgcagtgtaaagctctctagatatttatataaattcaggtacagctttacttcaaattataaatttagttaaaacatgttagaaaaaaaaatcagagaataaaatttggcactgagtggaaaatggagccagaggtacattttaattcccattcacagatcaaaatgactcaactgctaagaaatattttaatcttattttcctgctaacatttgaccccaagtgacttgccttttgtgctataccaggcaaaaatgtctaacaatgaaaaatgagcatttgtagttgctcatttcaagtattcccttgaaagagattatgaaaagtgaaagtgggaggttttgtgtctcttcctctttttttttttttttttgcaaagatgtatcttttataattttcagtgagttacaaaaacgttacaaaagtaaaaaagggctgcttcttggattagttctctaaagtattatttattttgagccacactatcttgcattttaaggtactcaaatatgagatctttgacataccaccttgtactgtctcctgtataatttgcacaaatatgtatgtcattgcttttggaataaaagccaaaggctttttttctcttttaatcaatcccctgaaatgtgccttggaaaaaaaaagtccctaaataaaggctgaggaatctaaactattacaagtgcaaacaattatgaataaatctgttgtactcaaagaaaaagctgctgacatcatctaacttgcaaaagaaaagtcagcccacgtaacattcctgaaattataatattggcttcatttagcacttagtaagcattcaaccccggaataaataaattgagctcctaagagtcccaataatttcataaggcagaagtccagtcaaaggtttgtaatgtagacattagactgttataggtggttaggtggtagatgtttatttgaaaaacttcaagaaatcctgatgtatactggggcttgtgaaaggcctttgctttaagtaagtctttccattcatgaaaatgtttttgctctgagggctctactcagaaatggaaaatttcttaatggataaatgatttgcagacttagctgaatctatccaatgctgtcataatgggacctatttaataaatgtcccaagacaaaatggcattgtaagatttcattgggctatctgcattttaaacgttagatcaaagatcagtttactggaaaataaaccacaagaaaatggggcatgccatttaaatctcaaacagaactaagccttcaacatgtgattacgttatttaaactttttcttccccggtcctattccacagaatggactttgctatgatcataccccatagcggcaatctgaagatgtaaagatatatgcaaagtgcttaggatagtgcctggcattcatttctgcaaatgtttgttgctattgttgttgttatttactaagatttttctgaatcaaaacatttcatagatattattattgtggaaacaaactactattatatttctgtcctcaatactgtcactgtcattttgattctacttttttggcctttgtattatatgtacaccttctccttaaacaaatcaattatgagaaagctaatatttattatttatagcaactatgttccaggtactgttctaaatatttcctctatactaactcatttaatcctcacaaccacatgaataggtactattattatgctcactttacagatgagaaaactaagatgccaagacattaaataatttgttcaaagtaactcagtctgtcagtggaagagttggagatgacacccaggcagtctagctccatactctcagaatccgtatgatctttgaaatatttattgttagtgttgttgtaattgtttataaaaataagctataatgtatttttccaaatgttttaattttattaggtggtgcaaaagcaattgcagttttgacattacttttgcaccaacctaataaaaacttaattttttattggacataatttttgtttgtttgtttgccctggacagtctcagttatcatactcttggatggtggaggggaaccttaaaccacctggaaaaaaaaagcagtgagccatgcacatatttctgcaaacagctcaataaggtgtatatgggatcatgaaaataagatgctttgacttatggatttgctttcaaaattcaggggttactttattgatcagttggaatgaatgtttgcaataaggcataattacttgagtataatgacagaaagcccgatttcattctgcttactgtcagaacaagttattttgtgatagtgcatgcatttttaataacatgtttcaatagtactatctacttgggcattaccatttttctagaagatgtttggcgaaggatggatagtactatttgggagaaaataaggaaggcaccaagagtttccagtctttgctgaaaacaccacttgctgaaagcaagattacagatttaaaatgaaaacaatttcatccttctcccagatcagtaatagagcacactcttaatatttgaaaataatgtaggaagaaatatagtaaaaatgattgggtcattaagctagtgttagcccttaatgatgttgtaattatgtttctgtatatttcaacatgtacattgacttatcaccaacatacatgagtggagcaagcctgtctaaatatttatggcatgatcaatggcttaaataagaatacacatagcttacattctcacaatactgaatgtgaagctgtcatgacatttgccacattgtgtaccatatttatgtgctcccctctcactccctgtaagttcttctaggtcaggactatgattttttaaaaaatgtttgtatcctaaaagtctacatagtatctggcttatattatgcactgaagaaaaagttactgagtgtatgtacaaaggaatgaagtgataattaattcaataagccttcctgagtgctttttatatgccacatattatgataggtgacctaaagatgagtttggtaatgtaaataattgtgtagtgggaggtgtgctatagaggaggcatatggagtgttgtgtgactacagagtcatttgggagcagctgtgatgggctttgtaaggaagagtttaacagaggagctaagcttactctttaagtagaaatgagaggggaagttttgataaataagagggtttagatggtggatgaataattgtagacaaaatcttagatcactatgtgtttgaggaaaaaaattagtttgacattgttggagttactttttaatttacttactgtaatgtattattaatgtattggtattctgttatataatacataacataaaatcattataaagataatttatatatattttattgaatgacaattttctttttaaatcatagttccagttacagatgtttgatattgtttgctccacatcatgggccaatacagacaaatgctgtgaacttccaggcctggtaagaattcttccttcatttctattgattttttaaattgtatttaattttctggaaatgagaagctatttctcaacattcatatcataggcaactcgttgagatgataaaattagaaagagattaataaagaggcatgtctgaaattaacaagatttctcctgtataacctaggatcacatacagcgtgaactgcccaactcagagggtgctatttacacatagtccagatgttcccagattccatggctcatgaagcccttagtgtctcaagctttttcttgcacccctaagccaaaagaaacaccttgcagttccatttatgaaataataggtccaaacatcttactaaatatttatgtcctaacaactcagtagccatataaaataacaatgcacatacattgaaagaaaaaagtgatatttatattttattcttaaatgaccaaaattgcttattgttgggatgtgtgtgctacctgagccctgcagcatttctcatatcttgggatcacattggccactgccatcctcacttctttttctacattgcttttttcatagtactttcctttcatcatagcagctatatttgtaaattagggcatcatccaaaaaaagtgttgcaaaatctaatgttgaaactgcagactaccttgagcctgtcattcacacgaagtccagtgggtgctgaatattgctgtacttctcttaaatttttaaaacattcacaggacccctgtgagctcaatatagtgctcccaggcatcttggtgtacaattttagaactgtagtcataatctacataacctatatgtgatgctactagaaaactaaacatttaaaagttatttataccaagtgatggtgtaaatatttatgtcctaacaactcagtagcccatataaaatataatacacataaattggaagaaaaaatgatatttatattttattcctatataagcataatttcttactgatgggatgtgtgtatacccatatattttatatatatatatatatatatatatatatatatatatatatacaaaaatacagatttatatcttaggatcctaggacaagtaagctggcacggacaaccatgtcatggttgggcagtagtcatgtcttaataattaaagctgggattctccagagcatggggaacccttcatgaagtctgtgagatttgaccttataaccgtattagtttgttctcatgctgctaataaagacataccccagactgggtaatttataaaggaaggtttagttgactcacagttttgtacggctgtggaggcctcaggaaacttacaaacatggtggaaggggaagcaaacacttccttcttcagaaggtggcagcaaggagaagtgcagagcgaaggtgggggaaaacccctcataaatccatcagatctcataagaatgtgctcactatcacaagaacagcatggaggtaaccgcccctatgattcatacctggcttacattatgcactgaagaaaaagttactgagttgaaaaagttactccactgggtcctgcctgtgacacgtgaggattatgggaactatatcaagatgagatttgggtggggacacagccaaactgtatcagtaagacttaccgtatcaaaaagccaaaccatataaataagacttaacacctcacaacatctattgcaagcaccaaattcatggcagtctgtatttgagaaggaagcaacttgttatttcttcaccaaaataagtttctagtaaactctggaagaaattaaattagagacaccttgatgttatgctaaagggaaggtagatgggaaactggcaggagaaacactcggaatcctctgttgtatcaagcaaagatgtgatcaccactttttctaggaaggatctttctcgttccttttctttttacttgtctcatttaagaggcgtaaattccatagtaaaaagacaccgtgcagtaacagtcagcagcactggcaaaactatcactgagtctctggctacaggtggcctgttgttagccttattttgggatctttcagaatacttaactttatgtttcactctagctggccagatttcaggccagatgtgtttatagggggtttgaactgaaatattttactgttgtccaacatttagagaaaagtatatacaccatgtaacagtccatttgcttaacctttcttgggtttctgttgtgaatattgtagagactcagattattttcaatttggcaatttaactgtcatctgtgctctatttggctctaattttattttcccccaaagtcttaaataatgactaggtttttctctatccaaagggactgatgaactctgtgaagttctatagtattttatcccagtgctgagctcattttggctgctgctctaaatgggatatttacaaattgttcaatagctgttagcaggtgctctgtcttcctctgcattccagtaactcattcagatatattcagccttccattaataatctattttgtaatgtcacatgacaacaatattccctaagagagaagaaaaatgttctcctattccagagcctcagatctacactgtgatgtttttcttactttcaaccacagaatgtgagcagttgtggaaattgtcatagggaattgatgaagagtttaaacattgattttattttgtttttctttgtttgttttagtacagatatagttgttttgattgagtactccaagttttcctttatcctttgaaacagaaaaattattgtagcataaaaaagttttcaagacctttagttcacagagtactatcactccaaccaacagaattaaatagtaatcaagattttttttttgttgcactcacttctgattgtctttcctcacctggattcccaagctggttttagcaacacccattgataatagtgattatcagtgactaggaggtacccattcatttttctttacagaaaagattttgtaatcaggagtgaatattctctgcctttctaatgtgcacttgaaaatctaaaaatatcttaaatcaaactgttttctttgagccagtaaagccatttgtataaactggcatgctaatggttgtgctttttttgtttcttttcagagagatgatgagtcttgcccagaccttccccattcctgctcctgttctgaaaccaatgaagtggctctgggaccagcgggcccaccagtaagtcttgctgagttcagccttaaattttctttaataatattaatagctatcacttgtgtgtctaatatgtgttgtctactgtactaaatggctattactcacttaattgtaggaatgcagtgagacacagagatgttaagtaacttgattaaagaacacagcttggaggagctgggctgggcttcaaatccaagtctccatgactcctagagatgatgcttctcaccactgtgtcatacgatgtctcatactggtctatattcaaaatcttcccttacagctactgtggttaattttcggtgtgaatatttcaaaccaggacctttacttgtacctgtaagatttgcatacatctgctttgtccactttctctctttttttaaacttttactttaggttcaggggtacatgcgaaggtttgttacatagataggtgaactcatgtcacaaggatttgttgtacagattatttcatcacccaagtaccaagtctagtactcaatagctatttttctgctcctttctctccttccatcctccaccctcaggtaggcccccgtgtctgttgttcccttccttgtgtccatgagttctcatcatttagctcccacttataagtgaaatcatgtggtatttggttttctgtttctgtgttagtttcctaaggataatggcctcctgctccatccatgttcccacaaaagacatgatcttgatcttttttatagctgcatggtattccatgatgtatatgtaccacattttctttatccaatctgtcactgatgggcatttaggttgattccatgtgtttgctattgtgaatagtgctacagtgaacattcgtgtgtatatgtctttatgatagaagggtttatattcctttgggtatatacgcagtaataggattgctgggttgaatggttgttctgtttgtagctctttgaggaatcaccacactgcttttcacaatggttgaactaatttacactcccaccaacagtgtataagtgttcccttttctctgtaaccttgccagcatcagttatttctttatgttttaataataggcattctgactgctgtgagatggtatttcattgtggttttgattttcatttctctcatgatcagtgatactgagctttttttcatatgctttttggccacttgtatgtcttcttttgaaaagtgtctgtttatgtccttcttttgaaaagtgtctgtttatgtcctttgctctctttttaatggggtcatttgggtttttttcttgtaaatttgtttaagttcctaatagaggctggatgttagacctttgtcagatgcatagtttgcaaaaattttcttccattctgtaggttgtctgtttactctgttgatagttacttttgctgtgcagaagcaccttagtataattagagcccatttgtaaatttttgcttttgttgtgattgcttttgatgtcttctttgtcatgaaatctttgctcgtgcctatgtcctgaaaatggtattgcctaggttgtcttccagggtttttatagttgtggattttacatttaagtctttagtccatcttgagttagtctttgtatatggtgtaaggaaggggtccagtttcaatcttctgcatatggctagccagttatcccagtaccattattgaatagggaatcctttctccattgcttgtttttgtcagctctgctgaagatcagatggtcataggtatgttgtcttttttctgggttctgtattctattcccctggtctatgtgtctgtttttgtaccagtaccataccgttttgattaccatagccctatagtatagtttgaagttgcataacatgatgctccagctttgttctttttgcttaggattgccttgactatccaggctcttttgtggttccacatgaattttaaaatagtttttttctagttctgtaaagaatgttattggtagtttgataggagcagcagtaacactgtaaattgctttggggaggatggccattttaacagtattgatacttcctatccaagagcatgaaacgtttttccatttgtttatgtcatctctgatttctttgagcagtgttataattctcattgtagagatctttcagcttcctagttagctgtattcctaggtattttatgctttttgtggcaattgtggatgggattgcattcttggtttggctcttagcttggctgctgttggtgtatagggatgttagtgatctttgtgcattgattttatatcctgaaactttgccaaagttgtttattagctgaaggagcttttgggctaagatgatggggttttctacatgtagaatcatgtcatctgcaaacagggatagtttgactccttgtcttcctatttggatgcctttatttctttctcttgcctgattgcactggccaggacttccaatactatgttaaataggagtggtgagagagaacatccttgtcttgtgctggttttcaataggaaatgcttccagcttttgcccattcagtatgatgttggctgcaggtttgtcatatatggctcttattattttaaggtatgttccttcaatacctattttattgagagtttttaacatgaaggatgttgaattttatcaaaagccttctttgcatctattgagataattacgtggtttttgtctttggttctgttcgtgatgaatcacatttattgatttgcatatgttgagccaacctagcatcccagggatgaagcctacttgactgtggtggattagctttttgatgtgctgctggattcagtttgcaagtattttgttgaagaattttgaattgatgttcatcaaggatattagctggaacttttcttttctgttgttgtgtctcttccaggttttgctatcaggatgatgctgacctcatagaatgagttgaggaagagttattcctcctcaactttttggaatagtttcaaaaggaatgttaccagctcttctttgtacatcttgtagaatttgactgtgaatccatctggccctgggctttttttttggttgctagactatttattatggattcaattttagaccttgttattggtctgttcagggaatcaatttctttctggtttagtcttgggagggtgtatgtgtccaggaatttatccatctcttctaggttttctagtatgtgtgcatagaggtatttgtagtagtttctaatggttacttttatttctgtggggtcagtgtaacatcccctttgtcatttgtaattgtatttatttggatcttctttcttttctgctttattagtctagctggtggcttatctatcttattaattttttcaaaaaactaactaactactggattcgttgtcttttgaatattttttcatgtcttgatttccttcagttcagccctgatcttggttatttcttgtcttctgctagttttggggttggtttgctcttgcttctctcattctctcagttgtgatagtaggttgttaatttgagatccttctaactttttgatgtgcgtgtttagtgctatgaatttctctcttaacactgccttagctgtatcccagagattctggtatgttgtacctttgttctcattagtttcaaagaacttcttgaccctgcttaattttaattttttatatatcctgagattatgttaaaatgttcaaaatattagaactgttgtcttcctattggcttgttacgtgaatcattgtgaatgaaaccatttaacttcagtaatgctttttacttcaagtctgatttgtctaatattaatatagtttcaatattgtcttttggactctttgtctaattttttaattttctaatttgtctaacttgcatgttctcattccagccagttggaaagggagaaaatggttgaggacagcatttggttttcatttaagaataacacccagggtatatgcagcaccctttctctcatattccattagccagcacttagtcatacctacttacgtaggattccaagaaatcaagtccctagttggatggttatatgtttagttaaaactcaggggattgtattattacaaagaagcagtggaaatgaatatgaggacaattagcaatctctgtacaactgtgaaaacttttttttttttttttgagacggagttttgctcttgttgcccgggctggagtgcaatggcacaatctcggctcaccacaacctctgcctcccaggttcaagtgattctcctgcctcagcctcccgagtagctgggattacaggcatgtgccaccatgccaggctaattttttgcatttttagtagagatggggtttctccatgtttgtcaggctggtctcaaactcctaacctaaggtgatctgcctgcctcggcctcccaaagtgctgggattacaggcgtgagccaccgcacctggccaaaaactcttttaaaaacatttcagatgtcagaaataaaaatatttcagatgaacaaaaactaataatttaccaccaatattctctcattaaggaatatgcctaggacataatttaaaataaagaaaaatgataccagaagaaattatgaccaaagaaatagcaaatatatgggcaaatcttaacaaatattaatttgtaacatatattttcttcactttttatttgcgacatttcattgtctttatatttatattttagatatttctctttaaatagcatatgccaagattttgcttttaatccagttttacaatctttctttcatagtctagtccattctgttggttgtaataactgacccattctgatttacatccacaactttaattttactttcttggtttttcttaatttcttaatttttgctttttatttgtgttacatatatattttttgcttgagattgtatttatttttgtctttaatttttgctttttttgtattccttttttctcctccactagtttggaaagtatactctgtagcttttctattaatagttaacccagaagtttctaccagatatacttagtttaacaatgtttaaaataatcaccatttctatcctactttgccagtatgatgagttggaattctttcaacttagatcatcttcttaataatttatgtgctcttactacccagtattttaatactgtttttaacatcacaaattagatgtcttgattattattattgcttgtgtgaactctaaaacataaactttccagcaagcctcagccatctttcccatccttcctgaaggcagtttcagttcacatgtatactatagttttttattgtttctttcttcttggtacttaagaatagagttcttaattacagtagtgttttagccagcattaatacatgtttatagcaggagggttttcaagttttttcatctgtaatttactggaacaagtgataaaatatttatttgtgacctaaacagcaaactttctaatggggagaagcagcagagatgtgaaagggaagggttgagctttgaattggagggggaagaaagatgtaaaatgagaaaaaagcaattgaaaatttatatttcaaaaatttcaaataaggaaattttgtattctaaataaagcgtaataaactaagaaatagtatcctgagcaatatgtaataaattctgtttgatgattgaacattctttaattgttttctcattcatgaatttacacagtagtatgacgtatcaataaaactaaaggatctgtaggaaggcctggatagaagaatcatattctctttgtgaagtctaagcctctcttattgaaaaaatgagtgttttcgtcaacaagtatttgctgaattcttgtgatatgcccagtgacaagggttaaggatgaggtggaaagtaagttagaagtgtaaagtggtccctggcttttagacatggtgcctctgacatgaatatctgtgaggtaaacagtcttgattattattatttgaataaaatcttcagttgaagatatatttgaatatatatttgaataaaatcttcagttgaaaacaaatcatttaagatgcaaaaacaaaattaaaaagttgtgacagactgggtatattaactgggagagactaggctgcgagaaacagaaaatttagctaacacagtagtgtaaactatgaggacaataggacatttattgtttgctcaatagaagatttagagggagatggtctgaagaaggcaaatgaggctgctagacgacttcatcaaggacttgtgcttgctctagcttcccatgttgcttcttgatcaaattggccaaaactgcttaacacaatgattcctggttgcaaagaaaagctgagaaaacaagtatctgtcttttttggcctttatctagggatgaaagggaaaagggggtcagaaaaggctcttaggtagccagccatagtttctgacacactgggggaaaaactataatgaagcatatatggaaatctgatatatggcacttgatagtggcattgcagatcaagtagagaaatgattgatattcaataatggtgctgggacatttggtcttccatgtagaaaatatctacaaataaaaatatatataacatctaagtttgtgtaagtacactccacgatgttcacacaacgacaaaattgcctaacaacacatttctcagaatgcatttccatcaccaagcaatttatgacttcatatgaagaatttctactcattaaagagaaaaagacatgtaacccaatggaaaactgagtaaagtatataaatagacagtcacagtgagaataaatgcaaatagataaacttatgaaaagatacataatcataatagttttcagggaaatgaaaattagaacaagaataaggtatattttcagcaatcaggttgataaaaatgtaaagtttgataatattcagggttgattaagatttaaggaaacagggaccctcttaaactattggcagatcaataaactggcacagttagtttagagtacaatatgataatatatctgcaaatttatcaactttcacttaacgattctactcttggtatcttcttctgagaaatactaacagtttcacttaagggatatgtaaggatgttaattgaagcatttaaaaatttttttttaatttttaattttttgagacggagtctcacgctgtcgcttaggctggggtgcagtggcatgatctcggctcactgcaacctctgcctcctgggtttaagcgattctcctgcctcaacctcccaaatagctgggattgcaggcctgtgccaccacactcagctaacttttgtatttttaatagagatggggtttcaccatgttggccaggctggtctcaaactcctaacttcaagtgatccacccgccttggcctcccaaagtgctgggattacaggcgtgagccagtgcgcccagcctgaagcattgtttaaatggctgaaaattgtgggaataaaactacttaaatttccggtaataaaagaatggctaaacaaactcttaacatatccaaggttcagacaactatgcaacagttaagaatgaattagatctatgtgtgctataataaaaaatcactaaagcatattaagttgaagtcataactatgtaaaaagtgtgacatcacatatttaaaacatacacagcaaataatacagtaataccacgggcagtattttgtatagatatagatgcacataaataaaattacgttttataattgcatttttaaaatctagaagatgagcaactaattgataaaaaggaagagtgcatgtaaatggttttttaaaaagctgaggaaattttaaagatcacctgacccagtgttttcttaagtgatacagcattctgctaatagtgtacagaatcccttttagtaatcctggacatggcatgaaataaactggaatcacacagggagaaagttattccattttcaatgatttttcaatccttctgctcaggtaaaatataaattctgtctagtgcccacatggtcctcctaacactcatctccctttttatcgaagagcgaactcttggctcacagacttcaatagaaacagaatctagctaaattttttttgttttgagagggagtctcactttgccgcccaggctggagtgcagtgatctcagctcactgcaaggtccgcctcccaggttcacgccattctcctgcctcagcctcctgagtagctgggactgcaggcacccgccaccacgcccggctaatttttttgtattttcagtagagacggtgtttcaccgtgttagccaggatggtctcgatctcctgacctcgtgatccacccgccttggcctcccaaagtgctgggattacaggcatgagccactgtgcctggccaatctagctgaatttaatagcattatttatagtgtattgatttctaagattaccttatagttttagcaagcgatactttttttcatttactgtaatgctgtatttgcttttaaaataagtgaaatagtcaattaagatattcagtaaatacacacatgtgtttagacacatatgaacatatatacagggaatatatacacatatatatacatattatgtttgtagatatatatctatataaagaaaactgctattaaataatagtctagataatatggcaaaagttttgaggggaaatatgaatgacaactttcagaaagatgaaactaattgtccttttgctgtgtaaataaagaaaatcaggttgttgctactttcatgtgctttctacaatttaattggatcatctcaaagttatgttttatatgttatatatgtatgttttataacatatataattttgattaacattgtattctttgggtcattcataatggtagtcttctataaccactaagtaaataaaatcttaccatttttcaatatttaaaaagaatttggcaaagaaagttttccaaaaccatgaaatcgtctgcagcgctggggctgggtggtaaatttccagttaaggatcatgatgaatgtatactattacacagtgtgttggcctttacataaaataataatgagttaattcatactattaaggaaaatgaatgaaatacactgttttgagatttgtctttgagctaatacttaacatctgtttgccagggtggtccaggactccgaggaccaaagggccagcaaggtgaaccgggtccaaaggtaatgcgcatgttttctctctctctctgtctcatctctctctctctctcataaatagccatcattttggagctaaatgtgacttatttcacccttgcaatctaaagttccttatagttttatgaaagttgtgcctaacccttcttccttattttaaaagcctatgcttttaatcaaaaagaatatttaataactcaatgaaaagaaaggcttctgggtcagaaataagaatgtcaatgttctgagtggtttagtctccaaggtagttctctcagaaattgtacattcttctcttcctctacctacaacaaaaacgtatctttagaggaatcatgcagaaccacaatttggtattagtcctttccaggtaatttctcaggttttggattcctcctcctccactgcactatatataatcaaacacacaactctgtttttcattcttactgcccagggtcatcaaatgtggtggttcaggttgtacattgttcaaaggcacctgccaagagaccaagccatgccaagccatgtcaaggaacacgtttttctactttgcacaaaggcatcctgaggactggcagaagcccagtcactaatggagttcaggcctcaccatcttctctccagctcttggcaaatcttctaactggtcttctgtcccaagtggcttaacatttcgattgattcttcacatctgcccccagattaatttccttaaagtctatgctggatcatatcatacttttcaaaaacctgcagtcacatgctgttgccttcagaataccgttcaccctctttgctgaggcatttaaggccctttgtaacttgactcccatctcattttcaccatgttgctccacatgttctcctctccatccatcttgcttgacttactgctcagtatggtttcttattaaatttacatagcatttattcatggagaggagaacattgcaaggttttttaccataaaattggaaacagatgaagcaaggtagaagaaaatattgggataaaaaagaagtaaatgaaagaaggctaaagacaattaatcaggtactacccaatccaaaattcagaccataagatgtctccttttttgtttattttgtttggtgggacagacttgaggtatcttacttggttccatcttttatggtgctgtaagaagggcagtagttggaggcctcttctcaagcaagggtgcactggatcttcctcagtttcacccaaaggcaatgcccctctgctcctatagattctagttccctcttcccagtgcctctatcagcatgaccccagtgttttctaacatgatcactggatgatcgttctaatcatgaagataaatgagttcgtagatgtttggtgatcccaagacctacccatttcctccaattaccatttccataggttgctactgatatggttatttctgtatgatgattttgatgaatcacagatccaagtgagtagtggtttttggaaaaagtcttattggacaaaggacgttgacatgtccaccaatgtggacagtgcaggaatagataccttgcatacggaaggccccagtatgtatgattttttattttgttgcagcaaatacagaataagaatttggaaggacaaagcaaacctcttgttggtctctcctagtcatttttgcctcatattttataggataaaatgggaccccctagtttttgcccttctactctatttgcaatttctcgataacatattattaaactcagccaggcgcggtggatcatgcctgtaatctcagcactttgggaggccgaggcaagtggatcactttgaggtcaggagttcgagaccagcctggccaacatggtgaaaccctgtctctactaaaaatacaaaattagctgggtgtggtggtgggcacctgtagtcccagctactcgggaggctgacacaggagaatcacttgaacctgggaggcagaggctgccgtgagcagagatcacaccactgcactccagcctgggcaagacagggcaagactccatctcaaataaataaataatatattattaaactattatatattaaaatgatttattattaaaccattacaaatactaagtaatacataaaaattgcctccttgctgcctccatcgtatttttaaaaatccagctccctccctctcccttcctcttatgccatgctccttgtaagaatagttatcattcagtgcttccacacgctcacctcccaaagaattctcaacccacatatgcttcctcttcctctgggagtcctatgaaaattctctcataaaagttcctaattacttgcttgttaccagttccatagattagagtttaatttttttaacacaatcaaacacttctttgtttgaaaatttctcctcctttggctgtttctatagcacaataccactccgtcttcagcctcttcctaattctcgggctttttcatttcagattcttccccaggtttctcttcctttcccttctacctgattatcatctcatttttatccacattctatttcactcactcaatacattctccttaataacctcacctataaatatattttcaactactccaaaatccatcccagcatagaccttgcctaactccttggcctgctggacatttccatgtggtttatcccaagcacctaaatcttaacaagtcttagtctgcactcattatctacccacactttaccccacaatgcctttttttctgtattctttgtcccatgtaacgtgttcaccaatctcagagctaagatgatacacagatgttggaggtcctaatttaataaaagaatagctttagttgaagtcacagaacgagacagaagagactgaggataggtaggtttttgggtctaatatttcttacatggtttagttttagttaaaccgcaacaagatccaagctacagaaataagggttacagaaataagggtaaaagggatgtctgatcctgaaaagaaaggaagtaaaataggctgggagtggtggctcacgcctgtagttccagtactttgggaggccaaattgggcagatcacctgaggtcaggagttcaagatcagcctggccaacatggtgaaaccccatctctactaaaaatacaaaaattaggcaggtgtggtggtgcatgcctgtaatcctagctactcaggaggctgaggcaggagaatcacttgaacctgggagcgggaggttgcagtgagctgagatcaagccactgcactccagcctgggcaacagaatgagactctgtctcaaaaacaaaaaatgaaaaaaggaagtaaaataatactaagccgagggaaggtcattcagtggacattgaagaaggtgtagtgtggtggcagcgtcaaagtgaggaagaaagcagaggctaggtgcaaagttctcaataaatgcagaggagtccccccgaggtaggtggttgacagtagcgaagacagagagaatgtagttcatctggacagtgtgaaccttcccagactaggaaggtggtcttgaagcacttatacttataaatttgttatggagtgtggggggtctcattacttacataattggcatagcactcttatttacagaagcaaaagtagtaatgataaaaataaagttacagcgatccctgtgtgtttactcttatggtttactgatgacattttgcctggaaggtaaatcatttgaggcttgatgtcttgctatcctgagtatttcctatcttaagaaaaactatataagaaaacaaattataattgtcctaagcagaaatattttctagatgtcagagagtctaacttacttttaggatgatacttctctcttgccttccagggaccagatggccctcggggtgaaattggtctgccaggacctcagggtccacctggacctcaaggaccaagtggtctgtccattcaaggaatgcccgtgagttgtgttcaaacattcagacgggttttattgttatctcttttccatgaggttacaaagaatgaacttttgtcttctgtgtcttaataatgaacctcagtccctttgaaagcaatgatggagtgtcatttcactagttgtgcccttagccatttttgtgtccaatgatgaaggtcttttaacaaataagtacatgcatacttattggaggtaggtccatccgcaagcattgtgtctatagaggaagaacaaagcttagcatgtatagccctttttctcgtctaactaaattcttaatggatgtgataacattcagaaagtaacaaatgttatacaaatttaagttttttaattatgtgtagtaactgctgatataaattaataaaagccatttattcatgatccttatctcaaatggcatcaaagtgcagtttatggagagtgagagtttagatttttagatgatgtattttatatagctgcatttctttgaaaagtcattttgtaccattgaaaaaaaagtttaattccattcactgatcttcattaatcttactgtaggagtctagatttaagaataaaaacaatctctttaattcatatttgaagcaaccagatccttttaagcacaatttttggcaatctttctgcacatatgattgtgtctgcctagctgagaagtttctcctacagtgttatttttacattttagaaagcattaacatgccaatttgtgtaattactactaataataaacattggttgaggtcttactacatgccagattctgtgtttgcttttcccttcttatattccatttaagtatgtttctagccaaaacaaaacaaaacaaatctacatagatatgagattgtaaaatccaagccgtaaataatactgaaatgttcaagccgccctgcatgtatttacaatattggccttgccatattagactgtatattctatgttaaaactatcctggtatataaatgttcagctccataggaatgtttacataaatggcataacatatgtggaaagtgaaatatattctgttggccaggcgcaatggctcatgcctgtaatcctaaaactttgggaggccgaggcaggcagatcacctgaagtcaggagcttgagactagcctggccaacatgatgaaaccccgtctctactaaaagtacaaaaattagctgggtgtggtggcaggcatctgtaatctcagctactcaggaggctgaggcaggagaatagcttggacccaggaggcagaggttgcagtgagccaagatcgtgtcactgcactccagcctgggcaacaagagcaagactccatttaaaaaaaaaaaaaaaaaaaaaaaagtgtatatatatatattctgtttagatgttagtgcaaacgcgatttactgtggaaactatttaaataatgagagaaggaaaagaaaacgctaagaatttacctatgtgaacttaactctgtatacttttggatattcagggaatgccaggagaaaaaggagagaaaggagatactggccttccaggtccacaggtattatttttgttttttaagtctattgctctcagtctacaactttgccaagggggaaaaaaaagctgtagcttctgaagtcagttgtgatcttggtaagtgttttccatattaaagactgcctgtattcacttaccctaagccccttttgagagtcacactgatgttccccaggtgagctctgacagggaacattctttgcccatgaataacttctaagtctgaattctaggttacaaagggttcaccattatgctcttaggtttgtttggaggccttcatctatttcagggaagctgcgtgagcagatgactcattcctgtgaacctgactcttttttgtccctgttctacacagggtatcccaggaggcgttggttcaccaggacgtgatggctcaccaggccagagggtaaggtcttgcccaaggttggtttttagcaaagtagtgaccttttcaccaggtcactcttattgctgacaggcttctatgtaagggagtcaagccagtttttgctttttgttttctcctgtttatgtattttccacctatcctgcactatttcccttcactgacatcttctatgttcattacttcgtcaaaccctaggaactttcatcaaaccttcccaaattagcacatccctttccgagtgctcccatgacctgaatacagtttattgtgtgcattggtttagtagatttctccagttctttcaaatccttgaggcataaatgtaaaggaaataaagaaccatatgaattaaaatttaaatagaatggctttctgtagtatggcttacatggcaatctccatttatttaatatcattcaattattggttcttctcatctgttcaagtggacagtagtacaataaagtataaagatattcaggaaagggatacgctaacatctggtatttgtttagtcaataaggttttactgaaccaagtttgaggttcttgttctcaaagagtttatagtttattgggaagaaatataactaaataagaaacttttattacatgctatcatgggagcagagccctgtgagaacacaaagaatgaataaccaagctagacttggaggctggaagaagacttctcagaggaagtaccatctaggctgagtcttgactgaaagatagaagtcagccaggtgaacaaggaaaggaaagctattgcaagcagaggaaagagcatatacaaagaggtagaggcaagggaaggtggagcatttccaatattgtacatcgtttagtatggcagaagattagagtaattgtatgtgtgtgttgaatgcatgtgcacacttacttaggtgtggggagattgttaagagaagaagttagagaggtaagcacaaattcatttaaatcatctattttttccaactaaggattttgaactttaacatgaaggcaataggtagtcattaaattttcagcaagggacacagaggctggtcttccttaaactgtcaccgatttagacatgtgagcagctccacagtttctctcaagactggattatatagagtggcgaccacttagattcaatccaatgaaggacagcacatctggtgttcactggtgttttgggtcgaacttactaggttagcaaacaattgacttgagcacccacttctctactcaaacaaggcttgcttttagctcagggtagctatactgttcaagaataatgaaactgttcttgttttttctatagaatgtagatgcgcaagccttctacatcccccccttttttttaacaccaaacttttgtttgcctaaaatctcagtgtagtctctgttcatcaaatggaattagtcagtccgtgaaatatgtttaggtgaatgtatctgaagaaggcattctgtaacagttagatttatgtagcattcttgtacatgtggaagcagcatctagaaatatttatatattttggcaaagggcgtaggctaagatcctgtgtggttacacacctggattccttcgtgattcctgaagttctgaaaatggcaattctaaagatttagttcggtgagtttatttatctgtgcatgaagtccaatcttggcaaagaactcacaaatcaaacatgttgaattagtgtttgaatcatttggttttggaattctttcttttaacaccaatataccaacacagactttttataaatattttgctatccctccaaatgtgtgttcctctataggattaaaaggcttagagctgtaataaagtgataagatatgtgtaattagattttattttcctttctcttccaatctggaagtcaaacttttagagtatgtctgattcttaatttgaaaacatattagatggaagtgggcttgcttttccaaactagatttctgaggatactcattctttatagggccatgtttaaagaaaagattgtatgattcctgtgatgattcttctagaagagatatttgaaggcaatatcatttcaatgtgcaacacaagcagatgccattcacacagaataaaacataatggtgcccctgaaattgtgtaacatggctgccttgcttgagggaaggaccacatatttttaatcaatcagccgtgtcttcattgagcagatataatatgccatgtactgtgctcagcctggaaagagttgttcattactgcctacagagaagaatccagaagaagagagaacttcaatggcagagggagacagtttgtggactgtttgcctagaggagatggaaggaagggataagaacatggctgttccctggggccagaaagacaaaagggtcttctcagagacagtagagaaggaaagaagaaatgaaggatggattaaaaacggctatttaggtggctctgatctgttcagtcaactgatctgagggcttaaggatagtaaagttctaacacagttagatattaataattactgggcaggattgtaagataggaggcccaggacaattttcatggtgggagacagaccttggacacgaagcaccccagaagacatgctgcattggagggccatctctccctggtttggcagtgggagaggaggtgctgtttatagagtaagcacaaacaccttgcaattattcctgctccacctcaggccatcctaaaaggcaaagctgcatttgggggaaaaaaataattacaacaacaataacaaccgtggcatagaaagagagcaaacgcaggatgatgagacttactgctgaaatgactgagaagacacttccagaaaactccccagtcaggctccactgtccaaaaaatcaggaagccaaagctttttattttcctccactctgagcactgaagtcacttaacgttactgtgcctttatttcccctgtcctgtgtgagtaaagcctactctagggaaaggaggaggaagctgcaacagacattttcaatgatgtttaatcggcgcttttagctccttggacagtgtaaggagtacatgagtgtggtgtgcagtaggagtggtgggctattccttactgctcatttttcttccttttatatttttgccttctcttgtttctttacttattttaattttaatttttagagataaggtctccctctgtggcccaggctggagtacagtggtgtaatcatgactcactgcagcctcaaactcctgggctcaagtgatcctcccacctcagcctaccaagtagctgggactgcgggtttgcaccatcatgtctggctaatttttttattttatttatttatttatttttggtagatatgggggtcttgctgtgttgcccagggtggtctcaaacacctggcttcaagcgattctcctgcctcagcctcccaaggtgctgggattacaagcacgagccacaacacctggccaaatctttgtcttctcttattgacagccacaaacttaaagcgcaaaccaggtgccatcaccttgactgaaagcttatggaaaggttagcacccctttcctgaagctgaagccaatagtacccctgaatttagcctagaaggagagagatcttaacaaataataaaaaggagaagatgaaacatcttttcttctaatgtttctagcttattctggcttttcccaaggggaatctttgactcttagaggtagcttttattcaactctgggcctgaggccataagcaagtctggtaaaaactgaacttcattgaacaagttgcagcctcttgctaggcagccagtagagtacaggaccacactttaaaaagcaatagtgcaagttcatatttcacagccaaatacattgaggcattcagttttcattccaggtcattccaacagaaagcattttcgtctcatctttcatttgcactgtaaatcttgtcactgctgtcatctccttcctcttcttttcttggtatctgtgacttcaggacctatcctgtgatctttgagctcctctaatatatggtggctttctcagtccccaccctagacatcagggtggtcctcaggaaaactaggaagaacaggcaagacatggattacttcatgtttccaagccctcactttcctcagcggtaaagtggaaaaaataatatttgactgcagagaattgtcatggagattaattcatataaagcatttctctataaaaatgtgattttagctaatattagtattcactattttcaaggtaaacttaacaagcctggacatttataatattttataaggcttgtacttgacacgtcgagatgccttagaagactgaagaaatacaaaaattctttttttaaaagcaagttaaaaattttttttcttggatttcacctcacaaggacaccagaagcatgcttctagattatgcaggttttatgtctacaaaggacatatttgtgatgaatatcccatttcatcaaaagtgagttagacttgaaatgcacttgagaaattgaacttgagtcaactatctgggtttaatttttatcataaatgttaagcagtgatgaaatatttatctaagtaatattttgtaaaatactaagattcatgataattattcccttgagcatcttcctccttctgaagaggatgtgtaaataccatcacaaaactagtggagggaataatttgattttcttctttgtggctctggatgggttttataatatcccaagaaagcctttgcacaatcagccacagtgatgatggtatatgcagttgagactgaacagattatttgataaaaatagcagcaaccactatcattacttattgaatatgtgcaggtgctttgcaattatgatgttctctagtcctcagaataactacgaatgctagtcattgttatccccattttacaggcaaagaatctaaagctcagaaaacggaagaaacaatgccacacagctagtaagtgttagagccaggattttaatccatctgcctgggtcctacacttcactctttctttccacaaaattatattagtaaagatcaccacaggattttgttactgtgagaaaatctttctcaaaagagatatttaataagcaggacttcaacacggaagatgttgcgcccagcattttggggcaataggaacccagtgtgggttactttcttgatgaagtagatactgatgcttcacccataaaaatatggtttcttgatcactttacacctttacctggagagtggcacacctgggcacatctgagaagagaacagctactaaaacatattagtttcctgtttttactgactctagagatacttctgggccaggcacggtggctcacgcctataatcccagcactttgggaggctgaggcaggtggatcacaaggtcaggcgttcaagacaagcctggccaacatggtgataccccgtccctactaaaaatacgaaaaaaaaatagcttggcatggtggcacgagcctgtaattccagctactcaggaggctgaggcaggagaatcacttgaaccgaggaggtggagattgcagtgagccgagatcgcaccactgcactccagcctgggcgacagaacaagacttgtctcagaaaaaaaaaaaaagatacttctgaaattgtctttatctgggacacaggcatggtacaaatagtaacatctgctttgcaccctggttctaacactgtccttcagcgtcggcacttgcattttatattggtaaaccagcagtttcctaacttaagtcatcaggttgttgttttgtgttttaatatacagattcctggacttcaatctcagagattcggatacaaaaggtcttaggcatgacttaggaatgtatagtttttaaaagcttaatgattctgataaccagctaggttttggaattgctagatagtatattgtgtgagacctactgatgtcaaagtgatttctttgatagactattgctggcatttttttttgttttaattcactgaagtcatcactgcaggttactaaaaatgtacatatgtttatatttatatatatacacatttaaattataaatgaatatgtatatattaaaaatagtatatgtggactgcatgttctcacttataagtgggaactgaacaatgagataacatggacacagggagggggaaaacacacactggggcctgttggggggtggggttggggaaggagagcattaggaaaaatagctaatgcatgctgggattgatacctcggtgacaggttgataggtgcagcaaaccaccatggcacacatttacctatgtaacaaacctgcacatcctgcacatgcactctggaacttaaaataaaaataaaatagtatatgtggtacatatgcaagatatgcaggcttgttacataggtaaacatgtgacatgagggttggttgtacagattatttcatcacccaggtattaagctattaagcctagtatacattaattatttttcctgattttctccctcctcccatccttcacccactgataggccccagtatggtttgtttccttttatgtgtctgtgtgttctcatcatttagctcccacttgtaagtgagaacatgcagaatctggtttttctgttcctgcataagtttgctatggataatggccttcagctccatccatgtccttgcaaaggacatgttcttgttttttttttatggctgcatagtattctatggtgtatatgtactacattttctttatccagtctatcattgatgggcatttaggttgattccatgtctttgctattgtgaatagtgctgcaatgaacccacccacacatgcatgtgtctttataatagaacagtttatattcctttgggcgtatgcccagtaatgggattgtgaggttgaatggtaattctgtctttaggtctttgaggaatcgccgcactgccttccacaatggttgaactagtttacactcccaccaatagtgtaaaagtgttcctttttctccacaacttctccagcatctgtctttttgtttagttttgtttttaactttttaataataggcattctgactggtgtgagatcgcatctcattgtggttttgatttgcttgtctttaatgatcagtgatgttgagcttttttttcatatgtttgttggctgcgtgcatgtcttcttttgagaaatgtctgttcatatcctttgcctactttttaatggagttgtttttttttcttgcaagtttgtttaagtccctttgagatgctggatattaggcctttgtcagatgcatagtttgcaaaaattgtctcccattctgaaggttgtctctttagtctgttgatagtttcttttgctgtacagaagctctttagtataattagagcctatttgtcaatttttgcttttgttgcaattgcttttggcatctttgtcatgaaatctttgcccgctcctatgtcctgaatggtattgcctagattgtcttccagggtttttatagttttgggttttatatttaaatttttaatccatcttgagttaatatttgtatatggtataaggaaggggtccggtttcaatcttctgcatattgctagccagttaacccagaaccatttattgaatagggagtcatttccccattgcttttttttgtcaggtttctcaaaggtcagatagttgttggtgtgtggtcttatttctgagttctctcttctgctccattggtctatgtgtctgttcttgtacaagtaccatgttcttttggttatcgtacctctgtaatacagtttgaagtcatgaagtgtgatgcctccagctttgttctttttgcttaggattgccttggctgtaagaatgagataatgtccttttaagcaacatggatggagctggaggccattatcctgaggaaactaacacaggaatagaaaaccaaataccacatattctcacttataagtgggagctaaatgttgagtacatgtggacacaaaggagggaacaatggacactgggacctacttgagggtggagggagacaggaggatgaggatcaaaaaactacctattgggtactatgcttattacctgggtagcaaaataatctgtacaacagacccctgtgacatgcaatttacctgtataagaaaccagctcatgtaccctgaacctaaaaaaaaaagtttaaaaataaatgaataagtaaatgaaatgaaaatagtatatatacatataatatataaatagatgtatatgtttatctgtgcatatatacatatacatttttaatgtgtgtgtgtgcatgtttgtgttactgaaaattttcccatgtaacccaatgcaaggattgatcccggatctgtagcctgggacagtgtttacagaatctgtggcttctagttgcttggcctcttaatctggtggttggtcttaatcttttgctgcaagaagcagccttttttcttatggctggctgccacactagtctgcttacagaagtccagagccatgccacagggttgaaattgtgcaacgagggtttcttcaagcatatctctaaccctgactgcttgagcctggcccctttcaacaaattcatctgttgccagctgcttacagatcccactctaaccgagagtgtagcatcagttgaataaccttaacaattggccggaatcttaaggttagtatcatgacctaccattgtcagcttcgaagaagatatgaatgaagaatagtataattgagtcactagttctaagcagtatttccgctggctacagaaacaagtattctcctttctgacttgattttcagttgcaacactatttgtgggcaggtcagttttttttagagaccataggcacagcacctagaaactataaacttttaaagagcctaccaaaaaatgtttagaaacttgaaaaaaagcacatacatttgttctatagtatggaaaagaaaactgcaaaaatggaagttaagaaatgtttaattaaatgtctgtataacaacatggtttgccaatttcagccatggttaaatttagtatttattcaaatattagtgattttgaaagcaaattgtgggtcaggtatacttttgctgataaatcatagccaaccataacttaataagttgctcataggcaaatgtttttaaaaacaaattataaaaatcctttcaagtttttatagcaagaattatttttaatgtggactatgggtgcatattaatattttgaggtaggaatattaaaaaggaaaaatgcctagagctattcatgttatttaaaaaaatccctgtctgtgggtgactaatttcatgcattttttaaaaaagtcagcctaagtgaattcacatattatgcttattgtttaaccttctatttcctaatattcattgtacattgcttaattaagtgttctgctgtttgtttgtttgtttgtttgtttgtttgtttttgagacagagtctcactctgttgcccaggctggagtgcagtggtgcgatcttggctcactacaacctccacctcctgggttcaagcgattctcctgcctcagccacttgagtatctgggcttacaggcgtaacgtaccgcacccagctagtttttgtatttttagtagagatggggtttcgccatgttgttcaggctggtccggaacccccgacctccagtgatccaccctccttggcctcccaaagtgctaggattacagccatgagccactgcacctggccacatgttctgctttatatgaggatgcttaatctctaaacacacatcttagattagctccttggtgtaaaatggaaaatttatagatatagaaaggttttgggacgtgcaagtacttttttagctgttaatagttgaagaccattcaatgagctttgattatagttaagctgaatgacaaagctagaatttgcccattaatttaccctacaaaatgcagttattttacaaaatttttcctttcaccaagtttattgctttctgtaaaaagcttctgctactgctgctcaccctgaaatgaagatgtgagaagaagggcctgaaccctgccctttgaagagttgactggcttgcccagtgagagctgtaacatgcagtggtgtgtgaatagggagactcatgccatggacccaaccattctgattacttgacttaaattccacctcttctgtgaaaatgtctctgtgtccccaagcctgggttaggtgctcttcctagatgtacccgttggaactctatagtctctcagcatagcacactgttggtttcttttcattgtttgactatcctcaaaactgtaaactcttagaagagtgactgtcttgttcatcattgtctacctagagcctagcagaatccccagcatgtagtacctgtacaggtatttctgggtaatatgacaaatgcaagacttgcaaataaaaaatctttcaaaggcaaatttactggtgtcatttaagagtttaaaaataaaactattttatgagatggaaaatgtgaagatctttaattttctagggttatgaagaaattttagaaaaaatggctttgtgtttttgaaatggtgttaaggctaatatccttttagttatcacaatttataataagaaaattttcatttgagataaagcaagcagataactcacagtagacttaaaaacgcctttgttcttggttgggtgcagtggttcatgcccgtaatcccagcactttgggaggctgaggcaggtggattacttgagttcgggagtttgagaccagcctggccaacatggcgaaatcctgtctctacaaaaaatacaaaaattagccgggtgtggtggtgcatgtctgtaatcccagctactcaggaggctgaggcaggagaattttttgagcctgggaggcggaggttgccatgagccgagattgtgccactgtactccagcctgagcgacagagtgagtgagactctaactcaaaaaacagaaacaaaaacaaaaacccacctttgttcttgaacaaatttgttatttgttcttgaaccattatctctaaaagtgtttagttgtttatgacagtccatgaaaaaagtgccagaataaaatgcattgtagtggatgctgttggtgccctgattggaccccctttacttggcaggtgaactacatcaccagctgctatggtgctgactgctaaccactcataattgtccccttctccagataattgcccttggaaatgttatcttggccctcagtcaacgactaactgatttggttcatagactcttatgtgagtcaactctgacgtgtaattcacactccagagctccccatgggatcaggcagaagtttagataactcactactctacctaacctcttccctgtccctaccctgcttccttcactgccttacaggtttcttccaagaaccctcctgcaataagtcaaatacacaaggatctgggtctgcttctaggatcctaaccttaagcttttactaaaatgaaatttcagcttctgagagtaggatgactcctgatgtcttttcgacttgcttgcagagggttcaagagcaaggagaatgacaccagcattcccctcaccctatacatttccagactcattctacctgtgattcacgcttatttcttcgatgtgataagtagagcaggaacctcaatcttattcaaattaagtatttattagtgcaatacttttttttttttttgagatggagtcttgctttgtcacccactggagtgcagtggtgcaatcttggctcactgcaacctccacctcccaggttcaagtgattctcatgcctcagcctcccaagtagctgggattacaggcatgagccaccacgcctggctaagttttgtattttagtagagacagggtttcaccatgttggccaggctggtctcgaactcctgacctcaggtcatctgcccgcctcggcctcccaaagtgctgagattacaggcatgagccactgcacctggccatgtgcagtacctattttgtgtcagtaatgtgttaagaaagttttaggaatatagcgatgaataaaacataattttctgccctcgaaagaagaagagaaagaagaaattccaacttttgaggatattgtttaggtagaatttaaagcaaacaaacatcttatccagtctctgctttatttgtttttttgagacagggtctcactctatcacccagactggagtgcagtggtgtgatcacagctcactgaagtttcaaccttccgggctcaagcaatcctccagagtagctgggactacaggcacaagccaccaggcagagcaatttttttttaatttttttttttttggtagagataggggtgtctttatgttgcccaggctagtcttgaactcctgggctcaagcgatccttttgcctcagcctcccaacatgctgggattacaggcatgagccaccacacccagctgcagcctccacttttgatttgatcacactgaagcactagccctttcaccaaattaagctcatatgtaggagcaacatgtcatccttccagatgatatgcacatgatgtccataaatcaagtgaattcaaacctcttcacaagagtatccttccagggtcatagatgagagcactgacagacttgttttttaaactccttctcacatgattgggagaggggataaatgtgttatttcctgctgttcttccttggaacaatgcaattttctgcagtttcttttctgcagcttgcctccttctgtgaaaaagattcccctcacttgtttttggaatgtttcccctctggacacagccgagcagagacttggggagaactccgcagtaatgctgcagttttggttgctgggcagttgtgttggccacgggtcctctgtgggctcacgcataggtgcatgttcactccctatccagtgctggaagagttttaaagcaggaagcaaaagatgcctttttggaaatgtcttcttaagttagtgaatatgtgcccagggtccatttttctaagaacttcatctgagaaataagaatatattattataaacttataaacttattttaaaaaatgagttaggttttctttcaactctctcttggccccaggttttctcactagtaatatgaaggagttagaatggatgagttctaatgtcctattcatccgtcacatactctgattgctgtttgcccttcttcttggacaggctacatttaaactccatttaacataatttattggctgggtgcaatgctcatgcctttaatcccagcactctggggagttaaggcgtgcagactacttgagcctaggagtccgagaccagcctgagcaatgtgacaaaaccccatctctacaaaacatacaaaaattagccaggcatagtagcacatgcctatagtcccagccatgtgggaggctgaggtgggtggatttcttgcatccaggaggtcaaggctgaggtgagtcatgattgtgccactgcactccagcctgggtgacagagcaagactgtctcaaaaaaaataaaatagtttatttcaacttatatcagcattaatttgtattgtttagttagcaggtctaaggacctgtgtatgtgtgtgtgcaaagtaatctgtatcagggtttatcaatactaatatttttgagtgaagtgaaagaatataagtagtagtaaaaataaaaatactaatatatttcaggattggacagcaattctaataaacaaccctaaaatctcagtggtttaatgcaataaaatgaaatagaatgaaagttcattgcttgttcacaatccagagctgtcagcaagggtgggtggaggagtgggggttagggggtctctgctccacacagtcatttaggaactcagggtctttccatcttggaacactctcatcttcaacatttggcctttaagattgctccagagtgagaaaataaagtgtaaaatcacccactggaaatttttatgagctaaaaactcatactagccccttgaaactagccacttttcattggccagaactcagccatgtggctccagcataattgcaaagagggtgcaaaacagctaagcaatgtgcctaggcaggaaaggaaaaccacaaatattggtgagcccacgcatcccctgccttatctggtttctgacttgctggcattctgaggttgagagtgtggcaaagggctttgctgaccagtgtttctcctccacactcgtcctacccctgtgtattattattctcacgctgctaataaagacatacccgagactgggtaatttataaaggaaagaggtttaattggcttacagtttcacatggctggggagacctcacaatcatggcagaaggcaaaagaggaggaaagtgacatcttaaatgacggcaggcaagagagcatgtgcaggggaaccccatttataaaaccatcagatcttgtgagacttgttcacaatcatgagaacatcatgggaaagaccagcccctatgattcagttacctcccactgcgtcactctcatgacgtgggaattatgggagctacaatttaagagagatttgggtggggacacagccaaaccatatcaccctgcctttgtgccacctctcacactctcccaactcacacaccgtttcctttccctcggccttatcattgctgtcttttatttgacaccttgaggtagggagacataatgtgagtctggacagacctaaaagatggattttctgtcgggtgtggtggctcatgcctgtaatcccagcactttgggaggccgaggcaggcagatcacctgaggttgggagttcgagacgagtctgacgaacatggagaaaccccatctctactaaaaatacgaaattagccagtcgtggtggtgcatggctgtcatcccacctacttcggaggctgagacaggagaattgcttgaacctgggagggggaagttgcgatgagccaagatcgtgccattgcactccagcctgggcaacaagagcaaaactctgtctcacaaaaaaaaaaaaaaaaaaaaaaggatggattttcatggtaaaataagtggaaaagatggctcactggaaaagtggcaagaatgtcagaaagggaattgggagagtctgcaaagatgccaggagaagtttgagttggtttgagatggaaaataattattccaatgggacaccaattccgtggtgaaaattaagtttctccctatagtaacaggtggtgtttggaaaaaattttacgaaattttatgaatatgataaaattcagattgaagattctctcttaaattaactgctttggaaaggccagcattcacaattaagagctataaacatttaggagtaagtcatcccagcttttgtagtttttttaacacttaacataaaaataacacacatacctatatattctataattgaggaagatgtttttataaagaacatcacttgctttctgccttaaatccttccaccagggaatgaggagcaaacacgtgctcatttgtaagcccacgatgacactcagtaaatctgtccagtagtcaaagctcaatcattgccacacgaaatcctcccaaatctcctccagcttactcctgaagttgcagactttccgatattgtagtactcctaatgaaagacagatccctctgatagagattccctgcccaagactctcttaggtcatgaaagatactaattcatcttttcatctggtccttaatgaccaataatggatcctctttccatttgttaggcttagtttagtaaaagcactttttggaagcaagttcctgtttaagtttgtaagtggcatttcttacgcctaaaatttttgcactggacaatttaatggagccaacagtcacaaaaccttgccaaaaacaatttccatgaagagtttaaaggcagtgaatccttggtagtccagagcaagcagcaggacttgacccccaaacatgaaaaggaactaaatgagcccattctgaaagccatataaagcaaccacttgctgacatgctgtgtttcttttcgccagggccttccgggaaaggatggatcctcgggacctccaggaccaccagggccaatagtaagcctttccagaaactactgggacatactctgttttaaagcacttcatttcttttgagaggttttcttttgccagatcttttaccagcagccgtcttcactatagtgtgacaactcatcccttgatagagaactctccctaaaactttttagaaagataatatacccatattgcccaattattctatctctgagctattttgccagaagatcacctgcattgacttagcttttattaaatcacaactaaggcttgaatttgaaagaaccacacctgatatatagtgaggagactaaaaaaaagtcttccctccgtttttgggagttgggaacaggaatgaggtcctggtgatgagggggagggaagctatcatggtgtgtatttgttactcttgcttaaaagttggctgtcattgatgagaatgtgtgattcctgactttgttccattttcctacctctcttctagggcattcctggcacccctggagtcccagggatcacaggaagcatgggaccgcaaggcgccctgggaccacctgtgagtatgcagcggtagctgctcagaatgtaggcccagtcatcacgtttatttatgtgtttaaatttaccagcctttctgttagtcagaaatgtttattcagcactggactctatggaaattcataaaggaaattggaaaagcttctaggataaagatgaagatcagattatgcatatgtcatggctgaagataaatggtcctaaaagggaataatctgtcatgcttttgcttatatgtttctattgcttgctattctgtatttggctaagcaaactcaatatcatctctccagagattgggtacaacagctacgtgttaatcaagctgggttcccaaagggaaaaatagaaagcttgggaaattctaggtttaatgaacgtgacattagatttttctcttccaaattctacaagacagaatttaccagtaaaacacacactcacacataagtgagaggtgttataagtgaaaacataatgaacagaattctttgcctctgattgttgtacttctagtctcttaggttggtgtttaaatgtgatcaatgggagaggaagggataaggtgaaagaaaaacaaatgaacacatctgggcctgtttcttcatctgtaaaatgaggtcatcatattacatggcctctggagacatgcttggcatcttctggtgacatgcaagttgttccttctaggtttagatgttagtcagcattctgatatttatctgtgaattgctaagtctacatccataaactgaaacattgaaaaatgcaaagatgtgtacaactgcaaacacactaagaatgtgtggagcagtgaaatccaatggatgaggatggaagcatctagtgaattagattcctgttaccacttaacaaattgccacaatctcagtggcttaaaacatcacaaatttgttatcttacagttccgcaggtcagaagtctggcgcagatctcactgagttaaagggaaggtgtcggtatttcctttctggaggctagaggagagaatctctttcctggccttttctagctgctaaaggcctcccgtagtccttggctcatgtccacctgcatcttcaaagccagcaatgttgcatctctctggcctttttctgccgtagtcacttctctctgacaacagccaggaaaggttctcttcaggacctatgtgattacattcaggccactgggataatcatagataatctccctagataattcccagatccttaactaagtcacatttgcaaattgccttttgccacataaggtaacatattcacaggttctggggattagggcaaagaagtttgaagggcctttttttctgcctaccatagtaaacaagatgtaacagaaatgttggttctcattcagaaagtggcctctcttcgtctagcaacccagatagtcttgttcctcttattcttgaaactcattttaataaaattatttcatcctcagaatccttttctgggccatgattcatgtgaggcatatgtaggtacacaaacccatacaggttatgcacatacaaaatgcatcttgattttagcaaacacatcctaatttgcacattcaaataaatgctatccttagtaatcactttatacagctgtatctttattccaactacaatgtcattcaaaatacaaaatacttttagatctcttctttttatatcaacctagtaatgggtcacagaagaaaatctgattgctttatcttcacacatctttcttttaattcaaaaatgtgttgcaaagtatgatcctgcacctagaaacatatactgaaacccacatgtgtgaacacatgaaaaaatgcatgcgttcacacacaaaaacacacacacacacacacacacacacacacacacctgtcttcattctttcactgcaagcttatctattcgtttgattctaagctgtttcataccagaaaagaaacttaaaaacatactgtctggtatttggcttcagcctgcttcccagaatgtgctcctgggaaccagagttttagaatacatccacagtgccagacagtaaagggtcctggtcaaagaagtggccctgacatgaccctaactagttgtgtaagccacatgcacagaaactgcatgcctaatctgtttctcagaaattcatgggaagttttaggacatgaaaggctttgaggcatcccgaagtgaaattagaaaacacccaaaactagtttaatttggttagacaataaacgtatttgtgcatgaggttcttattcttactagcatctcctagaactagtttctcctaacccaggctaggaaaaagcaaggtatagagtgatcctgacccaagagggagggaatggggaagaaggaaggaaagaaatgcaggctctgagagctttgggagagttgacatggggcgtggagagctagagagagacctggaatcattgagtaactatgatagcaccctgctcaccgatctggcctttggtggctctggattagactctaaatatagtatctacataaataccaataaaattttcccacaaataaaacacttgttcataatgttatttttgttatgaatcagcagaaaggggcccttgaaagcagcaggaggggcccttgtgccattggtgctttgatcagaggcagaaaccatttggcctattagcatcaggtaggaataccacagctggcttgggcatttcctctcaaaagcaagttgctctctgaactgtccagcccagacttttttgggcccactggctcccagatgcttgctggcggccagactggcatgactgtgacagcaggctccgtgtcatggtgttaaggcctggattgatttcccatggatgtctgtctaggaaggcatgagggaaagggaccaagagggacaggctgcaccgctgaaaatagcaacatgtttcctacagtgggtgccagaaaggcttgcttttgtgcagtctgccttcagctgccggctccctagggcagaatgtacattgctgctgctgaggtcctaattccgatctaagttttaagcactggcttaggtacggttcctccactgcagttgttagagagtgataaagcacacgaacgaaggagctgctcactgctggggccatgtgttcagccaggtagacaggtccagggttacatcattgaaagagtattgcattagaagtcaggatacctgggtccttgatgtagccctgacatgactcaaagtagctgtgaaagccacatcagttgcacaaatcatctagccttttggaatgtcagtttcctaattcattcatttaaaatatttagggaatgagcacaatacatgtaagattacatggtggggaggggttgtgagggatacaaaagatctcaagacatttttcaatactcttgagaaatccagagagaatgatgtttttatataagaagctgtaataaagggcagaaagtgtgaaatgccttaaggcaaagacaagcaaattgctctgaaagctccattaagagagagacccctaagctgaggggtgggagtagcggcttcaggagcatttagatgagatcttagaatatgggtaggaacctaacccacaaagacagaaagattgcatcacttaggtggcagttgcagaaaaacataaggcaaacacagagcacccctgtctctgtacattttaatatttttcaattctttctctagttccatcacgactactgcagttttatttcaggccctgcttgctactcacaaggactatcccaagaggctctcattggccccctggtctctgctttagccctggtctagtccattccccagctgccagaacatcttttagtgcaactccctcgtgtcactgtctggcttcaatctcttccctacccctggaggaaggagcccagttgttcagcagagagctcgtggccctttaggatgggcccctactttcctttccaacttggattaccatcctcccttcacttggagttcagtcacacattatttaaagttcctgaaatatatgccataccatttcacatgtttgtctttggggatgctaacaacctacaggatgctctttgggatgctcttttgccttactgggctgcattctttttcaccacttggtgagctcccggcaaatccttctttaaggctgcacatctcctgtgtaaagccacctgtcccttcgcaggctgttaggtactgcatttcaactattgatgtttgtctctccactaaaaggataattccttcaggatagaaattctatcatattcttgtgcagagtcctagaccccagctcagtgtctaacacatagagagtacttaatatgtatttattaaaagaaaaaaagaaggctgggtggggtggctcatgcctgtaatcccagcactttgggaggccaaggcaggtgaatcacctgaggtcaggagtttgagaccaccctggccaacatggtgaaacctggtctctactgaaaaagaaatacaaaaattagctgggcgtggtggtgggtgcttgtaatcccagctactcaggaagctgaaagacgagaatcgcttaaacccgggaggcagaggttgcagtgagccgagatcataccactgcactccagcctgggcgacaaagcaagactctgtctcaaaattaaaaaaaaaaaaaaaaagaaaaaagaaaaaagaaaaaaaagaaggtacgtttatattctagttaggctgatgttcagaggcatattagaagaatattcttatagattaggggtcaggtcatggaagacgtttcaagccagcctaagatgttttgactctgtttaacagacatctttaatatgtaggacttgaaccacaagatcattcctcttccttccagcgctaaaattcggtgaatctatgaatgtagctgctgtattttcttttctttacatttcgagtgctcctaaaattaaaggaaagtgtgccactttttcctgcctacatctgcagggaatatgtgttttccctcaaagcatactttggtggagttatgggccttcacttgctcaggaatttttattttgtttttgttttactttgtaaaaatcaaaggaacgatgtcagagaagttggaataaaaaataatttcttgccatagagatatttcattaaaaagatctttcactgagactgcctagctgcatcctttggctacttaataaccagcatcatgagactgagtttgaggaatttcaagcccaattaaacacatccgtccctacataccaaaaggtgccaacagctgatgctctccatttaccatgtcaatcaggtttgcactataattgtagtctctagatttgagacattttcaaacaagccagtttaataaatgatagcaagaatagcaagaaaactgtcaaaaaatgtattggtgcagaaataaaattattcaagataaaatagattttaaaaaaacgactcaagttgcaccctaattctgaattactagagttagtccttaggcatggtatgtttgcttgttttgcttattttaattgagaaaatattatcttccctggaatagaagacatgagctggcagaattgctaagcagggttctctttcaacagagtggtagagtgtactcgggatgtgcatggattctggagcccacaatttgggttcaggtccctggttttttcacttccttattgcctggccttgagcaagtgacaagacctcttagtgcctcattttccatatctggaaaataggaataatatagggttgttataaagaataaatgagttaatcttataggagtattataagcactaaataagttaatcttataggagtattgtaagcactaaataagttaatcttataggagtgttataagaattaaatgaattaatcctgcagagctgttataaggtttagctgagttaacatgctaagaacaaggacagtgcttggaacatggtaaagcagcctacgtatcagctattagtatttagagtgtcataatgtattaaaatatggaatatttattatttgctgatttttttgttttgcctctaatatttgacaaactgtttccgttaaggattatttagtggtaagatggtagttcttttctccagttggtccttccagtaaacactaatgtctctttagagatctgtccatttgtgaagcctaagaaatgagggaagaaggcacagccagtacatttatttccaaaaagaatttgggctggggcaggggtgtgctatgtaaatcttacttttgcaaaaaaaattttatgatggaacgcctcccaggttcaagtgattctcctgcctcagcctcccgagtagctgggactacaggcgtgtgccaccacaggcacgcgccaccacgcccggctaatttttgtatttttagtagagatggggtttcaccatattggtcaggctgatcttgaactcctgacctcgtggtctgcccgacttgtgatcaaggcctttgcgatcctcccaaagtgttgggattacaggcgtgagccaccgcgccctgccatcttctgtcttttttacagtcagggtagttgaaatgaagcacaaattggcttgccattcaaacttgaagtgaaattcagccacactacatcctcagaaggatcctttgtgaggatcttctttctctgtagaggttggaatcctttcctcggaagcccagactttgtatttttcatcaatttctgtttcctgtgctccctgcttctgaataacgaccatatcatgagagaataacgtgttagactgataagggaatcccagagatcacttcatttagtggcctcatcttacaaagaaactcagagagttaacccagcttgcaggtccaatgtcctacattctttccaaagtattagcataaaaaaattttaaacacacacaaaatggaaagaattttgagtgaacaccacacccatatatccaacactaagattctaacatcatgtttaaaaaaaaaaagtgttggccaggtgcagtggctcactcctgtaatcccagcactttggtaggctgaagtgggcagatcacttgaggttcaagaatttgaaaccatcctggccaccatggtgaaaccccgtctctactaaaaatacaaaaattagccggatgtggtggcacgcacctgtagtctcagctactcaggaggctgaggcaggagaatcacttgaacccaggagccagaggctgcagtgagctgagatcgtgccactgcactccagtctgggagatagagggagactgcgtctcaaaaaaaaaaaaaaaaaaaaagtgtgtgggtgtgtatgtgtgtgtatgtggtgtatgtttgtgagtgagtgagtgtgtgtgtgtgtgtgtgtgtgtgtattgaatagacatagcagggcaagggaggagaggagagaagatagagccagggtgggctgcttatatctgcactggagagtcaatcatgcatttctcttcctttccaattccatcttcagtgacagcacatttgtagcttgaaatcagctgtgatagaaacacttacacctccaaaatcagcaagcactacaagtcagggcattttctttttctgggaagccagtttacctgcacactgtgggatgaaaccagaagtttgaatctgggcaactggtcactgactacagattttgaagaagataccgagtttggcttgggacctgtttgaaataacaactggaaacagtctgacaacgtggcaaattccattaatgaattccattcactctccttttagtcgagactataaaaatgttgttcaatgaacattgcctcagagttgaaacaaaatatgaaatccttctgaagacacgtgttttgcattagatgtatgatttttttggaggaaccctgaaaatgccatttttaaagtagatgcgctttaataacggcaaggtttcttatgggtgaaagagtagctaagccacataataaaataataaatcaattgagaagtcacataaatgtgagctcccatattggggagaattagggagaattgtgtggcatcgtgctgcacagaaatcagagtgaagctctgggatttcactaatctcatctctgacttgaactcctaaattgagaggtgatcttttctatccttttggagatattcctttaaaaactgaaacaatttaactattcatcagagatttgtgaaataaattatgaaggatcctcagtagaatacagtacatagagtggcgtttagggtggaaagatgcaaaggacctacacagtgaaaatatgtgttacaaagcaatattattgctgcacgattccaattttgtggccaaaatataccatgtctctgcataaaaaagctgaaagggtagaatgcttaacagagctttttatgtttggtgtgcgtactggttgctgtttattttctgttgttgtgtaatgatttttgctgcagaattactggtgctaagaaaaatgtcttaataaaataagaaaagatgcatgattatcactcttagctaagtgcaatatcataagtaacttgacaattttccatttatacagggtgtccctggagcaaagggggaacgaggagagcgggtaagtatcctgtggctctgctttctggccccagcttgttgcaccccttccattgcataagcctgataaaggatcatcatttaataccattaatattcattgcaattgtaccagtctctgtttctccctttccccaattcattagactgtggccatattttccagacataaaatccctgtgggctgggagtcaggagagctagtttctaattgcatatctgctaccatccaggtcaatgaacttgggctcttttctttaaggataaaatggagagaatcaccgtcatataatttacaaagtgggtttgatgagaacgttatataatagatgtgaaaaggcttcagaaaagtaaaaactctatacaagtgacaagtggcagcatggcactcctgggctttttgatgctcccaggttcacacccaggaagacaatggcaggcatagaatcaaagaactggcccccaaactgaagtcagcttaatttaagggtcgtctctctcctttcagcaattgtgcagctgctaatataattgtgccattggctatagcagaaacagcagtggccttgggctcatccaattacctctgtgaaatcttgggccatgtgtttaatgctattcagctataaaatgggtttaacatctttcctctgggttgctattagtattaaatgagccactgctcgagaaagtgctgtattttataagctctaaagagctatatatcacgtgttaaatatatatgggtttgtttcaaaactattaaattttttagaataggggaccagaaatacttactagtgcttgttaatctaataaggactcccaggaaccttgaaccatgaatatcaaattgcttaccccttctctgcatgcaccgtggtggtcaaacccacctgttgctaggggccaaagatccctgatgggaacaatggggcaagtcagatccacatcctggaagtcctggtagtgtggctgggcttgtagctgagtcaggagtatgctttttttctcatccagggtgacctgcagtctcaagccatggtgagatcagtggcgcgtcaagtatgcgaacagctcatccagagtaagtatgtaatggttacggaggatgttccccataacaaactctcatccaaaagagagtttcttttcccatgagcgtaccactaaggaaaactctaaagcattgtctttgtgcagacacataagctttacagatgaccatcactgacccatcaaagagatcactgcagattaccctagagctctacatcgatggtacaaaagccaaattcctttgtgtcattggtccaagaactgcctgtttgcccatgtaaatttaacttgactgcccagatcagatcttctattcctttctcatctttccaggtgggtaggattttttctcaagtgttcagcacttgaaagctgccagactacatcttcagaagctgcctcagaaagacaatttatggtgttgatttttattaacttgcaagatttaaatgaatatttccttcttatccatttcacatccattaccttctggctagcctaaggtcttctcatttatttcttaagatgtttatgaaaatacaaacacacacatgaacaggcttgctctgacgtttgatatgatattatacttgggctttgtgccaaaaattacatcataacaaacttgatatgacgcctgtcccatttcttcattttacttgagctttttgatagcactgtatttccctgcccatttgcttagatcccaccacttttgcacgtttctgctctgcccactgattatatattttatcacagtaatctaatcagatggttactagtgtgggcccttcgctttgccagtaatttgttcagttccaggaatatctgaggccaagcagaggtgaactatctctctcaaccccacccagctctcgcctagctctgctgtccagccctctcacccaatagcacccccacttccagggctgacattacccaggtgggtacctcattggcttggggttatatttattttaactcaagaaagtttgggagttaggccaggaagccctgcaatatctaagacagctttgttggctaagtccaaaattccatctttaattctgagataaatccaaatctcaccctggaggaggcatggagttgagatctgcacaggcttggaagagttttcattaaggcaaaaacatcagggcaagaggagtatgaagataccaacttcagacacagtagtcatgctccctgtattttaacgttatttaattttctgttatattgcccaaactatgtgtgtgtctgtgacagagaatttaccagttaaatataactgtttaagtttaatggcaaaataggatctttaaaaatacattataaaagagaaattgaacattaatcattttgtactgacatattgtaaataacctgtatcttgaattgttttttagatttctgatttcaagtgtacaatgtaaatgagcagatcattattttcagaaaacttaaggcttaaatcttactatgactcactgaccactacccaagaaagatctcacaatacttgctgtcttattctactgtagaataaaaatcatgtgtaaatatctgattatttaaagcatgccctaaaaatcaagggttcaaaatcaattttttctccttacgaattctcagagtcttgtgattgacttctaggaagtagaagtcatcaagggattggttacacagtaaagcttaaacaagtctataaaatagcaaggccctgcctgtcaatatactagaaggaaatcaaaaaggttgtatgcaactcgataagccaggcccagcctactcagaggctgtatttctggtacctcaaccatcttgccttacactacttcagttttctctgggatccttattgtattccttcagctgccactcagaactggatttatcagttagcaaataattcctcacaagctcacttctctggtttttagttcacagttgatcagaattatgctaggaagagttacatgggaaattatgcaaggccaaagtgatgacagctgggaaaatgatgatggacagtccccatgtcaaaggcagaaactgaaaaagcaaatgaggaaatgtctcacctgcccaggcaacaatggacgtgcctactaataacattgagtcatcaggagcggatccctacttacagtgacaatccaatgcttaaggaaagaatgcactgaatgtattttagagtgaattccttgaagaaattgttactatttttatttagttttaaatgtttcaaaatggataaataacagtaaactagaaaattcacttatgttgggaaaactcctctcctaatgatgttggaaaaatgagacatcatggtatcaagtactttatacttctgattagtaacatatatctgtatatatattttccatacataactgagttaagggattgtgggagagagtgccagattttttaaaaatataaagctagtgggagtttctgcagctgagacccaagtaaaggttcctaaaaaaaggcttgatgaccaagagatgagttgagacagagcacttgtctggggatttgtgagcaagagggtggggaggctttgtgcgttttagaaaagaaaaataacttggggagtaattgctagagaaatggcagctgggtgagggtctaggggtcagataaatgttgagggtaaagatgaaatttacaacttctgctcagtgatgtttattgagatgctgacatgagctgcagaattccaaacacatgagatgccatttgacaacagtccagcccttaatatcatccagagtaaaacgtaaaaaaatgttaagctggaaatcaacatatttcaaaggggtgtgatttttcccttggtgggtatctaacagaattgtttgcagccttaacaaatgacacccctggtcctctctttccttgtgtgacagttcactgaatgctgtctttatgcttcatacctcaggtcacatggccaggtacactgccatcctcaaccagattcccagccactcctcatccatccggactgtccaagggcctcctggggagcctgggaggccaggctcacctggagcccctggtgaacaaggacccccaggcacaccaggcttccccggaaatgcaggcgtgccagggaccccaggagaacgaggtaagctgggccccttctctcagaggaactcctctgagttgggtgcagggaagcagaacattatagtggttcttatacaaggataaagtctgaaacaatggacttaaattaattctgccccatctattcttcagtttcttgtttatttatctctgagattgagaaaattgagcaatctgccaagtggttatctagagccatatctacttatatgaaagaggaaggttagaacccccaaatcacttctgagagtatttgagctaatgaaagaaagataacccctctagatggatgaagtcaaaaagggtgccccttccaggttgaagaattggaaaatgatgccgccctctgaccaaacatggcatcacaccaatgtcaaggcaagcagagaactcactctggtgatttgctggtgctttatttgtgtggtgcccagactgggcaatagtcagtggcagtcctgagaagagtcatgaattgtatcagcatatggttcacatgttcctgtatagaccatgtcagctctaaacttcaaattaaaatactgtctgcggctcatcttcctattatatcagacaacattttatttaatagtttcatgggccaatgttttgcctttcccactaaagtttccttaaaacagagattctacttagccttttcttccacatctacaggtcttagaagtatggtgtaatacaataataagactcttttgactgaatctatagtcgactaagatattccattccagaagcaggtaaaggagatgtgggaagtcagggttgcatgttaaccgtgaagaaagtgatgggaaagagagacaactcatcagagtattttctaagatacattttgtagaacatagacctggggaaaagctaacttttacctatctgctctgtgaggcatattagttttgtgggatgggtaggatatattccttttataaaatttgatttaaaatacagattacaaaaactatttcatatttattttgactcatgctaacaggccttgtgtatttctgcctctgcacttttgtacacattgttttccctctttggaaatgtcctttccttcctttgtcttccatacatcttactcttagttcaaggctcagctgtcttatgcatgaaattgttattgatcaccccagaacccaaatgtctccgcccccatgaacacctgatgcccttactgtcttttctttctgttttagcactcatcaggcattagcgaacagccaggttgttgagagcagggattggttctgaattgctttgcacaatgctttgcacttaataggtacttactagatagttgttgctttaattgtgacccagttctgatttttctttctgaaagtttttccctgtgtcagggcacaaaatcagcagatatagaaaatggcatcattccctcacaacacaccaaagatctggcagcctggaatgtggccccctctgtcagcagggcatcctctgctgctgtcaataatggagaaactgtgactcagtgagcacagagccagcacctgagtcattcccagcaagtcataagttgtctttgttctttttggaagtcttagccccgttcttgccagaccgagtctctcctgctctgcaagtacacttgaatgattagaccacagaaaaatcacccaaggattctcaaagggcagcccagacgacctttggaaatatgaatttccatgatgtaattttcttacatacatattgatatatattctaaagagtacagtagacaagcagaatcctatatttcacaaatgcataaaagatgacagtaagacagaaagtgagaaatgccctttgagcatggggaaaggtgattttagttgatgaccacttgaagggtgtgattttgcgatgactgttataggtcagggcttataggccagcatccaaggggctcctcattcccggcaaagttatttcagctgcagcttggatttgctgctgcaaggtaggcagtgatgtttgggatccaaatatccaggaaagataaagagaggaaaggcctgtctttccactaagtcaaaacaataaaatttaaaaactgaagtcttcagctatcttttctcttctcattttctataaaaggaagcatatgaagatattgaagtaaggccaaaaaggctcaaagtcagccaacatcaagacttgaaataagagccagagactgtgttgtttttttctgctgtataaaatatgattatcatcattctggataaaataatgttataaggacacaatattgtaatgagtaaaaataagtactattaccaggcagtgtatgtagcacataatgaactacaaaagcaagattatgagaaatatggctgttgagcattctggcatgaacactgaaatgaggctcactttctgcttaggcttcctatgagcctcataggagtcttcctaaaaaaattcactactgggtatctacccagaggaaaagaagtcattatacaaaaaagatatttgcatatgcatgtttatagcagcacaattcgcaagtgcaaaaacgtggaaccaacccaaatgcccatcaatcaatgagtggataaagaaactgtggtgtatatatatatatgaagcatatataaagcatatatatatgtatatatatgaagcatatataaagcatatatatatgtatatatatgaagcatatataaagcatatatatatgtatatatatgaagcatatataaagcatatatatatatatatatgtatatgattgaatactactcagccataaaaaggaatgaattaatggcattcacagtaacccagatgagattggagacgagcattctaagtgaattgactcaggaatggaaaaccaaacaccatatattctcactcataagtaggagctaagctatgaggatgcaaaggcataagaatgatacaatggactttggggactcagggggaaagggtgggaagtgggtgagggataaaagtctacaaatagggtatagtgtatactgctcaggtgatgggtgcacaaaaatctcacaaatccccactaatgaacttatgtaaccaaacaccacctgttccccaataacctatggaaaaaaattttgtttttttaaattcacaactccattcagtttggatagtttttcatcagaagtgcccactctaacttttctattctagtttttcaaacttttaaaaatgtgatacacagtaaaaaatacatttgacatcatgatgcaatattgcttatgcatatgcatgcatgcaaatgtatataactgggacaaaagaaattatttttacccttcctgttattccctgttttcttcttttgttaaaagaacgaggagagaccttgggtttcattaccttagtttgaaaaacactataccctaatgtccctgtctgacagctttgaagggagcagtggttctcccagcacgcagctggagatctgagaaccggcagactgcctcctcaagtgggtccctgacccctgaccccgagcaggctaactgggaggcaccccccagcaggggcacactgaaacctcacatggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaagctctgaaaatcagagtgcctctcctcctccaagggaacgcagctcctcaccagcaacagaacaaagctgggtggagaatgactttgacgagctgagagaagaaggcttcagacgatcaaattactctgagctacgggaggacattcaaaccaaaggcaaagaagttgaaaactttgaaaaaaatttagaaaaatgtataactagaataaccaatacagagaagtgcttaaaggagctgatggagctgaaaaccaaggctcgagaactacgtgaagaatgcagaagcctcgggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacatctgattggtttacctgaaagtgatggggagaatggaaccaagttggaaaacactctgcaggatattatccaggagaacttccccaatctagcaaggcaggccaatgttcagattcaggaaatacagagaacgctacaaagatactcctcgagaagagcaactccaagacacataattgtcagattcaccaaagttgaaatgaaggaaaaaatgttaagggcagccagagagaaaggtcgggttacactcaaagggaagcccatcagactaacagcggatctctcggcagaaaccctacaagccagaagagagtgggggccaatattcaacattcttaaagaaaagaattttcaacccagaatttcatatccagccaaactaagcttcctaagtgaaggagaaagaaaatactttacagacaagcaaatgctgagagattttgtcaccaccatgcctgccctaaaagagctcctgaaggaagcaataaacatggaaaggaacaaccggtaccagccgctgcaaaatcatgccaaaatgtaaagaccatcaagactaggaagaaactgcatcaactaacgagcaaaatcaccagctaacatcataatgacaggatcaagttcacacataacaatattaactttaaatgtaaatggactaaatgctccaattaaaagacacagactggcaaattggataaagagtcaagacccatcagtgtgctgtattcaggaaacccatctcacgtgcagagacatacataggctcaaaataaaaggatggaggaagatctaccaagccaatggaaaacaaaaaaaggcaggggttgcaatcctagtctctgataaaacagactttaaaccatcaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagttcacaaggatacccaggaattgaactcagctctgcaccaagcggacctaatagacatctacagaactctccaccccaaatcaacagaatatacatttttttcagcaccacaccacacctattccaaaattgaccacatagttggaagtaaaactctcctcagcaaatgtaaaagaacagaaattacaacaaactatctctcagaccacagtgcaatcaaactagaactcaggattaagaatctcactcaaagccactcaactacatggaaactgaacaacctgctcctgaatgactactgggtacataacgaaatgaaggcagaaataaagatgttctttgaaaccaacaagaacaaagacacaacataccagaatctctgggatgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagacataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactaccaacacctctatgcaaataaactagaaaatctagaagaaatggataaattcctcgacacatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccggcatcattctgataccaaagccgggcagagacacaaccaaaaaagagaattttagaccaatatccttgatgaacattgatgcaaaaatcctcaataaaatactggcaaaacgaatccggcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacatatttcaaaataataagagctatctatgacaaacccacagccaacatcatactgaatgggcaaaaactggaagcattccctttgaaaactggcacaagacagggatgccctctctcaccactcctattcaacatagtgttggaagttctggccagggcaatgaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagctatagatcaatggaacagaacagagccctcagaaataacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaaccaccccatcaaaaagtgggcgaaggacatgaacagacacctctcaaaagaagacatttatgcagccaaaaaacacatgaaaaaatgctcatcatcactggccatcagagaaatgcaaatcaaaaccacaatgagataccatctcacaccagttagaatggtaatcattaaaaagtcaggaaacaacaggtgctggagaggatgtggagaaataggaacacttttacactgttggtggaactgtaaactagttcaaccattgtggaattcggtgtggcgattcctcaggaatctagaactggagataccatttgacccagccatcccattactgggtatatacccaaaggactataaatcatgctgctataaagacacatgcacatgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaaaaaaaaaaaaagaaaaacactatccccatacaatgtctttgattaaccccatctttgtcagagaaatggcaaagaatatgcatttttagagagcagaagaaaaattatggattttcctttcatgttcgcaatgtgatgtacatggcttttcatgacttttcttattatctaaaagaagattgcacttttgctccatctgattgtctctctcttcagtaaccctttgtctcctttaacttaaagtctttttcgtaagtttgtgtggaacagtttttagctatcctcttacacagattgtaatagagaattcttaaaatttaaggattctaagggatccagtggctaatgttgttcaagttttctatctgaagcttgaaatcccacttagatttttctaattattggcacttagcattgaagaggcctcatttgcataacatcatgctttatattaagcagcccgatttctcacctgcttttccttgtcacttgttcttctctgttaatttatgtcaaagaaaagctatttttccatgggatgctagttggttacctctccccattaaaccctgtactgtcttcatgtaaatggttctgtataacctggcttctcattatcctaaaattcagaagagaggaccagttctgaggttcctcttttgatcactgaaccgtgacaatccagtgcttgactggacaatccagtgattgactactatttgtcaattgcttttctgacgtcaactcactcttgagtcacatttttgggtgattccaaaccagatttcctcaattacagatcgttttctttttctgctctgtgcatatcattcccagatgattcatctgtttttgtttactcaatttatttaaatgttcattctctacactggtatcttgagccatatattaaacaagtcaacaataagtttgttggtttatagttcacaaaattaagtttctttattcagttgaaaagaattagaaaattcccctaatttcagtctttttttttttttctcttggagacagggtcttgctttgtcccccagactggattgcagtggtgtgatctcggatcttggctcactgcaacctccgccccccgggttcaagcaattctcctgcctcagcttcccaagtagctgggactacaggcaggcaccaccacacctggttaatttttgtatttttagtagagacggggtttcaccatgtaggccaggctagtctcgaactcctaacctcaactgacaacccccccaccccgcctcggcctcacaaagtgctgggattacaggcatgatccaccgcacccagcctgatttcagtctttatgcaactcctttagtttccataatcctcccgaaatttttgaatcagagaaaccatctgatcatctaactaacctaaccatctaaagattttcattttagattgtatagctggacagctggaatttatatctggtttatcttatagaataagtcagcaaatattaaatgcagtgtttatgtaaggtttttcagtttggcagatagataatactattatttatagcttttacttattaggctccaattgcatctgccaagtgttgcgctcagtcctgtacacactacctcatttgggtaaagtggaagacctggtttggataaggaaggaatatgaaagattgctgagggtacaaactggaagatggtaaatgctaagtgagttatatagaatataaatggtttcagaatgtaaaggaagatgtcagtcactgtggtctttgagaagaacgggtgccagcatttattaagcaactatgtgtcaattgctaagcatgttatgtgatgctcataaaaatcttatgagatcaggattagttccatgttaggtgaggaaactgaggctctgctagattgttaattgtccaaggtcacacagtggaacaataggggtctagaattcagatccagatatgtatgattccagaatgcctgtgcttgctggcttcgccacttaactagctatgtgatcttgactacttaagcttaaaacttaatctctgaaactccattcattcattcagtggtacttactgagcatctactacacttccagcttgtgctgggcattgatgacatggtggtaaacagggtatatatttcctgactttcatggcaccttactgttatgggagatggatattaagcaaacaacatatcaatcatttaatttcagttgtaattagtgctatgaaaaagtacaggataacatatcctgtactccagccaggagtacagagcactccagccaggtgaacagagcaagactctttctcaaaaaaaaaaaaatctgctgaaatacatgttgccttcttccttctttgattcaccatcccctgcctctcatttcttgaaagatgaatacagatagttttctctttcttttttccacccaggactcatctggttaagttcaatttgaatgcccttcagaacaagacctttatctgaaggtctagtggattgtgttttcctaatggtgtagtcattttaaggcattgacaaggattgctcttctttttcttctttgcatcatcttttattgattttttttattacaaagcgactctttacagtgatcatggctgcagaaagaaactcttatgtattagtgagctattgctgtgtaacaaattactttaaaacttagtggcttaaagcaacaaatatatatgatgtccatttttgtgggtcagggatttgagttttacgtgggtcctgttggctaagagtcttgcataaagttgcagtcaatatgtcatttaggaggccagtcatctgaaggctcgactggagctggtgcatctgtttccaagatggtgccatcacaggactgttggcaggagtctccagccctggctgatgattggcaggagggctcagttcctcactgtggagctcttcgtggggcatggttgagaattcattttcaacgcatagaggctgctttcctcagagccactgatccaagagagagagcagaggagttcccattatgattttgacatctagtctcagaagcccaagcttttactttcaccatattctatttgttagaagggagtcactaagcctggcccacactcaagtagagaggaattcggctgtacactttggagggaggcattttaaagattttgtcagtgtctgtttaaaccatcacactcttctaaattaaaacaagtccttctggctgtgcattgcgaagagggtgatgctctcatccacgaaatgattgccaagcagtatgacgtctacagtgctgaataatgaagggctcttgtgaagagttggcttaccctgcctgttttcaccacttatgtttgtttttctctcctgtattcttttaaatcatccaaatgtcagatgtaggttttcagagggaaacgcaagatgcagctgtgggcacctttaaaaacagtagcaattattgggaaaaatgtttttgaagactactaataccttttgtgttcctgtttctgaaattagtcataattagaacaaaatccattttcaaaccaaacacaaagaacgagagaaaaaaagccattgacaaattaaaattaccattaaattatgttcccaccctttataattagtaaaatatgactgttacagtaataataagctataactagtgttttgtcttgtttttgccatggaagctaatatcattgtttctgtagataaaaaaattttaaaaccttaattgaaaagtctattagtcagtttgaacagatatttgataaatcaatggctgattaatcccaccgcattagtgtgtgacacatgtcattcaatacccagatagagtatgctttcttgaattggcccttattgatttctctctgttcatcctttcttacaatgaggctacattgtcccccaaaacaaattttaatgtacatttttcttttattcctcataatacatgaaatacaatagttatttcataagtcataactagtttatagtgttgataacctcttggctagctttttgactgccatttctcattcacaccttgagccctgataaaaacaaaagcccatgtggatattgtgcctcaatcctgagacatcatggtgacagcagattactgccacgtgaacaatgtaagcatttcctttcaagtcgtcatcgtgtaatttagccagaaaatcatggcaagttttctaagaaggagatttggttatactagataataaaagagagagagagaaagaaactccttttttaaaaatgtaggaatgtatttcatcattttctaaattttcaagccttgaacataagtaaaatggaaatataatgtagtttatatgataaaactaaagttgtttgtattagctgtgataaaacatttttggtgaattttttgacatggctttcaaagccatgactgtaataagttaattatcaaaatatatttttagaggaaggtgaaaacatgcagagaaaagatatattcattaatcctttccattttcattgttctagatttgactttggcattaaattactatgtaaatatagtgaagtagtttgactttcctgaacttctttgctagtttggaaaaacataatgagtatccttgattttggatgtgtttatcgtttttttttttatgttaacttttgggatacatgtgctgaacgtgcaggtttgttacacaggtatacatgtgccatggtggtttgctgcacctatcgacccgtcatctaggttttaatccccgcatgcattagatatttgtcctaatgctctccgtcccctttcccccaaccccctgacagcccccggtgtgtgatgttcccctccgtgtttccatgtgttctcattattcaactcccacttatgagtgagaatatagtaatgggtctttcatgctgagcatgaagtgctgttggtcataacacattttattttaaattctgtagaccctgaccttatcccaatgcctggacacagctcacttttccaacagtggagagcatcatatcattttccagttctgcaaggaatgaagaccaagctccaatttaaatattatcaactggttgactattcatgctaaacctgaaatgttcatttttaagccatagaaattggctccttttcccactaattttgaataatttataattttcttaatagccaatagtggaaataatataatagctcttaaggaggaatgatcaaaattttgtagcagaaagtaatagattggcatttgatctaacattcttatgtaccagtgaggtcatagtgtcagcggcaaaactgggtgaacaaaaagcccggattcctgatgcctgatttaatgcctattttctcctgccactcacctgcagttgtgaatggtcaacctgcagactacagtaggctggtgtgcactgatgagctttgcacctcatcttctctctctctctctccgcccttctctttttaacttccactcttcctacttctcctctttccttcctactgcacttcctccctctcgctgcccaaatttaggtgagtctgtggtcaaaataccaaaggaccctctacctatactgtcttgactgatagagactaatagaaagacctgaagtgctaactcctttgccttgatcttgctctggttagtggattcctttgaccattgagtggccccacttaatgattcaacctgttttcctctggcttttctgtggaaatagcacagggtttaccagtggagctaggctctacaggactccaggctgccttaaccaatgtattgccttgtagcacccagaaggagcagatacaggttttgtggaacctgaagcttacgacttggggttcctcttgaagaaaaagaatatgaagtccgaacataaaattaagtaggaggtactgaaggtggcctttacaagttagtatctctccatagtctggcacacaaagcttgtcatgccctggcctagactagccttatattctattgcctgtgaaacaacctgaaactgccaaagccataccaaaccatttctggccccccaggcatgctctgttgtctctcacctgcaagcctttgcgcatgcatgttcgtctgccaccgtgcccatctgtcacttctttagcagataatgcctgttcttcaagacgtcattttgggctcagccatattggaaagccttctgcagtccccacaggtgcctcagttctgtgctctcatattctgctgtagctgttttcacattgcattataactacttgttacctatctgtgtttcctactccatgacgacctgctacatgcaggaggggtgcttttgactccggattcccagtggctgatgttgggactgggctaggcagtttatgttgttcgccttctccaggctttagcttcgtggtgctaggtgtccagacccctttgccctctgctctttggcaaggtcagcccaatggaaagcattgaggaagattggagggtacaaagaagggcaaaccccacccctgcctcctctgcaactccagttgtagccaccacccctctgcacccctgcttctagtagacaatctccccttctgtttctagatcctaccagaagccactaggctctgggctccagtcacattttttttttctcattgtctctactctcctacaggtaatagtggctccatgttcttgccaatttgtaagttacatctttgcttggtttctaagcttttccatcatccatgttaccaagtgtctgtattaaattccaaatttcctctctctgaaagatctagagtggtttgtatttccctggctgagctctgaattataaaggcacagtagatggccagttgttatatgaaaaagacaataggaagagggacctttggcaatcatttgcaaggctcatttacatataaaacaactacgtgttttccattcctgtccatcttagcataaagcatggagccccagaaactggtactagtcctacagaccagacatgcagaaatagcagagcttaacaaaatgcatacagtacttattgaattaactccaattaatctgccttcttgtaactaggtgctaggtccagtaccttgctcttagtaggcattcacacaaacattgagtgaagaacagactgtacttgcaatccatcaccagtatatcccaggcaacaggcaatataataacacagaaagccttgatctataatctctgtgactttttggtacaattacaatggaagctttccccaggccttgcatagcttcgtgggcataaatcctgggagttcctcagaatgtctggggatgaggaaggagtgactgtgctccacaaacagcagagactccaggctggagtgcgtggtgtggtcgggggggccataaaaatgaataaaatctcccaactcagaggccaacaggccaaagaaaataggaaacagacaaccaagggccagcccctggacatgttagtgtgagcaggataaatcctcttaaaatgaattccaaatcttgctcagggcacacagcaagtatacaaattgaggaaagcatctgaggaaatgtggtgataaacacagggctgactgctgagtgtgaggccagagagagtgtgcagacacatttggcaggaggtttgggaagccataactatagcaagcaagacaagaaagagccttcgggtccagcttaggatggagaggcagggagtgcagtggttgagcacagaggcttctgtgccaatctgcctgggttgagattttggctctgttgtttcctagctaaggacaagtgagttaccctctcaggattcagctctctttcagggttaatagcagtgcctgccctcttggctcatgtgaaaacaacatgagtttgttcatgtgaagcagctggcatccgaaacctagtgagataatttataggcagtgctgatacactctcaggcacatttttggtttgtcaaagtctgcaatcaaattttgtattccattcattcatccattgctttaacagatatttcttgagtgcttaatgtgtgactggcacttggaatagaatgaagatctaaaacaagcaagtccctgattttgtgggccagaaaacaaaaatattgacgagtcagtgttaggttagtggtgagggagaatcaggcaacctgaagtggtttctaatgagactctgaagaatgaatgaatatgacaaatgtaccactctgatggaggatgttgtacaatgagcaaggctatgcatctgtgggagcagggtgtatatgagaaatctctgtatcttttactcagttttactgtgaacccaaaactgctctaaaagatagtcattagaaaaagagagagagaaggagtaggaggagatggagggaggggacttctttctgatgatcctaaatattattttggttactctacagaaaactaagggtattttaaccttggctaaatcatatttttgctaagttagatctaatttatatgagctgtgctcattttaaaaattgcagtacctcaaacttcattggagccaattatattcatctctaaaaggcactagtagttgatatcaccaccacacaaggaacttgttagaaaaagcagtgttcacctaaccaaggagtataaaaatgaagcttcagcctaaggaattttgtctgttgatttttcaaaggtatgcttgcttataatgggcagctgaactattcacaacagcaaagacatggaaccaacccaaatggccatcaatgatagactaaagcaaatgtggtacatatacaccatggaacactatgcaaccataaaaaggaatgagatcatgtactttgcagagacatggatgaagctagaagccatcatcctcagcaatctaacacaggaacagaaaaccaaacaccacatattctcactcataagtgggagcaatgagaacacagggacacagggaggggaacaacacatactgggacctgttgggaggaggggcaaggggaggaagagcatcaggacaaatagctaatgtgtgtggggcttaaaacctaggtgatgtgttgataggtgcagcaaaccaccatggcacacatttacctgtgtagcaaacctgcacgttctgcccatgtagcccagaacttaaaagtaaaataaattaaaaaataataataatggactgttgaatattagtctaggcattgaattcatttagtcttccagtatttattgggccacctaagagtggccatggactgatgctagagagataagtaaggcacagctccagcagtcaagaggcctatagttttggggccatgtgggcatgagaataggtaatgcagtggaatgcgcagtaccaaaggatcgcagttactaagaaagcaaagaattcattcactcatttgttctttcatttgttagttcactcaacaagtatttgtgttatatattatgtggaagacatgatatttatacattggggatatagccgtggaataagataaatatgccttgccctcttgagtctgtcatggttctacctgctatggttatagagaaattctgagttgggtcttaaagaatgaggacaagttatggagacagacaagttaaagggcatttcaaaagaaggaaattagcatttgggagtcccatgagtctcctgagtctcggtgtttttgtggaaaggacagtggcacttagcactggtgaccccatctcagcaccaggtggccccaccttggttctgtgcaaaagagatctacgatgggccatgactgggttttgtctataaaaaaatgactttatacccaggctccactgccctcaggcatctcatggatagtcacaggctgatgttttaggacacttgatttccctccttttaattaggtcctaccaggcttatcaaaaatatatccagatctatttttagagatctgaagtctctacgcttagcctttgatctcaatcctcatctaaggtacttaaatactgatttttaacaaggttgcttcactccagaaaatggcctacaaccaagttcagttgtcatggacatgaacattccttcagtatgcgaaccacaagtggatatgtggacaaatattaatgtattcacctaaatgtagtttgtaatataataacttgaagaataataaaatcagccaggcatggtggctcacatctgtaatcccagcactttggaaggttaaggtgggcggatcatttgaggtcaggagttcgagaccagcctggccaaaatggtgaaacgttgtctctactaaaaatataaaaattagccaagcgtcgtgtcacacacctgtaatcacagacactcaggaggctgaggcaggagaatcgcctgaacccaggaggcggaggttgcagtgagctgagattatgccactacactccagcctagatgacagagtgagtgagactctgtcttaaaaaaaaaaagaaaagaaaagaaagaaaaaaagaataaaagctaaaattccttgttaatatataattgtgtctttaggcattttcctttttgttttctaaggcatttcaagggctggaatttttttttaatattttttgtgaggctagttctctcttcttacctcgacatatgttacagataatatctgattccatttatttttctctgtataatgagaaaattaaaacaaccagattttctattcccaatcttctccacctcgtgctttctttatgaataagcaaaaaacaagtcaggaaactattattaggggattagtcccaagaatactttcccagatatcctcttctgcctgatccatgtcttcttgtggagaattaagcattaggagccatcctgttaaagatgatcctgcaccgtgaggtcgtgagaggccactgagtcaccacgctcttaatcaggaacagcctggtgttagtcatcagtatattttattatgttctagttctttcaaaattagttgttccctgttggcaaagtgactccagttcaaacagaagaggatggattctcggctaaattcccggatgcacattggggcataagcactgacaagtgaagtagtgcctctcagctaaaaactacaaactccgattagctactaaactaatgcccagtaggcttccacagcacggttttctgtctgaacaacttgattagcaattgagcattaaatattggtgagtcagagttagctgtgtgcttttaaaactcagatgagatggtatttttacttttgagaaatcattgttttccttatgggctcctaagagaagaaccaggcactgaacagaaagtcacaggcatggtggtttgtgccctgggctgtcatggagatactggtcttttgtaagctcagatagcaccatcaaggtgacatgcaataggattgggtgtttgggaattctagcaatgagtagaccaacctggatgactcctagtaaagaagaagagctttttaaaagagatgccaggctatgtcttgactgcaagagatcattacggggagcacaaaagataccaaagctgcaggttaggaacaaccattatatgtgcagtgtaaaaacaaaaaaccaaaacctgttagttcctcaccggagtcttctttaccagtgatttccagaacaaatactacatcaacacttttctttctggaagttataaactaagatgttaaaagtgattattttcaagtgctagcatcttgcttgttacatctaatttgttgacagtgaatatgcattatatttaaagtaaacaaatagttatttgcaattttaaaaaattgcaaggcctttccatgcctgctacctgtcaaattggccatttttcacttattgatgtttccttctaggctttgccaattcaacataatttctcagtaggtataattaaacagagatgctgttctgcatgctgctatttcaaagcattgttgtacacaaaaaaacagacagcaaagatcttctatgatgtaagccagggtaacccagaccccagtctaatgcaaccgtatcttgggcctcaatataggcgctctcacctttcaagtgatcttgtgataggacctgtttagataatgaggtgtcagagtatatgtttctttgttgtttgcctgtgaaaatgtatagtttgttaatagcactgtaaattataagaggtctgctccatggaaaagaaacatgaatagatttagatttttatggggctgaatcagccaaatcaaacacaggcttttctgaagcttccaagttttaatggaaactcacgctcttcagaatgttgctgcctaattacaattcatgccttttgcagacacattacagagtggaccaaaaggaaaatgttagacgtgttcacttgtgatttctattgtgttacttgtggagtgccagctgcataagtccagtggcctggtgcgtgcaaagacaaggaccagttcttggcaggctgtgtgacttcagtaggaaggagaaagagagactggcagaatagcaaatacagaccacacactcaaatacagaaccagacttcaacatgtgattctacatatactaccaatgtcagaatgtaatttaaaagtcccatggtactcataaccccaaacgaacccacttaattgtcttcatcagagaagcactttcgaactccagaaaaatggaactaccaagattttcttttaaaaagaactttaaacatttttaaaaattattttaaacaggtctaactggtatcaaaggagaaaaaggaaatccaggcgttggaacccaaggtccaagaggcccccctggaccagcaggtaaatcttccttcctaacaagagactgcaaatgtatatttttatattcacttggcattgcaagtgaggaaaatggtcatcttacatcctagtatgtaacttaaatggctgtatttcttacttgttttattgggaggcttctttgttaataaggatcctcccaatatacaagaccaaaaagttagagcatattctgggatcttattgtttgtgtgagttgcgataggacagactatgctatagtaacaaatacatcccaaatgcttagtggatttacacaataaagctttatttcacaatcacacaaagtttcatatgaataaggtagctctcttccatctcagaacccatgacctccatggtgaatcatgtagcctccaagagaaagaaaaagaaggcacatcgggctgggtgcggtggctcactcctgtaagcccagcgttttgggaagctgaggcaagaggatcacttgaggccaagagtttgagaccagcctgggcaatgtgacgaaaccccatttctaccaaaaaaaaaaaaatacaaaaatttaaccaggcgtggtggcatgtgcttgtagtcccagctacttgagaggctgaaacagaggatcacatgagctctggaggttgaggctacagtgaaccgtgatggtgccactgccctccagcctgggtgacagagggagaccctgtctcgaaaaaaaaaaaagaaggcacaccggtctcaacttcctaaacagaatgagatgtcacttccattcacattttattgtctggaactaatcacctagccccaactgaactgcaaggcagacacaaaatttagagaaatacagggctatttggtgagcactagtatttcctgccatggtaatcttactgaatgagttctgtaaaagttttgagttttgtgtattatatgcttttagaatggtctccagatgatcaggcttgatattagaattattataatttgcaatcttattataatatatatttataatgtcagtcttagccacattaagtaaagtgctttacagatttttctttccaatctagtaaggattttggaaaatactttttctgagagaggttcctaatgcaattcattttgagtgtaaatatttctgttattagagacaatgtgaggaactgatataacattacacattacacagaatgggtggttggtgagtgctgattgaggagctgaatatatgagagccaccacgctattcaaatagaaggtgatacttgttcctacttttcatttcagttctagttgagaaattccattatagttgaagaatgccttttcaacactgttggaacccggacctaaaaacaagcatacaagccaaaaaaaaaaaaaaaaacatgctgacaaatttcttcaattcacaacagttttaatcctcctatttttactcagtctgaattctcaattaatgtaaactagcttaaagaaattttggattagtatattgggtcgaatgtcaaacttgtcattggtcccctccaggacaatttcacactcatacaaatttactttaattatctagggccataaaccagtactgaattacatggctattctaactgttgatgaggttgagctttaattatctggggccataaactggtactgaattgcatggctattctaactagatgatgaggttgagctctgagtgtgttcatgtttgtgtctgtgtgtgtgcacgcccatagattggattcataaggaactgcattgggaaacaaaagctccaaaaagaaaataaggttgataatggaaggttcctttccctttaacatccaagaggaaatagaaaagatgcattttgcttgccagtttcctgagctgattgagagcattgacctccaggaggataagtgattacactatgaccctctgcctagggaatccagtctacaaaaaagaactcaatgagtagaaagaggttgtcctaattgtcctaaaagttgcttcttctaagagttagtttacttcttggttgtctcaaaactcaccctgttgtggcaaaagaccaacggttttcatctgtgggtacttcttaggaccttcaggggagagtcggcctggcagccctgggccccctggctctcctggaccaagaggcccaccaggtcatctgggggttcctggaccccaaggtccttctggccagcctggatattgtgacccctcatcatgttctgcctatggtgtgagaggtaagtgtcacaaaaagccccgcttgtgggctttgatcaatgttttagtatgcttagtaccaaaatgggaagatagtgctatgaaaaaagttaaattggttatgaatgggaagcagagcttgaatgcctcacttccttaaattatcccgagacattttctataaagtgcaaattgctatagaggctactcccttaaaaaccttaagagcaaattcaaaataacagcacatctaagtcttccttgcttcccagtgatgacctacatagacttggcctctgactttgtatttagcacatttggaggacatggttgaacattcttttggagtctccattcttatgtgacagctgtgatgtggccaagacgtcccataaaattttactcttggtttggggaaatgtcaaacttagaacttctcccgtaattaagagggctccttagattattttcaatgaaatcatgcataccacttgcatttaggtgcatttaagcaccacattttaggtgaccaagaatagttgtgagaggaaacaaaaatcatgctgtccttgtcttatcactagctactggactaaaagaatatgcttcctaaaacatctgcagtgtgcatgctggcgtgctgtgcaatggccccttttctgacatagtcactcttggaagcatcaagggagaggctgagggactgctgtggggccatgaacttactagttaatgggtttaaaattttctgcttcagtagaaatttaaccttagttatcacaggaattggtcaacaaagttttgctgatgtgtttttctctgttcatcttttccctccctgttctctcaaatactcctatccttattaagatctgatcccctacaatgattaccagcactgaagtggaaatcctccactctggttccattggccccagacatttagctgtggatacagaactgtcctgtcaaccaccaccaccaccaagcccctgcccctaacaatggacactctgcttccctgcttcttctgcatccctgccttcccactttcaaacctcttgcccactctgctccaaacatgatggagtgataacatcggaacttaaccaaatcatatatgtctattttaatagacactgactgctccatgtcagcctggatagaggtatatgatcgtgtgccaagaatttatcccagactcccctgtgtgacagcttcataataaagttacttaactgtgcctcttcctccttcctctccccacacaggatggatgggcatctttctccttgaccaccctactctcccttcctcccctgatcacctcccctccctgctcttccctggtgatggacttctaacatgagattttttaaaaaaatttctatttcttttataattttgctgagttttcagggtttcttctgtaaataaaacataatatttaaatggttggttatgattctagttttctaacaatttctgtaatgtatctttcccttcgtctatttactaactgtctgaaaccttatggggaaggtacaaggggcgtggtggattaagacatccactgctttttacccagcaggatatctctgtgtctctaaggacccaggtgaggggagaatatcaatttatgattcctgggtgcagcaagtccccacccccacttttcctctttagctccccatccagatcagccagagttcacccctgtccaagatgagctggaagccatggaactgtggggccctggagtctgatagcctcaggagaaatttgaagaccaactgcaagaactcttaaggaatcttgtttgagaaaatgttgttatgtggtttgtatgctacttttggggggcagggctcatttcagcagcctaaatctcctccttggataatgttaatattattattattattaacaaaaaatatatatttttaaaaagttcccttaatctatgacatggtagcaatgatttccctttggtgtcttaatggcatgtcagataatttgtttttccagagaagagagctcaaagaggaattgggaaaaataaattgaactctggaatcttctctctcaagtcctaaaatgaacaaacagatatgattgtgtttgagggaaatatgtccctagcaggaaaagaattcaaagaggttcaaagaatatgtcacttactcctacttgctgtaggaataaccttgctgataagaaaaaaagggacaatattggagaaactacctcttgtttaattgatctgtccaactctgagatcacttggtaactggtttcatgtgtatccaaaaatcagcatttggatttaagctttctgaatttggtagtttaagaaacagatttagtttttcagtggttttaactcatgtgaaataatgattttccaccagctctgatgcaaagagatataattttaatgaacgatttatccagcagtgtgttccaggggttgcctctccttatctacggggattactttgtacatgcagataagttttcgcaaacctatttccattttcttttgtaagcaaataaaactttaaaac

SEQ ID NO: 37813 - DNA, 68536 bp, Homo sapiens
atggccatggcccggctgggctcgtggctcggggaggcgcagtggctcgcgctggtgtcgctcttcgtcgcggccctggccacggtaggcctgtacctggcgcagtgggcgctggccagggcgcgaccccagccccagcggcgggcggtggagcctggagaggggccgcgcccggggtccgacgcgctgctctcctggatcctgacgctgggcagctggaggagccagtggcaggcggcctgggtgaccgccctgaacgaggaggccgagaggaaaggggtgagtttccgggactgcgggccggggggcggcagatgccggggcgggcggtccgggccgaggtctttcctggaggcgtcgctgcagcccctgacccaggctaagggagtcctccccccagcgcagaccatcctcgagagttaggagagagacgggggagcgaggccccttgacggagagacaagacaaagtgattgattttattctccaaacggcaggtgctccaggccctgggctccgcgagggacaggctggcagttggagggaccgtcagaagtgctcatccgcgccagccagtacctgccttgcctggagtcccggggcgaattcccgtgcccgatcggacacttactgagcttgcacatgatacatgaatagctgtgaccccaatgtgcttccgcctctcatagagctgaatttcaccaagaatttatctccaaagacttgcatttcttggcatataaaaatagtgaccgtttgctgagggccagccgctgggcagacatcctaccgaggctttcggtgcgtctgccatctctgaatcctcacaactcccgggacaggggtgttatcactgttttacagatgaggaaaccaaggcccggagagggcaagcagcctgcccagtgccacacagctcgtgggcggcagagctggcatgtgaatccagctgccctggcctgcaagctaagggcctcgtgtcttacctctgctgcctcacagtcctgtgggtgtttctgtagtcgctgattactcgttgacttatttttgcttttaagacatcttagtataacgacaagctcctggcatgtactattcttaggcatttcacaggagaagttggagcctgggtgggtttggggaggcacccctagtcttggccgctgctccgcccttccaggccacagtttcctgcacatgcctgtgcagctcagtggtcattcgctgtggaaatagcagaattgctcattttcaatgtccggccccatcaaccttcaaaatattccatggcgggccctgtgcctggtccttgtgcatggccttggaagacatggccatggaattaaaaaacaaaaaagctttgactatcagttagcagccatccaacaaatcaagagaccttgttttgaactcttgaaaaagaacataaatgactgtactttttggaggaaaaaggcttcagggtcagttgactgacttttgtcctggtgcccagaatctgtgcctcagctgtccagagctggagagtgtctcagggaaaccagctgtctcttgtgggagccctccacccctgttggcctcacatccaggagcaaatgcaggtatttccccaggaagctgccatcactgacccctgactgacctggaatcaaggcttctgaggctgagtcccctccaggctggtggcttgattgggcaccagtctcatctgtgtcctttgtaggaggcaggcaagtgttgggtgaatgacctttaagttcagcttctaactctggagtttcaggcttagaggcagtgaccctacctcctgtatatttgggatggttcgtttcctgacatctatggattggcttcagaaaatatgatcctcttggatatgatccttccatattcccatctgactgaagtgttgagaggcagagaagaggatgtccctggcatctgtcttaggctggtcaagtcaatctgagaacactgaaagaaatatttgaaagttttggatgaaaactttttacttgagtctttgtgtgggagcagggaggggttgcgttcagggagaggagagagggtctcaccttgtttgcgccttctctgttctctctctgctgttggccacacactgcagtctcagacacctgtctctcctgacctcctgcctggaagaggcaacagtgtcccggattcatgctcaaagcaacccagggccatctctggcatttttgcatggacatagtccattagttctgtgatgtcagtttttggtattgcttactttcctggggacgggggtgggggaacacagccctgatgcctgggaatgtcatttgatttgcattcaaatggaaggttttgcaggcagataggatctgggtgactgggctccctgtgagtgacggtcacacaccctcccggcatcctgagccgtcgctgccgtgtcagtgatggcattgtgggtgagcaggtagtggtgtttgcattcctggccgccccgagtccagcgattgtcacacacatcccagcatcctgggccatcgctgttgtgacagtgatggcggtgtgggagagcaggggctgctgtgtccattcgtggctgccctcccccacctccattcccactaatcccggattagggctgacactccaagcccgctctcgcctggacagctacagcttagtgctccccctcctgcctctgccttgtcctgatatcactctgtcctacccagggaggagaccagttcttggcctgtcgcttagggattgagaagacactggtaataacttaatcatgtccagcattctgtctgaaaagtggaattttctgtccaattgagacaataactcctcccattccaagttttaccccacctttgtattttaagatggaaagaaaccctaaactcttctagccaagccccttctccagaaggggagactgaggcccgtgaactggaggaatttgccaaggtctgcgcattggtggctgcagcctgttccctggtgggatgcagtatcaacttggagacctaaatgtttcctttaaatgagagccagcgagaagagctcagagagtagagttgttaatgtgttatcccaaacagtggggctcgcaccttccaggatccaaggactggtcagcaccggaggagtcctcctgctctctgatgaccactgcagcagcactgactccccgtattgcaggggacctcggattcccaccctcactccagaaaggggtctaaattatatgtgacagtgatttgcactgactttggaggaaaccattgctgatctgcctgctggccaggtggacgccaggtgtgcagggatcacaggagtcttgcccagagagcttagtgacacacgtgcctgccccccacatccgcctcagtaggcttggggagcacactttgagagtgtcccatggttgagaatcactggtgagaagctgctagtacacacttgccatccatcagagttcctctttcttttttttcctttttttttttattatgatactttaagttctagggtacatgtgcacaacgtgcaggttgttacataggtatacgtgtgccatgttggtttgctgcacccatcaacttgtcatttacattaggtatttgtcctagtgctatcccttccccagccgcccagtccctgacaggccctggtgtgtgatgttgcccgccctgtgtccatgtgttctcattgttcaactcccacctatgagtgagaacatgcggtgtttggttttctgtccttgtgatactttgcttagagtgatagttttcagcttcatccatgtccctgcaaaggacatgaactcatccttttttatggctgcatagtattccatggtgtatatgtgccacattttcttaatccagtctatcattgatgggcatttgggttggttccaagtctttgctattgggaataatgctgcaataaacatgtgtgcatgtgtctttatagtagcatgatttataatcctttggatatatacccagtaatgggatcgctgggtcaaatggtatttgtagttctagatccttgaggaatcgtcacactgtcttccacaatggttgaactaatttacactcccaccaacagtgtaaatagagttcctctttcacccagcaccacgtaaaagcaattgtttgagctttgactcttgcctctccacttggtgtggtgttgcagacccctaattcccattgatgtgatcactctttggtcacacagaacagaagatcccagaactggctcagtctcaggtcaggctccttagactgagaactaatattatggtatccaaaagcagcagttgagcttttccttttgctcccctgcgattacatcaatatttacaaagtggtccatgataatcagttacacccccaacatccccttgggagtctccgggactgctgtcctacagtctcctcgactctgggatccagcatgcttgcctctgatggccgctgcccgtgggctgcccagaactcctcccaaggctgatgctgtctggaccatgtgtgggcagcacctgtcccgaagcgaggcctgtgttccgtggcctgtgctctgggcttgtctggtagcggcccacctgagtgggatgaggccccggactaggagggtccccaacgctgtttgtttctttagtccttcagcccagggtttctttagaggtatgttctaattgcaaatgatcaagactatgatcattatggtctttgtaaaaaaaaagaaaaaaaaaaaaaaaaaaaaaagatgctgtgtggacttggaacatattattaatagcactgacttgaataggagtttctgcatttaaaaagtaaacaaagtggccaccagacttcagagtctttgcattatataatgaccttccagttgtgctcacgaagtccaaactccttgaccaatgacagtggctgtggtgtaggaagccagttggtagaactgtggtgaccactgtggggaaggaccatggagctgcccttccctcctccagtagaaggaacttgggcctctttggggctgtgaaccctgcaccctccaccgtgaccccttctgttgctccagtgtccagggacctttcctgtgtgggccttcccacgggtcattccttttgtttggaattcttatcttttttcctgcttatttaacttctctaaatcttttgggtctcagctcagaggtccctgatcctccccttcagccaagatgctccccgccctgccctcctcccgacccccccggagtcacttatgccctggtcagctcccggcattgtgagctggggcagagccaggggctgtctgggcagagccagacccagtgcccagcacaaagccggctcggggcaggccctggtctcagtggggtgaatcatgggcctctggaggaggagaaacagtggtgatgcccattcccccatctggactcaggccttctgtcttgggagccagccaggcctgggcaaaacaagctgtttaatgtgctttgtttttcacttctaaagcatcaacattaaaggaggctctgatgactttgcaagtcatcaatgccaaacccaggaataggcgccagttcagtttgttctttgcactaacccattctcccaacaagacagggattcaggaaagtgtgggtgtagcgttcacatcaactaaaattcccccaacgctaacttccactcccgcgggcccctggtaggttgctgaggagggaaggcacttcttcagcccgtggaagggcccgtggggaagctctggagctggttgcgggtttgctttgtgctccagctctaccctcctagctgtgcgatcctgggagagtctctgtgcatcatctgcagaagggaaaactggattcaatccagaaaacaaaatccactctcctagaggtgagatcagatctgtgtgagacatttagcaaaatgcctgggacatagtgagacaataaaggtgggctgctctctttaaagtcttattttttaaactttttattttgaactgctttcacagaaaagttgaaaaaataattcaactttcatatattcctcactcaaccttgcataaccacagctcaatgatcagaaccaagaaattaacattggtggcatgttactatgattcataacacaaggagattaatgcaatgtaatagttcaagaaattaggccaggcgcagtggctcacgcctgtaatcccagcactttgggagactgaggcgggcggatcacctgaggtcaagagttcaagaccagcctgaccaacatggagaaaccccatctctactaaaattacaaaattagctgggcgtggtggtgcatgcctataatcccagctactcgggatgctgaggcaggagaattgcttgaacccaggaggcagaggttgcagtgagccgagatcgcgccattgcactccagcctgggcaacaagagtgaaactccgtctcaaaaaagaaggagagagggagggagggagggagggagagagagagagagagagagagagagaaaagagaaaggaaagaaagaaagaaaaagaaattaacattgtcacaatgcctaacaacaaaagcgaaggccttctttgaatttcaccagttttccacctgtctccttgtattgttctagggtcccattaagggtacctgtggcgttgagttgttccttcttcatcacctgcagtctgtcagggtttctcagtctttctttgttttttatgaccttgataactaaagactgttgatcattattttgctgactgtctttccatttgcctggcattttcatatggttggagcgagattacacaaaccacagaagtggtgtgcactgtgtctggggcttgtgatgtcagcgtgtcttgttgtagaggatgctgagcttggtgccttggttaaggtgacttctgctggggtcatcctcttgtattttatgtctcctcctgtattagtcccttcttgcattgccagaaagaaatgccagaaagactggtggtttataagaaatgaggtttaattggctgatggttctgctgtccaggaagtatagcaggttctgcttctgcggaggcctcaggaaacttacaatcctggtggaaggtgaaggtcatcttctatgacccagagcaggagggggagaaagaggcgggaggtgctacacacttttaaacaaccagatctcatgagaactcactcactgtacagcaccaaggggagatggtgctaggccattcatgagaactccccgcaccgtgatccagtcacctcccaccgggcccatctggtaacactggagattaaaattcgacatgagatttgggcagggacacagatccacatcatgtcacctcctttatctttcctgctgtagttaacaggtagtgtggggagatgctttgagcctgtacagagcccgttgctccttaaactcttcctcactgatttcgcaaccattggtgtatcttgtgtgcagtgatggcgcaggtgcagttctcttgatggtgactttctgtttcctcttccttactgtctttattatttggaactctcccgcaagacagaactgtcatttctcctccaatgagatatttatctgattgtttagctcaatatggactcatggatatggattttattctgtgggttataatcccatactatcactatttattatattgttgtatcagtctgttttcacactgctctaaaggacttccctgagagtgggtaattgataaaggaaagacatttaatgactcacagttccacatggctggggaagcctcaggaaacttacaatcatgatggtagggaaagccgtcaccttcttcataaggcggcaggagagggaagaaggaaggaggaacttccaaacacttagaaaagcatcagatcttgtgagaactcactatatgagaacagtatgggagagactgccccatgatccagttacctccctccctctgcaggtgaggattacaggtccctctcttgacacatggtggttacaaacagagccaaaccgaatcagttgcttaggttgttctcctttgggccatcagggtgctcctttgagagtagcctcttgtgttcttccatcaagcccactttttttttttttcatttccttacttcatgtttccacaaaatatttgtttttggctccccacaggccctggattcagccacttcttcaagcagccctgattccttttattggagaagtgtttagaaaccaagacctaggcattaagtgtgttcattacctcttggttctcattgctccccttcagtgttcagcaatagcaaacatacgtgtgtataccaacgtgtgtgcgcatgtctatatttctgtgtatttctctctgtgtttatctgaaaaaccgtgattgtatcctgtaccttgggttctagtccaacggtacagagttcattttagttttttcactttcttattcttaactcccttctccaagagtaagacattgcacacctgctgtcttatttacttactacttatgtgttcagttctagtatatgcatgaagtagtttctgagttcccaacctatgaaacacatttactggattatagcatttatatgcagtcaagatgcagttttccaagcttcttaggttatatccgtgtttttcccatccccttcagtgtggttatattgttcattcgtagtgcatgtgtttgttggtgcaccagagccacacagttttaattacggggtttctatagtctgttttaatatctggtggagctagtcacccttgtcttcctttttcagtgttttcctggcaattcttgtgtgtttctttttctatgtggacacaaagtcttcctttagtctaagtggagtggggtctggaatgagggttctgtcagcattgacacagcagcagagatgcagagatacctgaatttgtggttgtgtgtggcaggcaggcacaccctgctcctgaaactcaaggactaggcagatcagaaaaggaaaagcaatctctcttaataacttattttctttgtgagaccatcccttgaccttaagttttccagcaaactcttttcttttctttttttttttttttttttttgaggcagagtctcgctctgtcgcccaggctcaagtgcagtggcatgatctcggctcactgcaaggtctgcctcccgggttcatgccattctcctgcctcagcctcccgagtagctgggattacaggcacctgccaccacgcctggctaattttttttgtgtgtgtgtatttttaatagggacggggtttcaccatgttagccaggatggtctcgatcgcctgacctcgtgatccgtccgcctcggcctcccaaagtgctggggttacaggcgtgagccgtggcacccggctgcaaactcttttcaaggtttgaattcagaaggtagcaagggaagagggtaaacactgcatctgccgcctcaggggagcatgagtctgcacccaggctggtataaggcaacagcgtatctttaggctcctacagaaggtacattgtttctccgctgcatcctccgagcggctggcatgttgcctgctcatggttctctgcctggcactggcctctgtgctgggttctgttctctcaggccagagagcctggtgcacagaaccgtctcatcaccaagctcagagcgtggccctggccagcaggtcccactcaaacaagctcccaccacagagaatgccagcagagcagccctgaaactgtgatttcagccctctcgagcagtacatttaattctctgctgatttttgggggatgagatagacagtgtaagaaaagggtgaggttagaagcctataaatcaaaatgttctgtcccctttaggtttacgcgggtcattgggcattcttgagaaatagccacagcgtaacctcatcgcttgctcacttgcaccatgcttgctggaatcgccacggcaaggttttacaccgcttcccctctcccaccctcggtcacgccttgtagctggacctagctcaccacggtggagatgagatacgatgggagcttgtggggctgtgtgttttttaaccacccagtcggagctcattgaaacacggtgtgctttctacagcatgtcaggaacagagttctaggagagtttcgatctgggattgtgttgttgatgtacacgtttggcctctcgagagctagacaagacttggacaagacttggttggtcacataagccctgggttcttcgtcataaaacgttggccttgttgccttgtggtcctgttcatttaattgtgcgtctctcgtttggagaattttttttttctttttgagacagggccttactctgtcgcccaggctggagtgtgatctcagctgaatacaacctccacctcctgggtgcaagtgattgtcatgcctcagcttcctgagtagctgggattacacgtgtgccaccacacccagctaatatttgtatttttggtagaggcagggtttcaccgtgttggccaggctggtctcgaactgctggccttgagcaatccttccaccttggcctcccaaagtactgggattaccggtgtgagccaccatgcctggctttgcttggagatttttaactggaagaaccagaacagacatgagctgaccgagtttcctggaaggatgctgggggaacatgcagagccacgggcacaggtgaaccttggggccaggtggctccagagggctgtgaagtaggggttgaggagtctactctgtgggcagccaccaggcgggttcatttccagccaaggaatcttggccaccctctcagatcccagggagaggccagcccctggggggtaggagaggagaatggggggcaccctaagtaatcgtaccacagcaaccacacgcaacaggagaggtgcctctcctagaccagaatagaggactgtccctagcaacagggaggacacagcctggagccctctgtgctgggcgaggtgcgccgctagacccacagatcctctgatttgcacgaagcagccctgccccaagagtctgtttctttccttatgctgtcagcaggaagattcaaaacacccttcgctgccttcctgcagcatcttcaggtttactcccgggttcctgtcctttcccagccttctcccataactgaatcctgcccactgagcacaatccatcaccagctgctccttggatgtgcagagctcctgatatttagccattgctgctattagaagcacagagttcacagaaagatgtgttagtacattttcttaatttttcagaactttaaacagatatgtaatttaaaagatgcagcccctcctgtgcatgccctcctcatgctgcccctctgttccagggcccacctttcctgtcctttgaggaggacccgcggcagcaggcactggagctggtggtgcaggaggtctccagcgtgctcaggtcggcggaggagaaggtgagcccaggagcccattccctgcaggaagaggtgaacttgatgccggggacggggagtttgctttgtttagaatcattgaaaatgcggaacccttacactaggaaaaaaatcaaaacaaccatctggcccatcagctgatgggtagatgaagaaagtgtgatccgtccacataatgggacgttattccgccttcaaaaggagcgagattctgacactcgctccggtgcggatgaaccctgaaaataccgtgtcaagtagaaaaagctggacacaaaaacctcatattgtgtggttccatttatatgaaccatccagaatagataaacctgcagagacacaaaggagattcgtgttgccaaggcctgggtgagggactcttgggggaaaatggagagtaactgctgatgggttgaaggtttcatgttggggtgatgaaatgttctagaactgatggtggtgatagttgtagaactctgcgaatatatttaaaaccattgatttgtatagcttcaacaggtgaattgtatctcaggacatctgatatctgttgctcaaatatgcacatcatgttgtagactttatatatttatgatatatctagatttatgtacatatatttatgtgtatatgaactatgtagatgttatgtagaattcattttcctgttgctaacagtttatgtgctccacttactagactggtcagatagcataaagcataaaagcttctgtaataagtcctaagacattttctctctctcttttttggctttgttttgtattgttttagggatgggatctcgctctgttgcccaggctggagtgcaggggcatcagcttactgtaccctcaaacttctgggcccaaatgatcctcctgccttagcctcctgagtagctgggactacaggcacgtgtcaccgtgcctggctaattttttaatttcttttttttgcagagatggggtcttgctatgttgcctaagctggttttgacctcctcttagtttcaagtgatcctcccacctcagcctcccaaagtgctgggattatagatgtgactctccatgaccagctgaaattttctcttcaatacaaatcttacccttgtacttattatattattgttgctgttgttattattattattattattatcattatatatttcttactcttgggctctgaattttccccattaataaaaatggtttatttgccagttatgttcagcataactagcaaatccaaaggccagctccacatggagaaatacagtatattcttgttggctgctgaatgcactgatttgtaacttacagtctagagttgcagttagacatgatggtatggtctcactttaggagggaaaagaaggaagcagtgcttcccgccttccccataactcacatgtacatttcccatatgtgtatataaagaatctattttggaaagcatcatctataatgaagttccatcctccattcctcctcttcctacctacagtgatgactgttcttgtaaagttgggctgctcttccttcattttcaacctgtgtttatatgttacctgtgttgctgtatgatctttatggctccgtctgcattttattatcaagttaggtatgtgggtaccatttagcaggcagcaaggaggggacgcctgtgtggccccagactgaggagagtgctgccagccccttcaccccacctcttacgtatccctgtgacagctggggtatttgtgtgtttaacatttttaccattttttatgtacacttttgcaacaagctttctctatgtagatcaccgtaattttgagacttctccaggttggtttttgtagttcttttctttgtagttcattttgcttcaactataattcaggattccagatgaacccgagctcacttacccatctcctgttgctggataatgaaattattttctcttttttgaaagtacaggttgagtatcccttacctgaaattcttggggccaggagtgtttcgggtatcagatctttttttggatttttgaatatttgtattatttttttactagtcaagcatctcgaatccaaaatactccagtgagcatttccttcgagcatcacattggccctcaaaaagtttcagattttggagcgtttcagatttgggatgttcggattcgggatgctcagtccgcacagacagtgctgcagcgattgtgtctgttcaccgcctcccgactcctcagacaagcaccggaggaccccaagggcaggcatgagcctggcgggtcactggtgtgcatacttcagcttgaccaagtattcctgagtcagtcaccaaagtgctgttcccggttttctctgccccagcagcataggagagctctccttcctgcataccctcgtcagtcctggagccacgctgttagataatccttgtaagtagtgtgaggaagtcactggaaagtactggggttgcaggaggaagcccatggcagcggtgcgggatgctgagactggcacagcctggagagctgggagggccctgcggcaggtgctccagtgcccattttatactcttgggagctgaggtgcagagagccgtgggcctgccctcctggagcccgctgctttggaagtgccttcccaggcggtgagcaccctctctatttgtggcaaatagagacttcatccctttgtggctgggtggtttctgtatggtgtttttgatactttcccagttcagagaggagtggaatgttcagggctggtctggacagggagtggaggaagcggggctgtggaaatagcaagactccatctttaaaaaaacttcatattgccagaaaagtggccttacacggtaggtaattcaattgtaatccttttaataaatacaatttcagaaatggacatgacagaaatagtacatgtaaattagaagtgaaaaacagcatcgtatttgtatggccatgaccatagcaacatttttcataactgctgaaatgtggaaggaacccaagggcccactgatgggcgaatagatcaataaactgtggctcgtccacgcggtggaatagaattcagccatagaaagtgaggacattctaggccgggtgccgtggctcgcgcttataatcccagcactttgggaggccaaggtgggcggatcatgaggtcaggagttcgagaccagccttgccaacatggtgaaaccccatctctactaaatatacaaaaaaattggccaggtgtgttggcatgcacctgtaatcccagctacttaggaggctgaggcaggagaatcgcttgaacctgggaggcggaggttgcagtgagccgagatcacgccagtgcactccagcttgggtgacaaagtgagactccatctcaaaaaaaaaaaaaaaaagagaaagcaaggacattctgacataggctataacgtggatgaaccttgaggacattatgttcagtgaaataagccagatgtgaaaggacaaatgctgtatgagtccacttcttagtggtccctagagtagcctgattcagagagacagaaagtggaatggtgcgtgccaggtgcttgggggaggaaagcggggagttagtgcttagtgaggacagagtttcagtttgggaagatgcaggttctggaggtggatggtgatgatggttgatacaacaaagtgaatggacttaatgccactgaactgtgcactcaaaaatggcttaaatggtcagttttatgtgtattttaccacaataattaaaaatatggaagggtatagagatttcttaaggtttcactatttcacatacaagctttgtttaatttgtttacccttcctttacctgagctatgatttgtcaatccttgccaggtgtcaatgactttattttgtttttaaaatttattttttttaattgatgaaaattgtacatatttatggtatgcatcatgatgtttatatatatatatatatacacgtgtggaatggctaaatctaacatacagatgatgtcacatacttaccattttgtgtggttagaaatttaaaatctactcttttagcaattttcaggtatataatgtatttttattaactttagtcaccacggtatgcaataggtctcttgaacgtgttccttctaaatgaaatttggtatcctttaaccaatacctccccgacgtccccaactccccagcgtctggtaaccaccattctgctcttggtttctttgagtttaactttttaagattctacttgtaagtgagatcacgtggaatttgtctttctgtgcttgatttatttcccttaacataatgttctccaggtttatccatgttgttgcaaatgacaggattttcttcatttttaaggctaatattccattgtgtatatctgccacattttctttatccattcttctgttgatggacacttaggttgatcccatctcttggctgttttgaataatgctctgggtatcttttcaacatactgattttatttcctttggatctataatggacccttgaacagcatgagggttaggggcactgaccccttgtgccatcaaaaatccgtatataacttttgactccacagaaacttaactattaatagcctgctgttgaccagaagtcttactgataatgtagtcaattggcatatattttgtatgttatctgtattatatactctattcttacaatgaagtaagccagagaaaaatgttgtgaaggtggcttatgcctgtaatcccagcactttgggaggctgaggcaggtggatcacgaggtcaggagttcgagaccagcctggccaacttggtgaaaccctgtctctactaaaaatacagaaaaattagccgagcgtggtgatgggtgcctgtaatcccagctactcaggaggctgaggcagagaattgcttgaacctgggaggcggaggttgcagtgagccgagatcaagccactgcactctagcctgggtaacagagtgagatgccgtctcaaaaaaagaaaaaaaaatgctgggtgcggtggctcacgcctataatcccagcactttgagagggtgaggcaggtggatcacgaggtcaagagttcaagaccagcccagctaacatggtgaaaccccccatctctactaaaagtacaaaaattagccaggcatggtggtgtgtgcctgtaatcccagctacttaggaggctgaggcaggagaattgcttgaacccaggaggtggatgttgcagtgagccgagaccgcaccattgcactccagcctggcaacagagcaagactgcgtctcaaaaaaaaaaaaaaaaaaaaaaggaaaagaaaatcatatggaagaaaaaaatctatttaccattcattaagtggaagtggatcatcataaaggtcttcatcctcatcgtcttcacgttgagtaggctgaggaggagggagaggaggggttggtcatgctgtagcaggggtggcagaggtgggaaaaaatctatgtattagtggacctgtgcagttgaaacccacgttgttcaagggttaacagtatacccagtagtgggactgctggatcatatggtagttctctgtttaatttttaaaggagcttccatattgttttctgtaatggccggaataatttacattgtcaccaacagcatacaagggttcccttttctccacatccttaccagcacttgttattgctcatatttttgctaatagccattctcacaggtttgacgtgatatctccttgtggctttgatttgcatttccctaatgattagtgatgttgagccctttttcatagacctgttggccatctaaaggagaaacatctattcagatcctttgcccattttttaattgggttatttgttttcctgctgttgagttacttgagttgtttatttattttggatattaaccgcttatcagataaatggcttgtaaatatgggattccattccgtaggttgtctcttcactccgttgatggttccttggatgtgcagagtttttagttttggtgcagtcccatttgtctgtttttgtttttgttgcctgtgttttggggatcataccaaaaaaaaatcattgcccaatccagtgtcttaaagctttccttctatgtttttttttctagtagttttatagtttctggtctcacatttaagtttttcatgcattttgagttgatttttatatatgtgtgagataagggtctaatttcattcttctgcacgtggatagccagttttcccagcaccattcaaggtgtcaggactttttttttgagacagagtcttgctctgttacccaggctggagcgcgaccttggcttactgcaacctctgcctcccaggttcaagtgattctcctgcctcagcctcccgagtagctgggattacaggtgtgcaccaccacgccctgtgaatttttgtatttttagtagagacggggtttcaccatgttggccaggctgatccacttgatccacccacctcggcctcccaaagtgctgggattacagacatgatctaccgcgcccggccctcagtgtcagaacttttctggctgtgggggtcaggcttcagcaagcacagacgggcatgctgcagtttgcagatactcccacactctggcaagttcagacctcaggctgccatggttccattctgtctcaaacataggaattccgctattatcataaaatcaatacgagttcattgatgaaaacttgaaagacacagaagaatatttaataaaaacacacagtagttgcatgaactggtgattagctctgttcatgtgttggtgtgcattgccagtcttttgcttctgcatttattttttgctacaatttacactatattccatttatattctttcccccatgttactaaaattcccctaaaattctaatgaatgaacacataagagtcaaggctggccagcgcggtggctcatacctgtaatcccagcactttggaaggccagggcaggtggatcacgaggtcaggagttcgagaccagcctggccaacatggtgaaaccccgtctctactaaaaatacaaaaattagccgagcatggtggtgcacgcctgtaatcccagctacttgggaggctgaggcaggagaattgcttgaacctgggaggtggaggttgcagtgagccaagatggtgccactgcacttcagcctgagcgacaaagccagactctactcgggaaaaacagaaaaaacaaacaaacagacaaacaaacaagcaaaaaaaaaaaacgaggcaaggctgtgaagcagcagccgtgttgtcctggttaggagcatggttccttgctccgttctttctcttcctctgtgtggctcggcttctcacctgtaaaggtagaggatactgtccaccccctagacgggctatgaggatggagtgagttaccacaggtacagcacatggagcaatgccaagcctgtgcggggctcaatattttctcctacctctgttgttatttttgctcatgtgtttatttcctcactgttcctagaagtagaagagtagaggtacttgagaaagagtacgtgcattttgaaggatgttgatacatattgtcagaaaagcaaccttaggaagtggactagcacatgtttcaggatcttgatacatagtgtcagaaaagcagccttaggaagtggactgttttttattttttgagacagggtttcactctgtcgcctaggctggagtgtactggcacagacactgctcactgcagcctccacctcctgggctcaacagtcctcctgcctcagcctccccggtagctgggactacggacatgcagcatcatgcccggctagtttttttattttttctgtagaaatggggtctcactttgtagcccaggttggtcttgaactcctgggctcaagtaatccatcgtcttctgcctcccaaagtgctgagattataggtgtgagccacctcacctggtgaaagtggatgattaaattgtatttgttttgatataattacagaaatagttcatggtcattaaaaagttaaaaataaaaatgtccaaacttttttttttttaaccatctatctcctgctgccgcctgctgggatgaggctgctgttaacagtgttctcggaagctttttcctgccggaggaaaagcacacacacacggactcttgttttgttttgcaacaattttccacgtagctcttgacttttatgtttttgtggccaaatgaggaaaggagcccttgccactgccttgtcgtggctgtggctcacactgtcctttgaggtggggtgagcccaccagttgagtagacgggttccctcccctcccctcccctttcacggggctgtgagtgcgggaggaggagcctggtcgctcttgccagcctggatcctatgcatacccacaaggaggaagtcctgttgggatctgcccgggctcctgggaagggtcagttgggagtagaacaccctcgggtgcttggattgtgtacatggccttttccattcttggatgagcatcttggccaaacatgacacatttttagggcactgtttttgcaaaggcatccagccagcttaatctcttgtaaaatgtccagggtgagacactgcttaatgttcgtgcgttaaataaaaatgataagacagcaaggcctctttttgttaacactgttcggtgagttcagccctagaactgccgtgtagggcagcgggttcacagtggtgttcctcttctctggtatctaagccacacacccccatggtctccaaatttacacctaattccgtgtctgcaccgcctcgtgttccctcagctgggcataattcttgagaaggaaaaaaaaaaactgtaacagaacttgaggacctgtgacaaataagaggtagaaaagaaacaggaacttctcattccagggcatcgcccctccctttcaaagctcacactttggtgtcaggttgcctcttcctatctttctaactcagccttgacaagggacatgtggttggcatttgagccaagacagggacaaggccgccggaacccagcctgtctgttatgtaatgccatctctgatcggaaggataaggccgaggactggctggcctgagctccccacctcctctccgccgacaaacccctgactggtgttccatctggagtctccctgtgggtccctctcccaatgaaactggctgccgtgcccactggatgcctttttcttggactttctcctgccaccctgaaggcctcggtgtgtccaagtcatcacctttgcaaatatctggttcatctgcaaaaccctctctgcatagtctacacagagtgcggtcttccagaacttggagcagcttgagtcatcccacaggaccaacgatagataagtgcagagtccacacccggcccagccgcggctgcggccaggagcagtctcaactatgtttactcacaacactttggacaccaaatgtgtgggggtttttctcacaccgattatcagttcttcaactctggtgccaactgggtgtcctacagttcaactccattctgacattactcagacttaacacagatcccaaaggcccagggctaggtcccgcaagacggcccccacttcagacaccaggcgtaagctccgggttgcccccgttcttctgactatctgtagatggcagacttccccaacccaccccactgaggttcacatattttactagagcggctcatagcacagaactcaggaaaacagtttactaactattactagtttattgtgaaggatatgactcaggatcggccacatcgaagggatgcttaggcgggcggagggggagggcagggactccagcagcttcatgccctgcctggacgagccacccgcccggcaccttgatgtattcaccaccttggaagctccccaaacccatcctttcagggtttttatggaggattcattcgctaggcatgatggattacatcattggccataggtgattgaatgcgacctctagcccctctgccctccctggaggtggagtggtgggatgctggaggtggggtggtgggatgcttgaggtggggtggtgggatgctggaggtggggaggtgggatgctggaggtggggaggtgggatgctggaggtggggtggtgggatgctggaggtggggtggtgggatgctggaggtggggtggtgggatgctggaggtggggtggtgggatgctggaggtggggtggtgggatgttggaggtggagtggtgggatgttggaggtggggtagtgggatgctggaggtggggctcaaagtttctcaagtgaccagcccccatcctggtgctatctggggtcccccccaacagcccttttgtcagcatataaaagacacttggccaggcatggtggctcacgcttgtaatcccagcactttgggaggctgaggcaggtggatcacgaggtcaggggatcaagaccatcctggccaacatggtgaaaccccgtctctactaacatacaaaaaattagctgggcgtggtggcacgcgcctgtagtcccagctgcttgggaggctgaggcaggggaattgcttgaatctgggaagcagaggttgcagtgagccgagattgcgccactgcactccagcctggcgacagagcaagactccgtctcaaaaaaaaaaaaaaagacactcttctcaaaagacgctcttatctctcgggagattccaagggttttcagagctttgtgccaggcatcaggaacaaagaccaaacacatatttatcacaggcagcaggccctgcagggctgtggcattttcctaagggaattctcctgggtgcctgccttgcagggtatctgctcagaccgggtgtggaagcacgctcctgcccacggctgctgtgagcaggctccagtgagggctggcttggaggcagcagagcatggcctttaaacttttctccggggctctctctgcattctcttctagtcccaacatgcaccgagtgcatttatttctcctagacttcaattaccttcttacacaagagtaacaagtttctacctatgttgtctttcctcatgtcttgggagaggtttgctccagaatgtttgacctagaaggaggaaattcctatttccatatctcaagccacctgagagccagcccttcccccgcaggttcagccacagcccttccctggcacgtgggggttcagaagcttttcatgaccccttccctgggggtctgaggtccacacatcagtaaaaagatgaatgtgaatcagggcttaggaactgtgctgtgacaggtcactcactgaaaaagagttgcatttcttttaggaaatattgtaaccgaataccctcattttctttctttctttctttttttttttgttttgttttgagacagaatctcactctcttgcccaggctggagtgcagtggcgcaatcttggcttactgcaacctccgcctgccgggttcaagtgactctcctgcctcagcctcctgagtagctgggactacaggcacgtgtcaccacgcccggctaatttgttgtatttttagtagagatggagtttcaccatgttagccaggatggtctcgatctcctgacctcttgatccgcccacctcggcttcccaaagtgctaggataacaggtgtgagctactgtgcctggccctgaatacccccattttctaagaaaaagagtatgagttattgttggtttattattatttttttctcttttctttctccacttccccctgctccccactttttacttagcccttcagaaatgcaattatagcctcttacctccctttcaccagaaactgcctaccgggaaagcttacctaaccatgtgctcaggtgctccagaatgaaaccctcacccaccaggaggttgcctggagagagaacagtcgatttataacccagagtgtgcccatgatgaaactctctcccaccggaagagtttcggctgttacaatctagtcctgtccactaaggcaccactggtcaccagcttggacactcaatagataaggcgccaaagcaagttaggtgaaccctcacctgctcgcttcctccctttcatgacattcatgccaagcccccttttgaaagtgcctgctttctgccccaaaagcaaaggggtacccttaaggcagaagcctgttcttcccctaagctaagctttggaatgcaaagtcactgtctttataccagacctgctcttgttcatcatactctgctagcagccactgcctgaattctggttacagtatggtaactgtggctttcaacgtaactttcatttggaaaacttgctgatgagggcaggagctgagctggacacttggtgatctttggagacttgagtgatgtcgcctggcatggtgtggagccaggagtcctggacatgctttagttgtctgttttcagtttcatttctaagtaaatggaggctcccaatggtataaccatcagctggaactgaaagttttaaataaaagttataacccacctagtctggggaaaggcccatctcagaagccagggagaccctgattggatctgggctcgtttagggcacttccttctttctctgagccacagggtctgtgtctgttgtgtaggggcccctcccgtgcagggctgtgggaagcagggcaggcctgtgcccgtgcagtaccccgcatggcacacgttgtggcatgtgatggcatcaggtgtgcccaggccctgggtatagagcttgtatcccttctcatgagagctcaccatgctcctgtgtcagaagcatcatcccactgtacagaaggagaaactgaggcagagaggtgcagtcacttggccaaggtatggagctctgacgcagcagaggccagagtgaacctcatttggcctccagaatctagctccaaccacagcacaaaataaaccatgccattagtgtgatctttttgcatttttattacttttttttttttttactttttaaatattttttagaggtgggatctcactatattgcccaggctcattttaaactcatggactcaagtgatcctcttgccttggcctcccaaagtgctgagattacaggtatgatattatcacttttattatttcacttaagctcgtgcccccaccacatcctcaccataaaaaagacaacagagatagggaaaggagaactggtcagcactatcacgctttgcatctgtaaaaccacagctacagacggaactggacgatcgtgtggaatttcccccagaaccttattccatatcctctctaggggaaacccataactcgccctgggtgtgtgtggtgtgttgtgtgcacgtgtgttctacctgatgctgaaatacgccctgagagctgcgggattggggggtggggggcggtcccctgctctgtccataactcagggggctgcctgtttggtatgggcaccatgatttaaaattgtccacatttgtcactctagctaactgtaaacaggaagctcggctcagttgtcttttttttttttttttttttttttgctttgctttacatgatttgaaattccaggtattccattaacctggaatttatgctaaaatgctaacaggttgtgaaattgttttgaatgagggtctttcctagggcgggtggtggaggttcctcattggagaccccgtcctctgagatccagggcagatactgcccctgaatgcgactcccacgaggccacctgttcgtctggatgatggtgtatggaattctgggccgagccagcctgcaggtgcagcccgactttggcctggaggaaacagagtgaaagacctgtggtggccccgaggtttcgtcggttggtcggaatacagagcatggggcgtaggaggttggtgtggccaagtggcctggccctgtcaggaagcactagctgccagcctggagaagacctacttcccttctgctcttcatgttaaaggaactgtcttgattttgtcttttagtgtaaacttgatgaaagacaacacattcacaaacagatctttctgtgtagaatggccacattaaaccgtgtgatgcattaacaacacctccttgcagtgcagcattactgaaaggctttcttgtttaaagtatgtaacaagaaaagggaggagagtgttgctgggggcggggttggagtcaggttgacgcaggagccccacgtggtggaggcttcccccaaaagaggataaacagcagctcttggggttggccaccatcttgtttccaacccttttcatctcaatcccctgcgagaatttcttataaaaatacatctttggccgggcacagtggctcacacctataatcccagcaaattgggaggccaaggtgggtggatcatgaggtcaggagttcgggaccagcctggccaacatagtgaaaccccgtctctactaaaaatacaaaagttagccaggtgtggtggcacgtgcctgtagtcccaactactcgggaggctgaggcaggagaatcgcttgaatccaggaagcagaggttttggtgagccgagatcctgccaccacactccagcctgggcaacagagtgagactctgtctcaaaaaacaaaaaataaataaatacagttttaagcccggtgcggtggttcccgcctgtaatcccagcactttgagagcctgaggcaggctcaggtcaggagtttgagaccagcctggccaacatggtgaaaccctgtctctactaaaaatacagaaattagctgggcatggtgctgcacactcgtattcccagctacttaggaggctaaggcaggagaattgcttaaacccaggaggcggaggctgcagtgagccaagattgtgccactgcacttcagcttaggggacagagtgagactccatctcaaaaataaataaataaaaatacatctttagccgtttattttgaattagtgggcaaacaggattaaatgttgtagatgttgggataatctttagctctaatggagtttactttttaaattgagtcccagttccagagtagaaatagtattttatatccagttcatactgtcttaaaggatatttacagaggtgagactcgcttgcagagtggggaaagacatctgactaggaaatccagatgattactgaagggtctttgccttccttttatttgggagttctttccttgggtgttacagaatgtgatgaaagtgaaaattattcgagtatctaaaccttttgtatacatttcctcagctgcattgctagtttctttggagacaaaagtaattacatgatttccagttctctagagtgttctaagagaaggagccgaggcagctgtacaggaagcttaattgaaaaggaaagtgaaagggcacagtgagatctgaagactcaggggctctcttgttggtgaacagtagcaaaatctggagtaactgtgcctggaattttttggccccaagtctaaacaaaggaatagtttccagataagcgctgtttgcataggtatgtgactacatgaggtcaaggtgttgaggctggagagagcaccgagaaggtgaatgaaggcctccccgctcagcctgctcttcagccttcagtcttgttttcccctccccgtggtgcttccatctgctgcccagggctccccgacccaaaccctcacctgccaaccgtgagtccccccttggcctttccatgtggagaccctgacttaccgtgaatagccccccactccgaaaaacactctgtcacttatacagagaggaagctgtttatttggaatacaaagttcacccttctgttgcttgattttcaaatgctttatgtaaataatctttgcttgttttggggaaaaaaaatgtcaaaaaaatgcaggttgggggatggttggttgttgtcgagggagctcgctcctgcagatgcagacctgggctctgtggagttcttccctggggctgggggttcactcctgtcctctgaggagttcactgtcactgccgcctatgccaaataattgcttctatttaactttttaaaatcctgtattaatagcagactgtttcagagggaaacactcagggcccagtctgtcaattgaatagaactggaattccccgaagagctcacttggaaagctaagaagaggctctcatgaccatggctgattgtgggagggaggatctagggtcaaaatcagggtctctacccactcgtgggtatttaggtagatgttaacccttgacatctggccacttaggaaggctaactagagaggaggagctgcttacctgtgtcaggcgatcctgacttctgctgtgatgcgaggaacccctttcagcccgtgggggccctgccactgttggcatgggttgggagaatttaatccccattgtggataacaccttaatacactaaaagaagattacttgtttttaaaatctcctctccattttgtccccgtccatttggcaaatggggcattatttgttagggtggcagaggcaggggctggcgctggaagaggacttggccctaatgtttatccctccaagtggagcaggagcagtattttgtttggccatgtaaaaatttgaggcaggttcagaatgtttctttctgctggaacgcagtggcacaatcacggctcactgcagcctcaaacccttgggctcaagtgatcctctcactttacccttctgagtagctgggactacaggtgcacaccaccatgcttggctaatttttttttttttaagagatggagtcttgctatgttgcccaggctagtcttgaactcctggactcaagcagtcctcctgcctcagcctcccaaagcactgggattacaggcgtgagccaccacactcggcctaaattgtttctttaattaacttttctagccaaattctgaggggaggctaagaaaggcttggtctgcactgtaggttttatttagagggtagcgaagccctagggttggggaagacacgccagggggttactatgaaaagacatcacacattctgtcctagagtagaatgtagagattacattaccttagtgatggggcttcagtgattacttatgagctttggagtcccgcattctagaagttttaaagtctttttatctatttacttatttatttgcttgcttttaatcaagtgcttggttctctgtgtatcagggagtgcgtggtgggaagctttctgcagaactggatacgaaagaaaatgaaattctttcttgctcgggttgaggctctgagtctgttttcttggtacaatgctgattagcttagtagagaaggctccagaggaattatgcagtgctcagagtcagggttgggtttttaaatttatttttattttttattttttactttaagcagtaaaaggagtgggctgttgagaccaaggacagggaattttctcagtgtcatgccattggtgcgtgtaactcatctggccacaaagcatgttcctccgtaaaggactgtttatagatcatttatttttaacatgaatagacaacatttcttatacaaacatttttttgttctggccctttgtgaactctggagatgatggaaatatgtaattaactcatgtgtatcagtcttctgaacgtggcgttataagaaccggtagaaagagttgcacgactttctgccaatattgagagaaggcaggattttctttttctagctctgtggcattgaggtatttggttgtggatattggatgttgacccctgcccgggccttagtgcccaggttccgtttttgttccagagtgggatgggccactggtgggaagagctggacccagggcttggctgcggccaggagccagcagatgagaaagtacaggggaatgtcctagccctgaacttgggggaatagcaggccctgactgagtaattattttgataatctttccatttggtattttagattctgataaatccaccagagaattaaagaattttctcttcctgtcctgtgactccctgcagtggagtcagtggttcttttgggaatgaggaggtcagtctgacttaccctcagctcctggtagctttgctttttggccaaacactggccacctacggaacccccttgtgcctgccctgtggtccagcccactgtgcccctggcctcccctctcctcctcctggccagtacacacctggcacctggcctggtaattatcccacacgtgtctgcttggccctctgcccccgggaggggagcggggaggggtctgacctctcattctacatcagcttctgtagaggaatctgtggcagaaactagatctctctctgtgccatggtagctgtgaaaagcacccctcttaatactgtatgattatgatttatgtcaggaaaccacagtttggtttattcctgaggttattatctttctctgtctgacagtttcttcaacgagctcattttataattctggttttggtacggctgcataattttataattgtttgatactttgtatgtttttccaattactcccacctttttgaaaaccatgatcgcctcgaaattatttaggtggaagcaacccattgtgttctgggtaatttaagaaaactttttttacttctaacatctataacttactttctctttaagactcatttttagcaaaagaacttggctaatggctttgactgtgtatgaatgtggaaacatttggggaattaaaaatcagctattgtggagaaatagaacaagatgatatttaaagaaaaagactttgttggccgggcacggtggctcatgcctgtaatcctagcactttggaaggccgaggtgggcggatcacgaggtgaggagatcgagaccctcctggctaatggtgaaaccccgtctctactaaaaacacaaaaaattagccgggagtagtagcacacgcctgtaaacccagccactcgggagtttgaggcaggagaatcgtgtgaacccgggaggcggaggttgcagtgagctaagattgtgccactgcactccaacctgggcgacagagtgaaactccatctccaaaaaaaaaaaaaggaaaaagactgtattacatgtggaaagcgcatgataactagatttggtcaagactttagctgctaagaaagtcatcaggaagcaaagatttgaaacattgtttctggttttcaaactatattatagaaaaggttttaatctgaatatttatccaactttgaaactctaaatttgtatccttgctaacatataaagtccagattattttgatataaagatgcctaggccaggcgtggtggctcacacctgtaatcccagcactttgggaggctgaggtgggtagatcagctgaggccaggagttcgagactggcctggccaacatggtgaaactttgtctctactaaaaatacaaaaatttgctggccatggtggcacacacctgtaatcccagctacttgggaggctgaggtgggagaatcacttgaaccagggaggcggaggttgcagtgagccgagattgctccactgcacttcagcctgggtgacagagtgagactccgtctcaaaaaaaaaaaaaaaagatgcctatggcagctgagcacagtggctcatgcctgcaatcccagcactttgggaggccaaggtgggaagattgtttgagctcaggagttcaaaaccagcctcagtaatacaggtagagcccatctttacaaaaaagacaaaaacaaaaattaggtgggtgtgggggcacacccctgtagtttcatgtactcaggaggctgaggtgggaagatcgcctgagctggggaggtggaggttgcagtgagctgagatcgcgccactgcactccagcctgggcgacagagtgagaccttgtctcaaaaaaaaaaaaagaagaagaagaagatgcgtatgcacgcgctgtcctttgttttggatacagttttctcccttacctgtgcctcctccaggtggtggtctgtcacgtggtgggccaggctattcagttcttggtcagcgagacgcctgccttgggtgctggatgccggctgtacgacatgcggctctcccctttccatttacaggtaaagatgtgtagactttgcaagttatgagacccgtcacagttctcagaaatgtgaagagtgagcatggtgtgagtcagagggctgtaacgttcatgtttttattaattatcattcatgtcataattttcaaactgtaacctttcatataggattttctatgtaggaaatgatcacacacactacacattacacacacacactacacacacacacatacatttataataaactcaggggttgcctctttcgggcatttgaatgaggcagggtgttgttgacggatatgataaggcaggtggcatctgagaggagaaaagtagttctggttccgaatccagcgctggttgcagcttggaaacacagctgagtggctgccgtggggcattcctcttttcagtttttgacaaagttgatttaaaaagaacccccttattatttttataagttaaaaaattagtattaccattattccatgttttcataatagacataagaataaagacatatatataattttacacatctctataattttatagagagagacttacggatctctaataattacaataagcccagtgagactttggttgcccaaatcatcagagagctgtgcgtctctcacatccggccagatattcactggagttcctctttagctggtatttaaaaattgcagatgtctgggcttgtttcgagggtcactgccagttcaatgccctgtttcatctcccgtgtcccgtgtccttggacttgactcctaatttgggggatgagctcaagtcatgcagaattcccaatcacaagggaaggtgacatcctgtatgcttttcctacaaaggcatggttttaaatagccagcactaacaagatttcctggctacctaagtggcttttttctgaaatccaccccgctagttcctcagccccactccagcagcaccccctttgagggaattgaagaggtgaagagttggcatcgtggatttgtgaggcgttcatgctctcctacatcccccagatgttttggacaatgtgatgagaaaataacctgcaaagtctgggtcatatttacccaacatttgatgcatgttttggaactgaatgagaccagagaggatcacaaacacaaatgaagaaatgtcatttctgacattgtgtttattatatcaaagcattcatgccattttaagcagctcacacagaaggaacacaattgtatctttgatctgttaacacagttaggaaccaatatgtggattacctctcagcgcagaggcagctgctagagatgggtaaataattgatgctagcggcaggaggcgttcccgcttctctgatgttcctccaaccagagatgcaagagtggtctccatcgactgagctgtctgtgtcaaaacaattaaagtgcacttttccactagaattacctaatttttttcctagaattaccagacaaggaaggcaggttggagacagttatgaagtagaagtcatcgtttttctcttaccctgcttctagcatgaggtgagagtccacttactcagatagtctgaagtcgttcttcccttttgtttaggagtggggaaggaatggagatctgcaaagttaagatttttgctttggacggagcatctagctgaagaataaaggatgcaatattagctttctatggctgtggaaacaaatgaccctgaacagtttaaaacagcacagattggtgatgccatcgtgaaggaggccaggtgtccggccaggcccaaatccaggagctgtcagggctgcctgccttagcggcagtcacaggggagtctgttcgttgcttttggggttgttggtagaatttcattccatgggattacgggactgagttccattttcttgtggctgtcagtggagggccatttccggctccttgaggcaccccattttttggctcagggtgccttcctccacgtccacacccgcagggatgcctgcagtcctcacgtcacatgccctggcccctcttctcccgtgctcccccactcttcaggactcaggtgtttccactgggctcttcggaaggacccagggtcatctccccatcttgaggtcctctccctgtcgcacctgccaagtctcctgtgccctgtagggtctcacagtcacaagttccagggattagggggtgaacatctttgggggccgctgttctgtctcccaaatggacagggtgggatgaggcatccttagagatggagtccagttagaggctgctgtggcggccccagcaagagacagtaaagatggctttgtgctgcacacaatcttcagggctgtttgagtgtggggcaggggagcccacgcccaggattagaatgaggcgccctgggcccttctctcactcctctttcctttatgccttgcggatactcccagaaggagaaatgcaaagcacagcaaactatttatgttaaatagactgcaaggtttgatggcatctggttgtcgaccaccaatgctgaggttcctctttgaggggtaggttgaggccagagaaggggcaggaagggcagggggtaaagagagtttggggtcctgctctccattttgaaagcacattgtatgccaagtggaaagctaagcagttttctgtgaaaatatgtgaataaatgagcaggtacacacatacatacacacatgcacactgatgcagacatgcgcacacatacacacaggcacacgtgctcacatgcacacttccgcacacgctcaaatacacatgcacatgcacacattcacactcacatgcacacacatgctcatacatgcacacatgagcacacatgctcatatgcacacatgcgcatacacgcacactcacatgcactcatatatgctcacatagacacatgctcacatgcatatatgcacacacacatgctcacacagtcacatgcacacgcacgtgcacattaaggctttggtggaaagagtggccctctaataacttgttttttaatagctggagttccacatgaaggagaagagagaggacctccagattagctggtctttcatcagtgtgccggaaatggccgttaatatccagcccaaagcactgggggaggtcagtccgtaagtttttatgattcttccattggcgtgagaacgcacgtgtgttaggacagtctgcggtggggaactgagtgcatggctggtgttgctggcctccttccctgtcccagccactcctcctggggctggcttgggcctctcaggatgtggatgggccctttggcttggcagggcctgctgggggatggctttgatggattggatgcagggctcccacctgagctgcacctgcagtcacctggccatttaaaaaaaaaaccctgaagccttccctgccccacccaagatgcaggtttaattggctggggatgattttagcactcatatgcagccaaggctaatgacaccgtaggtacctgcttgacgctccaccatgtctgacgatcaggccctctctcccacggtgagggtgctgcactcgtaacttgggctgagtccgaaggctgcttccaagggcagggcgtcctttctttccacagtttttgcaaagacagagctaaaatctgaaggtaatttccttccttcctactttgcatggttttagtcacctgaagacgtgagattgggagcagggagtgggcttgcaaaggcgatttgtcaactttctcctctttcaccaggaccaggtggctgagacaagtgcgatgtctgacgttctcaaggacatcttgaagcatttggctggttctgcctctccatcagtggttctgattaccaagcccacgactgtaaaggaagctcaggtaaactcatctgggtgctgtgggtgcatctgaaccccgttaggcaccatggcccacctctcttggagaatctgtgtgcgttccagcgttcctccacctcccatggtagagccaagatggctcgggtgcttgctggagatcatgatggtggatgtgggataaagccttgggtttggagcatggggctgcaaagcttcatgaagtggaaggaaaacctgacatttccctgtccattcagagccctagacctcatctttccaggaccaaggtacctgggaaagcagccagtgttgagaacattgccccagaagcaagcagagccaggtgggtgggatagacagagatggtttagcctgggctagggccggcctgctgccctggtcctgcctgcaacagctcctgcctcttggaggtctgtgtcctttggaggcacacgataaaggaggctagtctcatctgtgcgacccccttttccatatcacctgcctccctcctcatgctggagcccccctattccatctgattagggcgctactcacttttctggttaaattcttaaccagagcatttgccctggtcaacctcatgggcctaaataacacatcagtaatcctttgtttaaggtgagttctctcagtcatacgctgatctttttatcatgattacgtacaacaggcacttatagtccctgaagtttaaaaaatatatttttttggcagtggttttatgtagcatgataaaatacatctttattataatgtccatctttattatctagctcttggtgaagtcagtttgaaaatacaaattcctgtgtgatgtctgtccttggtctgcagatgtcaccagctgtcagtaggtagagtctgaagactttgtttcactggacagatatcagttgatggcagtgtttgctgctaagccctggctatgggggtcacaagagtataaggaagcaccatcaccctcccgaagcctgcagtatgcagaaggggcaccgggccagcagagcagagcaggaggggtgtggatgtctggggggcttcccaggggcctgaggcctgggggcactcagcctctccaaatggaggggaccaggccatgcctcttgggaggtgagaggagagtcccagcgctgtccctttcagtatttctgtcacagtagcttatttcacatcagaggtgactgttctgaatgtgacaatcaacttttaatgtcaaaatgtatgcggcttcataaaacagtcgtatatttttggaatccatgaatttaataggacccagacgatcataacttcaatcatgcttttccataaatttgtacagtttatttaatcaaaatagcatatatgtatattatattggtcaggattttccagagaaacagaaccaatgggagtgtgtgtgtgtgtgtgtgtgtgtgtgtgtgtgtgtgtgtgtaatcagctcacacagttatgaaggctggtacgtcctgagatctgcatttggtaagctgcagccccgggagagtctgtggggtaattctagttcgagtctgaagccctgagacctaaaagagcccgtgacgtacattccagtccaaaggccactgggctcaagacccatgaagagtcactgtttcagtccaagtctgaaggcaggaaaaggcccctttcccggctcaagcagtgaaggagtttccttttactcagcctttctgttccattgcgcctccaacggactggatgaggcccacccacgagagggaggaaaatctgcatcattgggtgtgccaagttcaatgttaatctcatccagaaacacagtcagtcacacccagaatcatgttggaccagatatctgggcaccccatggcccagtcaagtcgacacatacagttaaccatcaccctcagcaattgaaaaaaaagatttcatctctgtcccagacaagtagattgctctgtccccagtgctcatgtccttggatttcagggatttcggcaattccttcttgggctccagcaccctcagctcacgtttgggaagtgcctggctcagaacagtgttttctaggtgggaaagaacacctgtgtctcttgagacattagtgagcattcccccgaagaagtgctcagtcaaatcagtgctcagtcaaatcagcacccagttttcagctctgcctgaaaacttctcacagcatgggggctggcgccacctccgagaagcccgtctgggtccctgaatgcttgcaacgaacagagcctctttaacccgcacgttgtgcacatgtaccctaaaacttaaagtataattagaaaaggaaagaaaaagaacttaaaacaaacaaacgaacaaaataaataaaataaaagaacactcttggccaggcgtggtggctcatgcctgtaatcccagcactttgggaggctgaggcgtgcggatcacctgaagtggagatttcgagaccagcctggccaacatggtgaaaccctgtctctactaaaaatacaaaaagaattagccgggtgtggtggcgggcacctgtaatcccagctactcaggaggctcaggcaggagaatcgcttgcacccaggaggcagaggttgcagtgaactgagatcgcaccactgcactctagcccggacaacagagcgagactctgtctcaaaaaaaaaaaagaacactcttggcagtgagtgacaggtggaacccggtttgggaaatgctggtttgaagctgggctcttccagatttgggggtgctttctgttggaaacgccctggtgtctgttggaggatgtgatgtggtgtctattggaggatgtgatgtggtagaagctggtcccagctgcccctgcctctgtcccctcacctgtgcagtgctagggtatgcatagactttcctcatgtggacgttggactctgtgtggaggtgggaaatgggtgtgggctgacagccctggctgttcccatctgtctggtgtcctgctctgtactagcaggccatgagtgcccgcagccagcggaagaggtcctcatgctcttaagcacctgcccgggtcagatagtttagacccatggcaaagtgagctccatcttcccccgtggtaagtaagttgtgggaaccctgtctgtggatgaatgcactgctacttgtacttgctgtatttggggtagaaaatgctcccaggcaggaggatggcgatggctcattggctccctcccttcatgtgagaagggaaattgtttcagagcagatcccagagctcgggctccctgtgcaggttttcctgtagacaccccactgccaccaccccccataacaggagtccagtggctacttccttggccctcaatctccccatgaagaccaaaaataaagtgctctttattttttcagaacttacagtgtgctgcatctactgctcaggaatcctgtcctcctaaacctccaagggctcacgagctgaagctactggtgaggaacatccacgtcttgctgctcagcgagcccggtgcctcaggtgggtgacgatgggagcctgcctgcctggaggggctcttccagcccctgagcagagtcgggggctccggggggccttggattctctggtggcatcctcccgtgggggtgcagcgggagccctgccacggttgcagaaagcacctgaaaatgtaacgggaacaagagatggtaaaaaatccaatcctgtttctgcacgtgggaaggccaaggagggaaaggagtataattggtttggcctttttcatttgtctggaattgtcctgccttttttatcttttctttcctttttttttttttttttaactgttgaacctgtatgtatgtgttaagcatccttgaccaaggtgcagcttctgctttcttttttttgagatggagtttcgctcttgttgcccaggctgaagtgcaatggcacgatctcggctcactacaacctccacctcctgggttcaagcgattctcctgcctcagcctccctagtagctgggattacaggcgtgcaccaccacgcctggctattttgtatttttagtacagacagggtttctccatgttggtcaggctggtcttgaactccctacctcaggtgatccgcccgcctcagcctcccaaagtgctggagattctgctttcttagaaagtgggtgaagggggatgtagggagttgatgggcatcagatggcttcggccacactcgggactccgatgctgggagaccatggctgctgttggagccaagacaagcaacacagaatggataaccccttctgggtggttctgaatcactgttgaggccccagacacagagtcactcgggacagggcacctctttacagcgcgactccattttgccaagaacaggagcaaattgtattgcccgagtatgttaaaggtgacttatctttatttgcaaggggcttcctccagttccaaaagcacaaatgggccacatctagcaactgagactgtgcagagctagctgttgaggatgttttttggtaaaagtgcccacatgttgccctttcagcctgtactgcttagtggctaaacgtgagctccctggactcggtcggtcagggttggggtcccagctctcacatgtacctgtcctgaggccaggccccgttcctgcctctgctggatgtccccacgtctgggtctgagtcttctcttgaagagtgactgtgaaagctcagtagcgaatgcgtggaggctgcttcaccctgctgctgcgtggtccagcgtccacacattccagcaattactgattccacagtgtattggggactttgtgctgcagggagaagcattgtctcaaagcagaaacagctgttcactagtgacatgtcctactacctggatcaaataccctggctagtatcaggtacagcacctgtctggtgtaagtcgggaaatgggaactctgtgaggtatatttccaaatttaggagtcaacacgaactgatgtttaggctttggcaaactgttagtcttgtctaaaagtggggaccatgcctgtgtatataatggtgctgcctctcggggagggtccccctgggagcccacgcttgtggccagcactgacggagggggcgaggtacttggggtcaacagcccttggctgttgatatcaaatgtgggaaaaaattacttaactccaataaaggctggtgctatgagcatttgaaaatggcagatgcaagaattcccactctctgaagtgggtaaacctcgaccttagtcatttaatttagccttttttttctatgcatacaatgtcttcatgcaatttaaaaaataaaaataatgctgggcgcggtagctcatgcctgtaatcccagcactttgggaggccgaggcgggtggatcacgaggtcaggagttcgagaccagcctggccaacatggtgaaaccccgtctctactaaatatacaaaaattagctgagcgtggaggcgtgcgcctgtaatcccagatactcgggaagctgaggcaggagaatcgcttgaacctgggaggcggaggttgcagtgagccgagattgcgccactgcactccagcctgggcgacagagcgagactctgtctcaaaaaaaaaaaaaaataaataaataataaaaataaacgccaacacgatgcccttctatttaattacaggccacattaatgcagtgtgcgtcgtgcagctgaacgatcctgttcagaggttctccagcaccctgacgaaaaacactccggacctcatgtgggaagaggaattcaccttgtgagtctggccgggttatgggcctgtgtgtccacggccgtgtctgttcaggagcgccaaatcctgaaatcattctgcagcaccgtttaggctaaaacactaaaccaaaacagttaacaacaaatgatgtcttaagcatcttaaaggtagctttaggtcaaacatgggttttgttgtaaaggcagctcttagagtcagttttctcctcctgccctgatatgatgagagggagccatcgtggggtctcttacagacacacatatcatccagggtgaaaagggagggagcctctgactgaatccagaacctaacgaagaaaatagaaaaaggcgctgggtgcagaggctcatgcctgtaatcccagctgtttgggtggcagagacgggagaatcgcttgagcccaggagtttaagaccagcctgagcaacatagcgagacctcttctctactaaaagttttaaaaaatttaaccgggcatggtggcccttgccttgcctgtagtactcctagctatttgggaggctgacgcaggaggattgcttgagtctgggagagcgaggcttcagtgagctgtgattgtgccactgtattccagcctgggtgacagagagataccctgtctcaaaaaaaaaaaaagaaagaaagtctgggaacagtagctcacacatgtaatcccagtactttgggaggctgaggtgggtagaggtcaggagttcgagaccaacctggccaacatggtaaatgaaaccctgtctctactaaaagtacaaaaattagccagacatggtggcaggtgcctgtaatcacagctactcaggaagccgaggcaggagaatcacttgatcctgggattcagaggttgcagtgagctgagattgtaccactgcacactccagcctgggcaacaaagtgagactccatctcaaaaaaaaaaaaaaaaaaagaatcgagatagggaaaaatgtaggccatgcataaataatggggtaagaatcataaataaaatattatcaaacagaatctagcagcacatgaaaaataaaaccagctgtgttcataccaggaatgtaaggatgtatgtgtgctttctcataaggaaatctgttaatggtgttcattgtattactagatcaaaagagaaaataaatgtattttctctacatatgtccaaaagacattcagtgacatttaatacccattcttaatttttaaaaacttaattagagcaaaatttatggatacttctttaataagattttaaaaatcactataaatggtaaataccagaagcagactcactaaaatcaagagaaggatgcctattttattctagaagtattggttaatgcaaattagataagggaaaaaactatacacaaataccggaaaggaagaggcaagaccaatcattgcttggagatgatatgactgcgtatcaggactatgcaagaaaatcaacccaagctattagaaagaataattgatataaggtagaaatgaatattttaaaaactaatagacataatcatttaatgaattagctgagtaccaaagtattaaaattaatcataatctaatccttaaaaaatgaacaattagaaaaagtaatggaagaaaatttcccgtgtgtgtgtgtgtgtatagcttttataaatcatgaatgaaaagatgacagctgccttagaaaactgaacaaaattcctgaactggaaatacaaaagccagagctaccaatggccataaacttctgaaaagatgttcagaaataagtaaagtcatgcaaacttcagcaaaagggagaggtcatctttccacctcacagcttggtaaagaataagagagtgataatggcattggaggtgtcactgggaataagcattctggatgccatccgtcgacctaaatgaaaaacacctctcaaatgcacatgccatttgacaggcaattagagttttcctaaggaaataatcacacggcgtgcaaagatatatgggtaagaatgtgcctctcagcttgtgtatagttatgaaatagtggggaccaccaacacattaagaagggttgtttagtaaagagttggctaaataaaatctcctaagggcaaagagcagaatactagaggcccatccaacatgatgttgctctgtagttatacagaaagacatccacaaaattttcagttaaaagaataggttacaggctgggcgcggcggctcacacctgtaatcccagcacgttggggggccgaggtgggaggatggcttgagctcaggagttcgacaccagcctgggcaacgtagcaagacttcatctctacttttttttttttttttaatgcctttgtaatgaaaataaataggttacgaaggaggagggaggtatatcatgttccgtattttgtctttaggtcattatatagctgtgctttcaatatggcagcgactggccacatgtgtctctttaaattaaattaatggaaattttttaaaatgacgttcagttcctcagcttgcactggccacctctccagtgctccgtgcctaccgcatttgacagcttctctgtcactgccatcacagaacatcctgttgactactctggaaggctagtcaccgaatattaacagtaactgtttccgaatggggaggttgcagataactctttccctttttttgcttatatgtcttggtagtttgttaaatattgacatctttgtcttcctttctataatcagaaaaaacactctatttcataaaaagaatcaagcattgcattttttaggactcataacttgtttctcttccaaagcgagttgaatgccaagtcgaaggagttacacctgcagatttcagaggctgggcgatcctcagaaggtgggttgagcaggaggacagaggcctcgccctctggaaaggtcctccgctgcatgacctcggcctcaggaaaagggcggtgggagatccagcagaggaagctgacccctcctctaaatgactttggttttcccatgggaatgtttggtcgaaaggcaatttgagttattaacaaggtcatacattttggggaaatgttcaactggattttttgtttgtttttttaaaaaaatccaaaatcttttatgcaacaattcttggcatagagaagtagttctgaaccctcttagctccaagagacctcctttttttggaaaacaaaaacaaaaacaaaaccttttaactgtagtaagataaacaacataaaatgtatcgtcttaaccatttctaagtacatagttcaggggcagtaagtacattcacacggttgtgcaaccatcacccccatctatctccagagcttttttcatccctactctactgcctgtatgaatttcactgggtttttccttgtaaaataaactacagaggtttacattgaactcaggatttatacacaagaaagcaacaattagaggtaaagtcactaaaacactaaaatgaacgtgggcctgtatgtgtgtgtgtgtacacatcagtagtttcaatatttgttaggtttttaaagatacaaatattttcttagattgtaaaactctccccataaacataccaaaattgggaagcccttgcccagcctatccagcaataaaatcaagccatttggttacctcctaaagtgagaaagttgttatttctcccagttaactagttttatatcctagttgttagcaagaatcctgaggcgacttccttgattttggagtcccgagaaaactgggatgcccgtgagataagagtcctgagagagaagcctaacgcaggtcggggacctgcacagcatgggggtgctgtttacctggagagaagtcaacttctgatcccattcctgggtccccactccttctggcctcactcaaatttcgttccagcccagcctgatggaatccatgaaatttcgaactttacaaaaacaatgcaaagaacagccacataacctttactcaaactcacgtatccttaacatttgcccagtttcctctactatttgtgctcatgcttggtctctctctccctccccttactcattttcttttacacacacacacacacacaacttgagggtaaattgtatgcatcttggccctttatcctcaattctttagtgtgtattttcccaggaatggagatactctctgctgtgtccacggtacagttgtcagctccctgaatttacattgctgcaattccttagcttatgcccatcttccagtttttgtcactggacgaccccgtgatgtccttcagagcagtgacctttccactccggcacagggccggacattgcctgcctgtcttattgctttagcatcctctgtcctgcagcgtttccacagcctttctttgtcttttatggcatcgacatttttcaaacattctgaaacgtgagcacttccccgtgggctggatgcacgggaggagcgtgttccggctgctgggcgtgtgggcctttccgtcctcacggaagcccgggaaacatcagcggcaccccttgcctgtctcctatcttttcaggtctgctggcgacggcgacagttcctctggacttatttaagaagcagccttctgggccacagagcttcacgctgaccagcgggtctgcctgcggcagctcggtgctgggctcggtcacggcagaggtagggcgaggctgtccgccgcggccgggttccggcttggggcacttacccaaggagcgtcttcacttatgtctgcagagtctcactcctgcctctgtgtgaaataagacctcctccaagaggagatgctgtttcatcgtacgcaggaccagactcgaatagagcacgttctgtccactgtacaattgagttgtctgctggaggagataactgttcaggatgccattttatggacctaccccaaaaaggcctttgaaagttttgcttggttccccagcttctattctgttgccatcattacgtgttgagctggctgtgcgtaaggttgggtctgtgtccattctgggaatatccaggttaattggagatgctaagtgaccttaagggaaggaattatgaattatggttatttcacaagaaggcagtgttacctggctgatcagcctgggcaacttccacaaaaccagaaacaagtaacgcgtcttctctgcagttctcttacatggaacctggtgaattgaaatcctggcccatccctccccctgttcctgctgcaaaaatagaaaaggaccgcacggtgatgccctgtgggactgtggtcactactgtcactgctgtgaagaccaagcctcgcgtcgacgtggggagggcgtccccgctgagctctggtgagacaacaggaacgcagtcgaggaactttctgcatgacgcctgcctgtaaccaccttgcccccacaactgcagagttctggagcctgcagcgccgagtgttaggaaattctcacagcacaggaagggtgctaattggccacacttgtgcttagtttgttgttgttatcggatgacagttatctttctcttctgccaaacacatatgcaataaactgaaacaaggttcaattcccatggtatattctgaagctaaaatctagatagtgtaaatagttgcccttaggtgtaactccaactaagttaaattaagaactcaatgatagggctgggtgcagtgtctcactcctgtaatcccagcactttgggaagccgaggcgggcagatcacctgaggtcaggagtctgagaccagcctgaccaacgtggtgaaaccccatctctactaaaaatacaaaattaactgggcgtggtggcacgtgcgtggagtcctagccactctggaggccgaggcaggagaattgcttgaacccaggaggcagaggttgcagtgagctgagatcacaccattgcactacagcctggacaacaagagcaaatttcaaagaaaaaagcaaaaacaaaacaaaacaaaacacgaactctattacctgtatgtggggacagcacacgcttttttcttgaaaaattcaaagtgagtggtccttgtagactttcttctgtgaaaaatcgtttgctagaaggcttgacggactgtcatttgagatccagctgaattctgtacctgtctccacaggcactgccttggagacagaagtttctgtataagcgtatgctttatttctcaaaattcatactgcatctctgcttgggcaaaagcattatcctcccagagtgcatgagttggcacagttcagggatgcaaaatagaatgggaaattctggcttagttaaaatgtttctgaaattttatttcaacctggactccagacaccactcttgcccctcctcccctcaaaacagctttcgttaagctttgcctttaccaactgcacacaccagagttgcagtgagggctgtcctttcacttttcggtaactgttgatccagtcagccacggggccgcttttgtaatcaggatcttcctctggcagattctccggtgaagactcccatcaaggtgaaggtgatcgagaaggacatctctgtccaggccatcgcctgccgcagcgcccccgtcagcaaaacactctcttcttcagacacaggtaactgagacacgcccacgtcgctctccctcttagcacctttgggccttttgggctgttctgatatgaagtattttcctttcagaatttggaaaaagttgttttgggcctggtgtggtggctcacacccgtaatctcagcactttgggaggctgaggcgggtggatcacttgaggtcaggaatttgagaccagcctggccaacatggcaaaaccccatctctactaaaaatacaaaaattagctgggcgtggtggcgcatgccagtaatcccagctactcaagaggcttaggcaggagaatcgcttgaacctgggaggcagaggttgcagtgagccgagattgcaccactgcactccaacctgggtgacagagcgagaccctgtctcttaaaaaaaaaaaaaaaaaaaaaaagttttgatttgcttttgttttgttaatgagtgatgagtgaaggagagggagaaaagggaactccaaattgatcagagaccaggagcggcattcatattcctgctacattttagggaatgctttaacaaaataaaaagccaactgagactttacattttaaattttctgttcatttttctcttgcacaacacgctagctacattaatagcaaataagtaggactcaggacatcgtcctcaccgtcactttaattttattcaccactttctgcttacaccagcttagtagaagtagttttcccttccactaggaaatggtcactacgaataggaaatgcaaattccctattttatggtcagtttcaggtaatagactttttgaagagatgtcttactgactcattaaatcactgcgcaatctaaatttggggattaactttctccctttgcctcctcgtgacctgctctcaggggcaatggatgcttccttcttgcttagctctcccacattcgctgagtcctgtgtctgaccttgcccaggtcaacaactgggcaaggtggggcagtcaggggagtggaaagttctcactggaggggcactgtcttaacatggtgttggattctcagcctggtgaaagttcataactgcctcctcctcttgtgggaggttttatggttttttggatactaccccgctgggtcccccacctgcagttctgggacgcaggccctgcccctcctttcgttaccagaaaaggatcttgatctagaccccaagagagggttcttggatctggtgcaagaaagaattcggggcgagtccacagagtaaattgaaaacaagttattaagaaagtaaaggaataaaagaatggctactctgtaggcagagaacccgtacgggctgctggttggctctttttctggttctttcttgatcatatgttaaacaagtggtggattattcacgagttttctacgaggggcggcgatttctcagaactgagcattcctccccttttcagaccacgtagggtaacttcttgcctttgccatggcagttgcaaactgtcatggtgctggtgggagtgtcttttagcatgctaatgcgttatcctcagtgtatcatcggcagtgaggacagccagaggtcactctcattgccgtcttggttttggtaggttgtggccggcttctttaccacatcctgttttatcagcagggtccttgtgacctgtgtcttgtgccgacctcctagctcaccctgtgagtaagggcacctcacctcctgggagtgcagcccaggggatcccagcctcattttgcccagcccttatttgagctggagccgctctggtactaatgccgctgatgcttttgccgctgcccctgatgccccttcctcagtttcttcccctggcagtgcccccactgcccatgctgcggggtcctgtcacgtgggcaggatccctcttaaaagacctaggctgatgttcccactgtgggttctgatgcatggtccatggagccggcccccaggctcacctgccacggtgcaggctgcacctggcacctggaccgggctctcgggggactgaacagaagcactgggcctggcgtgaggaggacgtgctcccgacacgtctcccttggtggctttgggaattacagcacagctttctcctaaggagtcctccccaactcctttctccagcacttctctcttctcagtgtgggtcagtggctaaacaaaaatctgttcctctactcacaacactcctgacgccaaatgtgtagattttctatggcaagcaattttctgtttctctgcagacaccaactgggtgtcctacaatttaattcaattctggcattacctggagttagctcagatcccacaggtgaaaggctcagccccacaaaaccacccttccactttagatgtcaggtgcaaatagtgggtccccaggttaccacacttttgtcccacttggctacaaattggggtttccatgacacactcctcgggttccgtaatttgctataatggctcacagaactcagagaaacactttacttgggtttaccagtttattatcacacaaatgcacagccagatgaaggggctcagggcacagtctgggagggtcctgagtgtgggagctttgatctccgtggagtcgcccctttcccagtacgtgcatgcgttggttcacaacctggacgctccctgagccctgtcatttagggggtttatggtgcttctataagtaggtatgtaggcatgattgattcacttattggcctttggtgatttgagctcaatctctagcccctttcccttccccacaggcgagaggagggcagaaagttccagccttctaaccacagggttggtgcctctgacatccagtgcccgtcctcattagcattcactcggatggggtgcaggggcttattaggaatgagaaggatgccccagctccgtggctctggaattcaaaggatttttttttttgttctctgtgccaggaaccagggaggaagaccaagtatctatttattattccccagtgtcactgttgtcaccggttcttggcctctgtggtcttatcttgactccctttggaaatgcagcatctgtaagcctcaggccatggccaaaaccgagacagaagttccttttaccatcctgctactttaatagctttgccattttgactttacctgagcaggaaagtgtaagttacaagcatcagctctgagtcagagagacctgctggtcatctcagctctggggcctcctggctgctggacatactcctcaatggtcaaatgggataaaaggaaggacctgctcatggggtgtggaataggagtaaatgagagaatgtgcacagagctctgtctctgaacagcacctggtttgccgtaagcattctattgatgttggctggtgtgtgttgttattaacctggggaaggaggtgcttttattaactggcccttcatagctctagttactattctatgtatttaggcactcttgggagggaaaaggagtcactaccttgcctttcaaagttcaaaatcttccaaagggttagatattttttttttgttgtttgcttgcttttgccattttccatcaactctattcaggtataacttaaataaataaaatcggtgaatcttaagcagacacttcagtgagtatcttgtaaccacccagggaatcaagctgtagaccaggggtcagcaaacagcaaactatggcccataggaaaaatctggcccgtcacttgtttttgtaaataaagttttactgaaacccagccatgctcatttatttacctgtggtctctagctggtttcactctataaaagctgcattgagaagttgttgcagagaccaccaacaaagcctaaacaattgaccctttggccccttttagaaaatatctgctaaccattgcttatcgaccatttccattatccctggaagttcccatggaagtctttaatttttgctgatgaacttaacactgccttccttctggtagaattgttggtgttgaatggttcggatccagtggctgaagtggccattcgacagctcagtgaatcttcaaagctgaaactcaagtcgccacggaagaaaagcactattatcatatcagggatctccaaggtaccatcgtggtggctggggaggtgttcatctggtcatctgtcagtgacctgctgctcctctgccctttgaagaagttagcccaagcacttggttaacgtccagagagttccatttacaaatgtcaaattatgttcctcaccccacaaaggagtcatgtgtggtgttgtgtttacacagtttatcctattcaccaaggacatgggagactttctaatcagggacgctttacacgttgagaggttggcaaatcatttcaagaaaaattatcgaaagagaggaacatgatgtaagactcccctttggtacagaacctctgctctcgtcaccacccagtcacggggaactttcactttccacgtgacacgtttccaaagccttttacttttttgcagtgaatgtttattccttttgtaatcagagagaaatgaacattgtagtgtcccccgtggacaccgcactccctttctcccccttctcccgctctgggacgtccgctcagagcaggtggtggcaagtgtgtggtttcagctgtggagaggccagcccctcaggtgaagggccatgttacagatccttactctttttattacattttttaaaattgattttaaaatttttatctatctatttatttattttgagaccagctaatttgttatgagactggctaatttttgtatttttggtagagatggggtttcaccacattgctcaggctggtcttgaactcctgggctcaagcgatccatccaccttggccttccaaaatgttgggattacgggcgtcagccactgctcccggcccttacttttttttgacatttccaaatgaacaggtggagggagagttgggaagattttgatttggagtaggagggggatgaggaagaattctggacaaaagagtgggtgggtgggcagagggcacgcagaagatggattcctcagtggctgggagacaggccagaacaggaccttggaggtgccagagatgagtcatcaaccttgccattgtacccagagggtggccttgccccacgtcccagaggcaggcgggtggtgttttgggggcttcctgagcccctccaggggccctcagcagggatccatgacctctctggaagtccggggcccagtagttgggttttcttcgctcttgggtgaatgaatgagcaaaataaggacaagactcgtggtcatctcccctatactttctctaagatcatatttaaaaatcacaaagaactcctggatcttagtatttaatgttctgaattcaccgcagtgattatttttattggtgctcagattatctaatctttattttattttattttatttttttgagacggagtctcgctctgtcacccaggctggagtgcagtggcgtaatctcggctcactgcaagctccgcctcccaggttcacgccattctcctgcctcggcctcctgagtagctgggagtacaggcgcccgccactacgaccagctaattttttgtacttttttaagtagagacggggagattatctaatcttgagtcagtgggcgcttccacaggctggcacttaagtcagaacagcacagttgtccctaagcaaacgcctgtgtcactgccacccacaccaagaacagcatgactggccctcagggagcccccatgccctcctccccaaactttctcccctccaaggaagggagcccccgtgccctcctccccaaactttcccccctccaaggaagcgctatcccgactctcagaggttcatttagtgcttaaatatttttacacaaaatataatttttgagaggatgtgccggtgaatttccacttgcaggtaacataaacgtgtaggaacaaagacagctaaacccgaaacacccacggccatttcctttgtgctgtcgtggactctgaaggacgggctctctctctcgcatctcatttctgcagcttgccacaaacgctcccaccgctaggcccatctgtgagaggaagagggttaacctctgagccccgggggccaacccccagctgcctagggatcctgagccctggctgtaagggagaccttttttaacccaagcatgagcaacggccgtgatgtataagcgccttctatgaggcccacggctgcatcttctgagactttgaaatcagctgtcagaatgttttggagagtgcttttcagttcttttcaaaccctcccttcctttcatgtatcccttgtcatcttccccactgcccctgacagacctcactatctcaggaccacgacgctgccctgatgcagggctacacggcctctgtggacagcacccaccaggaggacgccccatcccatccggagagggcggcagcctctgccccgccagaggaagccgagtcagcccaggcatcccttgcccccaagccccaggaggacgagctagactcctgggacttggagaaggagccacaggccgcggcatggagcagccaggtcctgctggaccccgacggtgatgagctgtcagagagctccatgagtgtcttggagccgggcactgccaaaaagcataaaggtacctgctcccgagccccccatcccgggccccccacttggtggctttgcgctcatgctggcttccaagctgaagtcatctgccttccttccctttgtcccctacaaactccctcccagcctcacccctgcccctccagaaatgccctgtgctgaatgtttgaacccgtggtggggcatctgccggtccttctgtgggagggttggcgtcatctctgcatttggggtcagtgtgtgtccatgcatagaggccccttcctcagtctgggcttgctccacctggcttcccgacgggttaccaagagctgtacacaatgatgggctgcagagactcagagcaaagccaggcagagcctggggctccttccactgccgatatggacatctttgctcctttgtgcctgtcaagagtctccctgcacctgaaacaaaaccagacctcaccacctgaccctaggaggctctacagggagaaaagctcctgggaataatgaatcggttaacttaatatgtgggtgctgaggaggtgatcatttcattagtactgattgcttccattagccctaagtccgtgctttaaaactataaattccttaagcgtgtgcagatttgccgagacagtgccttggcatgagtaacctgaatgtatttgctaaggacatatagtctaggggcttggggtccgttccagatgtgagactcaccgagcctcagcatcctcctccataagatgaggagcatggccgctgcctgcgcccacctgactccaccattcgggggacaaaaggacatcttggtgcagaagacaggactgggggcaaggcaggccaagccgtgagctcaggtgaagctcagcattaactcctggctctggctcttgtgtggggctccaaggctttcagcggaaatctcaggatgtcctgagaccatctgtgtcgggaaatcgaaggggctccttgggggagctttgttaagcgctgctgtcgctgccttttgtcctctgttcttgatgccatagaccagtgattctcaagcccagcactttttccctccagggaatatggcagtgtctggagacactttagttgtcacagctgggagtctggggtgcagtcggcatctagtgaatagaggccagggatgccactcagcgccctgccgtgcacaggacacgcccccacaaggcagcctcacagtgcagcatgctctggtcccaaatgtccctggtgccaaagcccacagcctgccatgggctggactgtctgagtctgtcctcttcccctctctccctgtctttgctttgtgtccctcagccatggcacggcggcctccctctcccatgcccccctccttgccagtgcagagtcgtgataggtgttgggggaaatggaaagttagaagaggaaagggagaaggaggaaatttcctggataagatttcagacccgttggactctgtttgcccactgcctggccttggggtgcttgatgcatggacccccctccacagagcacttgagggctgtaagctgcacgctgacctctgtggcaggctcctgtgctcctgttaagaggccttggcttgggttatgtcaaaggtgacctggtcacctgacacacacacctgtggcctattctttgtcttgtagacagtgagtgctgggcgaagcgggacaaacatgggtgcagggtggggtagctcttcctctcccttacctgactggatggcccgtttcctcttgtcctggcagaacccaaccccccgtccgccctcctcattccttctgaaatgccaagcctcgctcactctgttcatgtaaagatctgtgttccttcacacagcccctcctccttccccctgtctggtttcccttccgggaggtctttccctgggtttccatccttgctgtgtcacccaccctgctcctctcccttcacgggccaggtggatgaggggtccaccctttggggactgggtgtcgggcaggtgtgttgggggctggggctggccacctgcaacgcaggctcagaacttgccggaggctcggcatttgggaatgcagcagagaggctcagccgtgccgtgcgtttcactcctgcgcccctacctcattgaccccaggtttttgaacaggacatacttggcagcagttttaaatgtttccttccagtgcttttaaagagacttgtaattagcatctctgtgagatgctgtcacaatctgagacgattctgtgttatgggtgccaagtcattttcatttttcaaccaaacatttttcaaaactggtgatagaggatgtctttttttaaaaactaaagcttgttttttttttttttttttttttggtttaagaaccacctgtatcttttgtcctgctaaggagtttgtattcggtttctgagagtgcctgtgtatttcgaatcctcctgaggttctgctggttggaaaccagcccgcacaggaaatgtattccccaaatttttatttacttttagtttaaaaaaagatcagtgaagttggtcgtggatatactcagcaccactgagctgtgccggtagaaatggttaagagggtatattatgggtatgttaccacaagtaagcacaaaagtttcaagggaggttttcggaaaaaaaacttggaacagtaagaaaccttgccaaatatcctgcacagtggcgtcctgtgtgcgtgtggtgtctgtagatggctcagaacccttacccacgtccactctgatgttgctcttgcataattctttctgcctcttacttctcttcatctcatgctcattccctttaacttaagaggatcgctatgccaaccagaattaattgcctgcacagtaagttatttttgtcttatttttctcaattacacgtagacgtcctaggagtgcagcctgtagctcagcagccagccgacctgcctgcctcgtgttccctcccaactccgcctttaccctcctaggttgctagttccgcgtgttcctcctgacagtgctgtggctgaggttgtacagggcctatcaggtgagggcgctcgctctggtacctgatgtggccaggcgacctcgctgtgacacccacaggaagaagctggttccttttgtcgtcctccagagctaaaaagtagtcgcttctatcaacggaccatctgtggttccagttgaaatccgatgctgttcttgggaagccaaagacaattgttttttttttctggtcattgtttttctttctgctgggttttaagacagaaccttcaattcgctatttatgtctgttagactctgtagagacaaataggaatacatttggaaatatttatgacattagagctataatttagattaattatgtttaaattctttcacgtatttgtttatacttcagccttcttgtgatttgttttttaaaccttgttagaaccagggaaagacttttcttcttctccctgtctcccatttaaaatcttggttacttgcctccaatttcacataaccactccccaaattatcttcaggaatcttgaaggttgtgggtgaggtctaaatctcgcttcttgctgttggcgtagagaaggtagcctggagtcaagtagtcaggcttcatgcaatcaacatggccccggctattgttgaccgtagtgtgaacttcactatcagcaaagggcaacacattctgcgggctcaaagtcaagcagatgatctgcttgatccagaccatcagttactggatcagtcacagtcctccagagaagcagaacccataggttacatatttaaggaactgactcatgagattgacaggtctgaaatccgcagggcaggcagcaggccagagaccccggcaagagctgatgcttcattcttgaggcagaatttcctcctccctggaaaaccagtgtttgctcttagggccttcagctgattggatgaggcctacccacattctccaggataatctcctttccttaaagtccactggctggagttgttatccacatctacacaatgccttcccagccgcacctcagtgcgtgttctgttgaatctccgggtgctgcagccaggttgacacagcgacacctcacaggtgttgctcgtggaggtgggcagaccggtacattccatatggggttactgcccagcagacaagagtgtgctcctgtctcagccttgaccctcacaaccaccatggggcggctatttagtgtgcactggcaaatctgggggccctgttctccctgcatcgtttaccccaaaggtgatagtgaacaatctgcttccaagtcgaaacaggctttcccattgctattgagaaagggaatggaatggcctctgtccgcatggctggaatcctcctcccctgccccctgcatgcctctctggagacgcaactcattctgggaatcccgcccgagtccttgcaggattagggggctttgctccatgagaccccacgggctttgatgtatccacactctccggagtctcctccccaggggccacagacttgcccatttttctagacacctggctggccacttctcagacgctgtccttagcagcatggaagagcagggcctgggaacatggacttcagagccagaaagcgcaatgtcacacacccgtcccattagtgtgcgaccccagccagccacctctccaaaccttagcttcctcatttgtccctacagagtctagcaaacataaatagctaattgaggaatctgtcttaaaatcctataggtaggaaaacagtgaccaaaagcaaccctaaaaatggtagggatcaggcctccttcctcagaggcggctggggaatataattgagggtccagtctacagaactgcaaacctcagtccccacccgcacatgactgtgccctgttcgagaagttgatgccatccccctagaagctgtgacaaattatcaggttaggggaaagtgtgcaagtcacacaaacgatttcaggaagatttgcacacgggcacatatgaccataatctggtttctggcattgatgttgaactatgaaattcaacaaaacaggccaggagccgtggctcacacctgtaatcccagcactttgggaggccgaggtgggcggatcacgaggtcaggagttcgagaccagcctgaccaatatggtgaaaccctgtctctactaaaaatacaaaattatcgaggcatggtgatgtgcacctgtaatcccagctgcttgggaggctgaggcagaagagtcgcttgagcctgggaggcggaggttgcagtgagctgagatagcaccactgcactccagcctgggcgacagagcgagactccgtctcaaaaaaaaaaaaaaaaaaaaagaaatttaacaaaacagcagacatgctctggagagcgtgagtgaagatggaagaacagaaaataaccttgttaccagcccctctcggtagggtgtaagaagaggcacagagctccctggggcagaggtctgccactgaaacaagttagtccctcagggtatggacagacaacagactggagcccggagtgaggttaaaacaaacatgccgtgcgaatctttcttgtctaccatctttttacatgcaggctgcaatccttgctatttcatcttaatatgccaagaattagaattttaggcagtttttatttttattattttattttattttgagagacagggtcttgttctgtcacccaggctggagtgcagtggcaagatcatagctcattgtagtctcgaattcttgtgctcaagcaaaacacttacctcagcctcccaggtttaggcacttgtagtacaatttcacttgcataaattatcataactgcttgaaaatgtgcatatcccattttatttcttttaaaaaaagtttaatttttttattttttaaaaatagagatggggtcttgctgtgttgcctaggctagtctccaattcctgggctcaagggattctccaaacctcagcctcccaaagtgctgggattacaggcctgagccaccgtgcctggctcctgttcctgttctaaggtcttttgaacacagccgtgccttgcctgtctccacacccatttccctcttaacctgggcgcaccgcgcgtctctggcgtggcaccgggccctgcgggtgggctgcgtcagcttctacccacacagccctgtggtctgccggcccccagagtgaagtgcgaaggagcatgagcagcgacatgcaggagagcaggtatggtgcctgtgtccttggccctggcctgctcctgcgttgtcggctgtggcctccgagtgctctaagcactagtggcattttggccagacccgggctagcagtggataaccccagctgcatgttcaaaagacctgggaacttttgaaaaatgctcatgcccagtgtccccagacccccatcatgccagattctccaggaagggcctgcacgcctgttgtccttagaggcctgttgtttggagggctcggggctgaggatgctgcttcactgtcctctccgcctccactcctccatgttgctgcctgggttctaaggactgaacaggaagacatggtggacgttcctggatccttaagccaaatgcgccccctcccctcccagggctgtatcaaagtaccacaaactgggtgtttgcaacaccaggagccaattctttccctgttctggaggctggaagtctgagctgctggtgctagcagggccaccctttctgaggccctgtgggagagcctgctcccgcctctccagctcctgacagctgctgacaacctttggtgttccttggcttgtagaagcatcaccctgtgctctgccttcatcttcacgtggcatccttcctgtgacccttcacaatgtcttcccttgcgtgtctgtctctgtgtctaaatttccccttttgataaggacagcaggcatattggatcacgggccaccccaatgatctaattttaagttgatgacttctgcaaggaccccatctccaaataaggtcacattctgtgaagtactggggattaggactgtaacatatgaatttgggtgggggtgggggagccaagttcagcccataacattgtccctgctcatacctcaggcctggatacagacgccaggccagcttcagtgcagggacgcctatgaaatggactttggaggtggagcaggagggaacctctcactgctgggggttctgagtccttgggtctgtggttgaccccagggggtgggttggcgttccctccccctaggcctccatttcccctagaagtgaagggggtgacgttggagcagtccaggtgaagctgatggatccaccccttcctctcccctgttccacctgggagcccttgtccataggcccttcagggcctccaagatcagcctaaagcagagcttcaaggcaggtgcaggtgcctatagatcagaaacaccactgaggtccccctcatcccccagcctcaggtcacctggtcagctcagagccccctgacagctgggggttcctctgcctgggagcccctatcaccatgcccagggcatttccccagcaggtgccctctgatacaccaggcagttagccacatcagcaccactgtatctgccccactggccaaactccaaagtcatgtccagttgggggtcattatccacctgtcagaacacaccctgctgatggctggtttttcacgatgtgctgcatttttcagggacgtgactcactccaggaactgacactgatgtcccacaggtgtgccattaggcctgtggacaacagggacatcatttacacgttgatactacttacccgcctttttcattccttttccagcagtctccgaagctcctgcacacaggctcctaactttagatcactgtaaaaaatgtcactacttacccacctttttcattccttttccagcagtccccgaagcccctgcacacaggctcctaactttagatcactgtaaaaaatgtccaaatgacacgtcataaaaagtgatttggttgtgttgagagagtcaagtttttaaaaaattatggccgctttgatcaaattaaattcagtccattgcggcctttcatcttctcagtttctgtcctgtaacctgggcagagcagatgggacacagtagttcctgcttgaagtcaggctcaggggcacatgcttctttccccatagtaggctttgattatacaaagattcataggcaggtctaggtcaggtttctccgactgccctcagatgccacaattgttggtgtgcatttcatttagaagagggaattgatattcttcgtgccctccttcaacctcctcaacatgggtggcgatttgcatatgtcgtggctattgaaatgtttattggatatgcctatcacaaagggaataaattatcacattaggtataaagctcctcttcatgatgatcagacctgtcttctttcaaagtcattaccacctacatgccagcggtaatgaatttcacaggctggcctgaaatgcttactccctcgaccttgccagccttggttaataggatgttaaactaatctgtgaaaaagcaaattagtgggctcttgcacccactacattagcttgtacttgatctttaaggaatcattgctgttgaaattattgttgctgctgctgctaatttttttctattccgtattctactacctgatggatatctatagccaggtaaatatctgtatatagagatctgtatctatctgtaagcagatacatcgaaccacacaaaattgacgttttgtaggccaaatatgcccaagtaacaaacttcagatggcatagcctaatatgataggatctggaattattttttaataaaatcttattcccaaaagagcaaatattatttaacattcctaagaaagtgaataccattgttctcagggtcttaattgggttttatgagtgtgaccatcctttctgggacatagtactgctttgccagctacacccttcctaatgaggggaagtgggtggcacagaggggacccaggtatcccaaccgaggcaatagctgtctgcctccatttggtctgatagaaaatcagggatataagccaggtgtggtggctcatgcctgtaatcccagctcccagcactttgggaggctgagggaggggtggatcacctgaggtcaggagttcgagaccagcctgaccaacatggtgaaaccctgtctctactagaaatacaaaaaaattagctaggcatggtggcacacacctgtaatcccagctatttgggaggctgaggcaggagaatcgcttgaacctggaggtggaggttgcagtgagccaagatcgcgccactgcagtccagcctgggcgacagacagcaagactctgtctcaaaaaaaaaaaagaaaaaaaattcaggaatataaatatcggccttagaaagggatatcaagcgatagttcaggcttactgcttctactgttataatctcgtttccttttcatcttgaaaactctcgttttgtacaagccagattccagttatttttctcatgcaggtagtgacagcatattgaagtagtaaactggcccttcgttagaggcattcgagcctccttttccctttgtccgattggaccagtcattcagcccctcattccctgcccacttgaccagcccttgtgcctccctcttccaggaggaattctaaggaaaggtgcaaagctgttcttccgccggcggcatcaacagaaagacccaggcatgagtcagtcacacaatgaccttgtgttcctggagcagccagagggttcccggaggaaaggcatcaccctcaccaggatcctgaacaagaagctgctctccaggcacagaaacaagaacaccatgaacggtgcccccgtggagccctgcacgtagggcctgaggtcatcacctccaagccagaagacgtgcacccatgttaactaccctcaccaggacgcagccagtgtgtccgccggatgtccagatgccccgcttgtcttgctgggtttcttccaaccatctcgtcatttaaagggaaaacaaaatctgagtctccagccaggaggcttctcccagagaggacaaaaaagcccaacttgccaccagatgctaaatgagacttgacagctgcagagcttgggctgtgctcatagctaagggttagggttcaatattagaaggagattaacattataagtgaaataatatgctctaatagattgtggagggcaggtttgagggacttagtttacctattctacactaacaagtgttgttttgggtccatgcctggaccatgtcacaaaaaggaggtgcccccctgtgctgtcactgtgaatggaaaggatgggtcacctctcttcatctgctgcttggaataaaaaatgcagctggccctgagtacagggaagtggaacataggcaggattttggattaatagagaaattttgataagaatggagacgctacgacagatgtaggaagtcatctacctttgatattagccatagaacttgaacactaactatatcctatgcatagtatgcagaacacttttctaagtttactttgagcctacttgcaagtggaagatatatatattctcacatggtttttacatttttctctatcgtgttaaaagctctaataatgctagtggagcagttgacatccagggttttttttcctgcctgtcatacttgctaaacaagagcacagcgggcctgtcagatgaagtcaggagccatacgtgaccgctcgtagaacacagtaaccaaacacatacatggattttgccaagtgctgccagtagccaaaacaaagtctttttagggcaatagaggaaattattttgtgtctcaggtgtcagtcttaggaatggaagtttaataacaaatgggccaaactcgcaggacattccttctatgagcgcttcagaattttgctgtgaacagtcctcttggacacaggttggggtgcccttgtttgggtttgttttggtggaaaacatcacaaacctggcacaccatttgaatatccctaatatcattccagtcgctttcctcatcagttgcctttctatttcagttcattcacagatctcacttctgaatgtgccacttccagtagacatgctggtcaaagagcagtcatcattggggtgaagtgttcttgacagtttaatatgattcacttttctccaaagacatgtaaaaggctgttacgaaagcttggcttctgtcatggagacggaaatgggcaagcttccttccgtagcctcttgttaatccttaaacattaaatatttcgggggtaatagagccactggtgagtaaaaacctatataaaaaccaaaattataggattttttcttttttagtaaaaaccggtatcaaaaccaaaattataggatttttttcttttttagtaaaaacctatataaaaaccaaaattataggattttttcttttttagtaaaaacctatatgaaaaccaaaattataggatttttttcttttttagtaaaaacctgtataaaaaccaaaattataggatttttttttcttcttttttagagagagagattagaaaacgacattaggaatttcactttaaaatgcgcattacaaacttcttaggtgttccaggaattatcaagtgactttaaaatgacttttccaacctgctttgtttttaaaaattatattccagttttaatcattgtaaaaaaagcacctggagtttcaaaacatgtgaatactaccaagtttctgtccccaaagtcaggcatcactgttagtcttttgggacagatgggacagatgttcactttaatgttttacttgaagttttactgctctttgccatgtggtaaaaagaggctgagacatatttaagaattccaagaggatattatgtgtcagaatttcagacactgatgagaagtttttaattgttcttttttatttgattttggaattcaggtgcactctattcaagtgcaaggatatcagaagtttttttttatttaaaaaatttttttttcgagatggagtttcactctgttgcccaggctggagtgcaatggcagcttactgcaacctccacctcctggttcaagcgattctcctgcctcagcctcccaagtagctgggattacaggcacgcgccaccacacctggctaattctatttagtagaaatggagtctcaccatgttggtcaggctggtctcgaactcctgacctcaggtgatccacccaccttggcctcccagcgtgctgggattataggcatgagccaccaggccggccccaggattttatattaagccttcttgctctcaaaaaaaaaaaaaggttttaactattccatttccagatgaatcccatgagcgctgcttactgttgaataccaaggtctagggctctgcttcctgtagacacgcacacgttgtctccatccaatggccttttctgaagttacagaaaacaccaacatgggagggagtttatgaagcaaaggcaaaggcaacacgtcggctagcttcagggtagcaccgtgagaaatgggctgtattgatactgtgaatgtttgttttccaagctgttttatacaggtttgttttttcatggtgtagggtatttatgacaaagtaaatgttgtgaaggttaaagataaattaagattatccaccaaatgctaaaaatactgatgtgtaaatcacctttatcgcctcacctcttctacaagcttttgtggcttgagggcttttgtttttggcttttgtctggatgaaagttttgcccagttgtgttttaaaaacaattcctcatgaacactaagattaattgtgtctgtatctctggaactgggtgctcatgttggttttaatgagcttgcaacccttccccgtttgctttgtttaaggaggtgcctctgttctttgtggaggagtgaaatggagctttaagtgtgtgtgtgtgttatgtgtgtttgcacacacgcgtgtgttattgtagcaataacaaaaagtagccatctccttgttccagctgaaaacctgctgtgagagttttgacagagcactttattttcgtcaagtttcaagtctgagttcaaaaccagccctgatcccttatgaccaactgctactcgaccagtcgccactcagtggccacctggtgcccgtttagatttttgcttgggttttactggccacctctatagacgagagttgcaaagttgctttgagcagagagggaaagattaatttacactgctggccaccgaaggcaggtgtttcctgggtagtaatctcacggctcttgatctggaaacttcagagtacaaattggtggatggtggaaggcaggacacgtatctctgtctgacggaaaacagacctcggggctggcgtaaaccctgctgccaggccctctccccactgccccaaaccggcctagacacgaagaccaaagcagcctgcacagggcaaggcccccgcggaatcctgcagagcaaactcaggttaacttgggtccatgaccgtttgcattcgaaacacaatacactgcctcgttctctcagttagcagctgggcagcagcgcaccattcatcatttaggcttgtggtttgttgtttactctaccaatgttatgtcgaaactgcattgtaaaaagagaagaaagtggcaggttttccaggtccacggaaaggtttggcctgacgctggagtgcggtgatgaacttacgtgacaatgattgtattcctcagtagcactttaaacgccgaagacagccctgcagcaagcctgcacacgggcttgggtgggttcctttggagaagatgtggctggaacacaaacaatctttgaaagaaataaatgtgcacacagaacact

SEQ ID NO: 37814 - DNA, 82145 bp, Homo sapiens
gcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcggtgagtccccggcgtgcgccccggaccgcggccccctcctcatcctccgccccgtccctgtcccgctcctcttcggacccgccccggccgtaactctgtccccatccaggcctccttcccggtttgggtcccggcccctctccgttcccaccccggtacccgccccagttcaccgccccggccggtccgcgaccccttccaggttcaggtcgggttcttgtccccggcccttttgccagccccggctcccggcgccgcgcgtcctccccatccgcgtcccactgcaggttccggtccccggccctgcccagggccccgccctggccccgcatccccggcttggccctgctgcgggcggcggcggccgttcccggggacagctgtggaccccgggaacccgcgacaggggaggtggctgaccccgggatcgcggcgggcggggaggccggaggcccggcggggctggctttgtccgattcctcctcttccttccacccccgcctctcccggcaccgccctgagcggacgcgcctgtcattctcgcgggcggcggggggccgggtccctcccgagagctggctccgctttgcctccttggcgaccccttattttcagtaaccagatgcgaaacgtttcaggcgaccctgttcacctaggctggcgttgctccaactaaacttgaagcagcctccgtcctggaatgctttttccatgtaaaattgggtgtacccttttccttaagaaaattaaaataaagcgtaaaagtagtgaaattaatgcgtgatggagtggatggttttataacttaacatttgtaggtcatttctaggtatatttgtattagaattgttgctgcctgttactgttttattatttaaatgaattaagaatttacatattaagcgtttgaaaaggaatacttacaaaaatgatgttttttaaaaatgtgagaacaaaaaatttgagatatactatttcaggtgttctgtaaaagggcagttagagctttgattctttgcattagttaaatcccaaggcctttttttttggtacggcatgactaagccattgatcagaatcagctcggaatacattgcactagtttagtgaaagacactttagaaaactggaagaacctcctgaagttatattacagacatggccttgcttctttcagggattgtcagcaagcctgttatggtgagaaatttgacctattgctctgtttcctaaatatttgtaggaatacaatgatactaagtatgaagtatatttcaacttgtatggaattctgtgtgggagggtaggcactctaaagagccagtgtctctccaagtcatcaaagaatgcagcatcatgttgcagttgagcctggcagccctgtctggcactgagtgctgtggaggacccaggtggtaacctctaaccctactgcagccttggcattgtcttagagaaaagcatccagacatgcacaggactctggacagcgtttatctccagcaaggggggagggaatgacactggggagaggcacacagtatcttcagtatttcatagcaaataactgcagtcgtttaaacttacacattttttttttttttgagatggagtctcgctctgtcgcccgggctggagtgtagtggcgcgatctcggctcactgcaagctccgcctcccgggttcacgccattctcctgcctcaacctactgagtagctgggaccacaggcgcccgccaccacgcccggttaattttttgtatttttagtagagatggggtttcaacatgttagccaggttggtcttgatctcctgacctcgtgatccgcccacctcggcctcccaaagtgctgggattacaggcgtgagccaccgcacctggcccaaatttatacatttttaaaatttatacattcttaggcatgtttctcaatgttggaaaaaagtcaatgtgtaactttctgtatagggccataaattatcttaaaacatacttgtataaaaagaaacctaggatagaaaaatcaaaagttgagtgaaatgtatgattagtatcacctgaaaacattctttgtagataagtggaatgttagaaaccagtattttatttttatttatttagagatgagtctcactgtgtggctcaggctagagtgcagtggtgtgatccccgctcactgcaacctccgcctcccaggttccagtgattctcctgcctcagcctccctagtagctgggattacaggtgcccactaccacaccaggctgattttttgtatttttagtagagacggggcttcaccatgttggccaggctggtctcaaactgctgacctcaggcgatccacccgcctcagcctcccaaagtgctagggttacaggtgtgagccattgcacctgggctgaaaccagtattttatgtagcaaagaaatgatcagtaatatactcaagacgagagtatttgggaagatttaagtgtcaaatttcagggcatagaataaaagtgacaagcacattaagattgcaaatactggtcttaaatgtctgttgggaaccaactgaatggcaggtactgtgctgagtagtcagcgataccttgataaaagagccactgttggccgggcgtggtcatgcctgtaatcttaactctttgggaggctgaggctgcagatcgcccctagctctttgggaggccgaggcaggtggatcacctgaggtcaggagtttaagaccagcctggccaacatggtgaaaccccgtccctaccaaaaatacaaaaattagccaggtgtggtggtgcacacctgtaattccagctactcatgaggctgaggaaggagaatcgcttgaaccgggaagtggaggttgtagtgagccgagatcacgtcactgcagtccagccagactccgtctcaaaacaaacaaaaagagccgctgtcagccgtgcagtggctcactcctgtaatcccagcactttgggaggccaagatggaccgatcacctgaggtcaggagtttgagacccgcctggacaacatggtgaaaccctgtctctactaaaaatacaaaaaaaaccaaaaccgggtgtggtggcgggtgcctctaatcgcagctactcagaaggctgaggctggagaatcgcttgaactggggaggcagaggttgcagtgagccgagatcacgccattgcactccagcctgggcaacaagagcaaaactctgcctcaaaaaaaataaaaccaaaaaacaaaaaaactctgtcctctaggagctcacaggctggcatgggcaggtaccacagaccaggttaaaggctgtggagtgcactgaggaggcgattcttcacaaaagaaaagtaccaatcagccagtgtcagggggtcaggggtgggattgggattggggttcctgcttggaggaaataaatcctgaggttgtgctgctgtaaaggggcatgttgggaaggggacatgggagtgagtgtggaaagacgaggttaggaaaggccttgaatgacttcttagaagtctgctttcattctgaggtttacaaaggagggttggaagattttttttttttttgagatggagtcttgctctgtcacccaggctggaacgcagtggcacgacctctgctcactgcagcctctacctcccaggttcaagtgattctcctgcctcagcctcccgagtagctgggactacaggtgcgtgccaccacatccggctaattttttgtatttttagtagagtcggggtttcaccacgttagccaggatggtctccatctcctgacctcgtgatccgcccgccttggcctctcaaagtgctgggattacaggcgtgagccaccgcgcctggccggagggttggaagattctgaggagccagttgccactttagaaagagcataggcagtggtggggcaggtgctgtgaactgggatgaggttaattaggaagccattaaccccaactcggcaagcctcaggattagggcagtgacagaaggaacagagaagctaggtgggggcaggggctgggctgtaagggttatagtggagctgatttggggctgactggattggggtaaatgaggagctgcagggaggactccccagaatgatcctgtgaaaacctgagtcactcctctgttaaagcttttgtcagtgtcctctgagcaccccaccctgtctcttttcatcttcctgctctggccctactcaagcacttccaggtgcatctggagttctgaaccaaacccattcttgtagtgattagcatttcttcacttccccacatactccttagcctctgccctgatttttctccttagcacacctcactatcttaaatgctgtattattattattttttttttattattactttttgagacggagtctcgctctgtcacccaggatggagtgcagtggcatgatctcagctcactgcatcctctgcctcccgggttcaagccattctcctgcctcagcctcccaagtagttgggactacaggcatgtgccaccacacctagctaatttttgtatttttagtagagacaggatttcaccatgttggccaggctggtctcgaactcttgaccttaagtgatccacctgcctcagcctcccaaagtgctgggattacaggcctgagccaccgtgcctggccaatactgtattattttaatcattttaaaatttttattgtttgtctccacttaacattcataacctccacaaggatggggagttttgtctcttgtattcagtgtcggtgcttggcgtgtaataggaacttagtaaatgtttgttgaaggaatgcatctagaatgatcctcatctctaatttgggtgattcactggctggtgacactcatccaaggagggaaaatgggagaaggatgagattatgagtttgtttttggacatgttaaatctgaagtgcttgtggggcagccaagtggactagtgggcagttagagatacatctttggagctcaagacagaggctgaggctggaggtaaagattccagagactgcatcatatcgttgagccagtcgggtgtgatgtccatctggtagagatggggagtgggtctaagaggagagggtcctgggaaaccaagagaagaggagggaggagatcagtagcaaattggctaagaagtcagtgatgggttggactgagaagtctctatggattttgcttctaggaggttactaatgacctttaacttttttttttttaaatatagtttatgtagagacgggggtctcactgtgtttcccaggctggtctcgaattcctgggctcaagccatctgcctgccgtggcctcccaaagtgtcgggattacaggtttgagccactgcacccggcctgttgcctgtttcctgagaatattacctcttaaggatggaggctatttcgagatgatcttcattcgttctcccaaggcatcctttgtggcgttgtactctgtagcctcctagttagtatactcatggatcagaaatgaattatgatttttttttagttttaactaatttttggaggcagatgaaagcagtttgcatatatgctttttgaatttgaaaagtgctatctgaacttaaagcaacggatatggagcaaacatgttaagctgagttacgtgcatacgtgaactgagttacttccttggttctaaaatatctgttaccttcatttaaaccatagattgttccctgacttcagttgcataacataaatttatgttcaggcttctctgaagttcactatgctgctactaaaactgatcagagtgatgtttgcactgttccagagaaaataggtactgtaaaccctgcggatgtcatatgtgtctgtagtttcagttactccgaaggctgaggtgggagaatcagttgagcccaggagttcaaactagcttgggcaatatagtgagaccttgtttcttaaaaaaataaaaggctgtgcttggtggctaatgtctgtaatcccagcactttgggaggctgaggagggcggatcacctgaggtcaggagtttgagaccagcctggccaacatgggtgaaaccttgtctctactaaaaatataaaattagccgcgtgtggtagtatgcttctgtagtcccgggtatttgggaagctgaggtaggagaatcacttgaacccgggaggcggaggttgcagtgagccagatcgagccacggcactccagcctgggcgacagagtgagactcccatctcaaaaagaaaaaaaaaaagtaaaataggtactgttactgagattctactgttgaggaatttgagggtgagagaggggaagtttcagaaaccaaagttacacagctgtgaagtcaagattctaactcagtttttttgcttcgcggtataagctttgaatcaccttgcagtacttaaagctgcagcttcaagtgaatcatgataatgctgtttaatcctatcattactttttcttggggaaacctcgcgccacttcaatttttttcaaagatgtaccattttaaccatttaaaagttcacaattcagtagtgttaaggatatgcacatcgttgttccacatttctggaactctttcatctggcagcgctgagactgtagcccccaaatactgatatctcctcctccctcgccctcccccggtaaccatcttttctactttgtttctatgattttgactactttcaatactttattttttattttttttgagatggagtttcactcttgttgcccaggctggagtgcagtggcacgatctcagctcactgcaacctctgcctcccgagttcaaacaattctcctgctttaatttcctgagtatctgggattacagtcatgggccaccatgccgggctaattttgtatttttagtagagatgggtttctccatgttggtcaggctggtcttgaactcctgacctcaggtgatcaccccccatcggcctcccaaagtgttgggattacaggcgtgagccaccgtgcctggccttgcctgtctttttcatctgagccattctagcggggtatagtggcatcttgttagttttaatgtgcatttcactgatgactcataatggtgagcgcttacatgcttgtcggtctttgtatgcctggatttgtaaagtgtctgttcaagacttttgcccatttaaaaaattggattgtttgtatttttaagttccttacatatttatttatttatttatttttgagatggagtctcctctgttgcccaggcttgagtgcagtggcgcgatctcggctcactgcaagctctgcctcccgggttcacgccattcccctgcctcagcctctggagtagctgggactacaggcgcctgccaccacgcccagctaatttttttttttgttgtatttttattagatatgggtttcaccatgttagccaggatggtctcgatctcctgacctcgtgatccgcccgtcttggcctcccaaagtgctggtattaacaggcgtgagccaccacgcccagcagttccttacatgttttttttttttcagatggagtcttgctcttgctctattgcccaggctgacgtattttttatacaagccgtttgccagatatatatgtgtcgcaaatattttttcctaatctatggcttaactttattttttggtagtgccttttaataaatcaatacttttaatttttcttaaccatgctctggcaagttttattaaagaaattttcggctgggcgcggtggctcacacctataatcccagcactttcggaggccgaggcgggtggatcatgaagtcaggagtttgagactaccctggccagtatggtgaaaccccgtctctactaaaattacaaaaattcgccaggcgtggtggtgtgcacctgtagtcccagctacttgggaggctgaggcagaagaatcgcttgatcccgggaggcagaggttgcagtgagtcgagattgcgacactgcattccagcctgggcaacagagtgagactctgtttcaaaaaaaaaaaagaaattttcgcagggtttatttttatcttttattttttgttgttgcctaagcaacatccgctttccttaattctgaaagcatatctataaataagtcacccaaaggccaaatagatgcatttgttttgtctggttgttaatgttttctttttaaaaaaatatttatgtatttatttaatttttgagacaggatcttgctctgttgcctaggttggagtgcagtgtcacagtcgtggctcagtgcagcctcgtgttcaagtgatcgtcccacctcagcccctgaagtagctgggactacatgtgcgcaccaccatgaccggcttgttttttgtagagacagggtttcatggcattgccctggctagtctttaacttctgggctcaaatgatctgctctccttggcctcccaaagtgctgggattacagacgtaagccactatgctgggccaccaagatactatttatttccctgaatatgacgtggactgttcctgtaggctggtcccttcacctcaggaccctctttgctggtattgtttggggcttctgcgcctgtatatggggatgggacctgaccctgctgatctggccagcactgccagggtttcctgttgcccatctctcggtaaaacatcccttataaacctttgcaaggaaaaaacctctgttttcttccctccatcccatttttccttaatgtgctaccctcgtctgtattcataggaactttatttaacacttgagaactgagagtaattgacatttctttcttggctgtccttcattctgtgcacccagacctattgctttttctaccacattctttttctcttttagaaaattgaaatgtaagtcacatcacatcaaatgccccattttaaagcgtgcagtgcagtgatttttaatgtattctctgttttgtgcaactaccatctatctaattccacacattccttttccctttttagtgcttggtgttttttttttttcttaactttcttcatcactgtaagctttccccacctggctgaatttcacatgataaaaccaggggaggtaaagtgaccaaagatgatgccctttgcttctctggcctttgctttcatttcattaatttttttttttttttttttttttgagtcagagtctcgctctgtcacccaggctggagtctgggtgtatatgtatgaacacagtggggtgtgtgggtgtgtgtgaacatagtggtgtgtatgtatgaacacagtgggggtgtgtgtgcgtgagcacagtggtgtgtgtatgtatgaacataggggtgtgtgtgagcacagtggtgcatatgtatgaacatagggtgtatgtgtgtgagcacaagggtgtgtgtgtgtgtgtgcgtgcatgcagagtggtagggttcctgaagcagagggacacttggggcaaagagaccttggattgtgttcttcttgttggtagaataagcttaaatcacttcatgtatcccagtttcctcagctgtaaatgggaattataatgataggtcatcaaactacctgcagactttttttgttgttatttcgataaaatattacacatttgaaaatgctcccaaaactaacatattggacagatgcgaattcttctttccttttttttgagatggagtcttgctctgttgtccaggctggagtacagtggcatgatcttggctcattgcagcctcagcctcccaagtagctggaactacaggcatgtgccaccacgcctagctaatttttatatttttagtagagatggggtttcaccatgttggccaggctggtcttgaactcctgacctcaagtgatccgcctgcctcagcctcccaaagtgttgggattacaggtgtgagccaccacgcctggctctttcttgtcttttacttatttatttttttgtgacagggtttcgctgtgtcacctaggctggagtatagtggtacagccaaagcttactgtagccttgagctcccaggctcaaacaatcctcccaccttagcctcctgagtagctgggaccacaggcgtgtgccaccacacccaactaatttttatttttgtagagacagggtctcactgtattccccaggctggtcttgaactcctgggctcaagcagtgctcctgtcttggcctcccaaagtgctgggattactggtatgagccaccacacccggcccagatgtgaattctttatttttattttattatttttgagacagggtctcaactctgtcacccaggctagagcacaatggtgcaatcatgtttcactgcagccttgatttcctggactccagtgatacacctcagcctcctgagtagctgggaccacaggtgcatgtcaccacacccagctaattttggtatttttttttaggatggggttttgccatgtttccctgtctggctttgaaatcctgagctcaagagatccacccgccttggcctcccaaagtgctgggattacaggcgtgagccactgagtcaggctgtgaattctttcttttattttctttatttttgagacagagtttcgctctgttgtggagtgcagtggcacgatcttggctcactgcaaactccactttccaggttcatgcgattctactgcctcaccctcccgagtagctgggattacaggtgtgcaccactatgcctggctaattttgtatttttaatagagacagggtttcaccatgttgaccaggctggtctcgatctcctgacttcaggtgatcgacccaccttggcctcccaaaattctgggattacaggcatgagccactgcccctggcctgtgaattcttttttttttgagacagagtctcgcgctgtcgcccaggctggagtgcagtggcgcgatctctgctcactgcaagcgtcacctcccgggttcacgccattctcctgcctcagcctcctgagtagctgggaccacaggcgcccgccaccacgcctggctaattttttgtatttttggtagagatggggtttcaccgtgttaaccaggatggtctcgatctcctgaccttgtgatctgcccgcctcggcctcccaaagtgctgggattacaggcgtgagccaccgcgcccggccctgtgaattcttaatatacatattgtatgtatacttttttggttttgtttttatcaagttatatatgtattttgtatttatgtgtagatttgaaaataaacttttaattttagaatagttacagatttacagaaaagttgcaaagatagtacagagagttcccacatactttgcatccaatttcccctaatgttaatatcctacattactgtgatacatttgtgacaaccaaggaaccaacattggtaccttactattattattactattattttttttttcttttgagacaaagttttgctaggtcacccaggctggagtgcagtggctccatggctcactgcaacctctgccttctgggttccagcaattctcctgcctcagcctccctagtagctggaattacaggcatgcgctactatgcctggctaatttttgtacttttagtagagatggggttttgccatgttggccatgctggtctcgaactcctgcccttaagtgatccacctgcctcggcctcccagtgttgggatcacaggtgtgagtcactgtgcccagcctggtacattattattaactgaactccactttatttggtatcactggtttttcccttgtccttgttgtacctcaggatcccatccaagataccatatcacatttagtcatcatgcctcctgctctgtggctgttttcttagactttccttgcattagaggactgtcttagcttgcgaggctgtaacaaagtaccacaggctagtgactcacgaacaacacaagccacagtcctggaggctggaagtctgggatcagggtgccagcatggtcagattctggtgcagaccctctttctggttgcatgctaccgacttctagatgtattctcacatggtgaaaagagtgtgagagagttccctttttaaaaaaaatttaataataattatttttttgagacagagtctgtctctgttgcccaagctggagtgcagtggcacaatcttggctcactgcagcctccgcctcctgggtgcacttcatcctcccacctccacctcagcctcccaggctcaattcatcctcccaagtagctgggactacaggtgcacactacaacacccagataatttttgtattttttgtagagatggggttttaccatgttgcccagactggtcttgaacacctgagctcaagctatctgcctgccttggcatcccaaagtgttgggattataggtatcagccactatactctgcctaggttccctttattttttatttttttgagacagagtctcactccatcgcccaggctggagtgcagtggcatgatctcagctcactgcaacctctgcctgctgggttcaagctattctcctgcctcagcctcctgagtagctgggattacaggcatgcaccaccatgcccggctaattttgtatttttagtagagacggggtttcaccatattgactaggctggtctcgaactcctgatttcaggtgattcacccacctcggcctcccagagtgctgggattacaggcatgagccactgctcagcccctgggttcccttttttaaaggcactaatcccaccgtgaggggtcccctcatggcctaatcacctcccaaaggccccacctcctaaaagcattactctaggcattagaattttaacatgtgaattggggtggggggcacacattgattccattgcaataaccttgatagttttgagacatatgggcaaggtattttgtacaatgtccttaaatttgggtttgtcttgatatttttcccatggttaagtcagggttatgagtttttaggagaaagactactggctcccagttttggattctgattccattgtaccaaaacaaatcagaactctttggagtaatgggtgattctagggctggggcagggaaaatataagatgagcctgaagcttcttctagtgtttgaatgtaaggatatgctaaaaaacaaagggatgggaacatgaagaagggacacaggaaccaactgaaagagctcccattgacaaaagctggaacaacttgaacaataaaataaataatgtagttttttggttttttggttttttttttttttttgagacggagtctcactctgttgcccaggctggagtgcagtggcgtgatctcggctcactgcaacctccacctcccaggttcaaggcaattctcctgtctcagcctcctgagttgctgggacaacaggcgcacaccaccacgcccggctaatttttttgtatttttagtagagacggggtttcaccattttggtcaggttggtctccaactcctgacctcaggtaatccacccaccatggcctcccaaagtgttgggattacaggcatgagcctccatgcccagccaagaatgtatttttaacaattagtattttacttatcacctaaagtataaaacaaatatctgtaagtccatattgatataaataattacattaataaatgaggaaagagacaaagaatagactgatctcccttagagaagaattccaaataatggtagattcttccatcttccagagggtcctctataactttccccatctccttggagtgtgggctgcacttagtgacttgcttcctaagagtatggaatgggatgactgtgtgtggaggtggtggtgataatcttacagtggctaaacctgcaaatgctacctgagccaggtggtcgaggctgatgtattaggtgtaaatcatgttggcacgtgcccttgatagaattgttatgaaaagattcaaaccctgtaaaatatttgaaaagatttattctgagccaaatatgagtgaccatggcccgtgacacagccctcaggaagtcctgagaacatgtgcccaaggtggtcggggcacagcttggttttatacattttagagaggcatgagacatcaatcagatacatttaagaaatacattggttgaccgggcatggtggctcacgcctgtaatcccaacactttggaaggccaaggcaggcagatcacttgaggtcaagagttccagaccagcctggccaatatggtgaaactccgtctctactaaaaatacaaaaattagcctggcgtggtggtgcatgcctgtaatcccagctactcgggaggctgagtcaggagaatcacttgagcgcagaaggtggaggttgcctggcccgaaggcatttgtttaatttccttttgcttccaatgtggctgttaagaaacctaaagttggctgggcacggtggctcacgcctgtaatcccagcactttgagaggccgaggcaggcagatcacgaggtcaggagatcgagaccatcctgggtaacatggtgaaaccccatctctactaaaaatacaaaaaattagctgggtgtggttgcgggcgcctgtggtctcagctaccagggaggatgaggcaggagaatggcctgaacctgggaggcggagcttgcagtgagccgtgattgcaccactgcacatcagcctgggcaacagagcgagactctgtctcaaaaaaaaaaaaaaaaaaagcctaaagttattctcgattctttctacgtgactttttttttttgagatggaatctcgctttgtcgcccaggctggagtgcagtggcgtgatctcggctcactgcaacctccgcctcccgagttcaagcaattctctgcctcagcttcccgagtagctgggattacaggctcccgccaccacacccggctaatttttttgtgtttttagtagagatgggctttcatcatattggccagactggtcttgaactcctgacctcctgatccacccgcttcagcctcccgaagtgcttggactaaggcgtgagccaccgcgcccggcctgcatgacctgttttttttcctccctctctggaagtatagagaatattctctgggactgggtgtggtagctcacgcctataatcccagtactttgggaggccgaggtaggaggatcacttgagcccaggactttgagaccattctgggcaacatagtgagaccctgtctctacttaaaaagaaaagagaagagaagaaaaagaatattctcttgtcaccaaaatattttaattttcttaggacaatttttttggggggtcaagttctacctttagaacagtgccttgaataaagtagaggctcagtaaacatttgaggaatggatggatgttactcttttggggctggccagatttctttctttagttctgttcttttctgttctattctgttcttttccttttcttttctttctctctctctttctttctttttctttgagtttctttcttgttgcccaggctggagtgcaatggggtgatcttggctcactgcaacctccgcctcctgggttcaagtgattctcctgcctcagcctctcaagtaactggggttacaggcatgtgccaccacacctggctaattttgtatttgtagtagagtcggggtttctccatgtttgctaggctggtctcgaactcccgacctcaggtgatccgcccgcctcggcctcccaaagtgctgggactacaggcgggagccactgcgcctggcctggggctggccagatttctcgggaaaatttgcctgtcttttttttggaggcgaagacctagctgccctaccaggtctacaaaccaagtggtggctgagagttggtcatctcccaggttccccctggtgctgcctagctcagttcttctgcagctccctgccatgcttgtagtggacatcgcagtcgcacttcttagtttaaagcatccacctaatgcagttgtgtgtgtgttatgctgaacgttgaggatgtgttttgaggaatgcatcgttaagtgatttcgttgtgggggcatcagggagtacatttacacaaacctaggaagtataacctactgcacacctaggctgtatggtgtagcccattgctcctaggctaaaaacccatacagtatgtggctgtggtaggcagctgtaacagtggtaaatatttgtgcaactaaacatatctaaacatagaaaagatatagtcaaaataggtgttacaatcctttttttttttttgagacagagtctcgctctgttgcccaggctggagtgcagtggcacaatctcagctcactgcaagttccgccttctgggttcatgccattcttctgcctcagcctcccgagtagctgggactacaggcacccgccaccatgcccagctaatttttttgtatttttagtagagacagggtttcatcgtgttagccaggatggtcttgatctcctgacatcgtgatccaccagcctcagcctcccaaagtgctgggattacgggcatgagccaccatgcctggcctggtgttataatcttatgggaccactgtcaaatatgaggtccctcattgaccaaaatgtcattatactgcacatgactgtattgtacagaatttgtctattgtaaatttgttagtttgcgtcatatctatcagggagttagttaaaattcccaaggccttctcttttagtcattagtgtgacagagtaagtaaaatatcactcctgtcataaaggacgaattaaaaggacagttttagtgtgtaatgagaactattttctgagacagtcttgcttgctctgtcacctacgctggagtgcagtggcatgatcatagctcacgcagccttgaactcctgggctcaagccatcttcccacttcagcctctcaagtagttgggagtacaggcacatactaccatgcccatctaatttttaattttttaattaaaatattatatgtatgcatatatatgtgtatatatacatatttcagacaaggtctcactctgtcacccaggctgaagtgcagtggcacagtcatggctcactgcagccgtgaactgcagacatgcatctttatgcctagctaattttttttctttcttttttttctttttgaaaagatgggacccctctatgttgcccagtctggtcttgaacccctgggctcaaacgatgtttctgcttcagcctcccaagtagctgggagtacaagcatgtgccaccatgcctagctaattttttttgtttttttgtagagatggggtcttgctgtcttgcctaggctggtcttgaattcctgggttcaagggatcctcccacctcatcctcccaaagtgctggggttacacacatcagccacagtgtccagcataagaactatttctatttttcatattacctctgcttggattactttagaggtaaagcaactgaatatacaaattcatatttatgtctggtgtttttgtcagagctgagtggtagaactttcgttgtagtctgtatattaggttttattgcatgccatctcttttcagttacacgggtacaaatccttacctgtcaagtaggatgttgaataatacaaacatgctacagttaccttgtctatccgaactgttaagccttatttcaagtttgagcatgggttttttatttactttctttatccagaaactttttttttatttttatttttttgagacggagtgttgctctgtcacccaggctggagtgcagtggcaggatctcggcttactgcaacctccactttccaggttcaagcgattctcctgcctcagcctcctgagtagctgagactacaggtgtgtgccaccacacccagctaatttttgtatttttttttttactagagatggggttttgccatgttgaccaggctggtcttgaactcctgacctcaagtaatccgcctgcctgggcctcccaaagtggtgggattacagggagagccactgtgccttacccagaaacttttttgttattgtttcttatatttccaaaaggcaggtaagccttttgaaaggatggcatggccaggcatggtggctcacgcctgtaatcccaacactttgggaagccaaggtgggcagatcccaaggtcaagagatcaagaccatcctggcatacatggtaaaaccccatctctactaaaaatacaaaaattagctgagcatggtggtgtgttcctgtagttctagctacttgggaggctgaggcaggagaatcgcttgaacctgggaggtggaggttgcattgagccgagattgtgcaactgcactccagcctggcgacagagcaagactccatctcaaaaaaaaaaaaaaagaatagcatttcctaatttctgtcccagtgggtagtttgtaaaagaccaggtctatttgtattgggtttttttttcttttgagacggagtctcgctcttttggcaggctggagtgcagtggcgcgatctcggctcactgcaacctctgcctcccagattcaagcaattcttctgcctcaagctcccgagtagctgggactacaggtgcacgccaccacgcctggctaatttttgtatttttattagagacggggtttcaccatgttggccaggatggtctcaatctcttgacctcgtgatttgcctgccttggcctcccaaagtgctgggattacaggcgtgagccaccgcgcccagcctgtattgtttttcaaatgacattttaaaaagagtaaaaattgttttatttctaggttacaaaatgctacagacaggattttaacatttattttgatttattttttactcctggcaagttgcgatacaggtatttaatcagaggtcccaatgtggagcctgacaggataggttcttaacattctcaatttatgtcctcagaatgtggtagtacgaaagaatgattgaagtaaatctttggacttgagacttgtggcctggcatggtggctcatgcctgtaatcgcagcactttcggagggtgaagtggacaggtcacttgagcctaggagttgaaggccagcctcggcaacatggcaagaccctctctacagaaaataaaaagaaaataaaaaagaaagaaaaattagccaggcttggcggcacgcacctgtagtcccaactacgtgggagactgaggtgggaggatcacttgagcccaggaggtggaggttgtaatgagccaagatcatgccactgcacttcagcctgggtgacagagtgagaccctgtctcagacaaaaaaggagaatcatgtatgttaaaaatacatgtcaaaatggcacagtgggctgggtgcagtggctcatgcctgtaatcccagttctttgggaggccgaggcgggcagatcacctgagctcaggagtttgagaccagcctgggcaacatggcgaaactgtgtctctactaaaaatacaaaagttagctgggtatggtggtgcatgcctgtagtcccagctacttgggaggctgatgtgggaggatcgcttgagcccgggatgcggaagttgcagtgagccaaaatagtgccattgcagcccaccctgggtgatagaatgagagcctgtcttaaaaaaaaacaaagaaacagtacagtgacaattgcctatactcctagctccttgggagactgaaggtggggaattgcttgagtctaggagtgcaagtccagcctgggcaacatagcaagaccccatctctaaaagaaagagaaaaacatgaaaaccacaatactatataattgcaaaagttgagtcactatctaaaataatgtaaacaaaatgagttctaaaataaaaataacaattatagggtttttttggtcttcattatgttaggtagtgacttacagtctgtagacacagtacataatttgttaggggcctggtgtgatagctcatacccatatctccagcactttgggaggccaaggtgggaggatcactggagcccaagagttttagaccagcctgggcaacatggtgagacctcatctcaaaaaaaaaaaaaaaaaaaaaagaatttgttaggtttacttgaatcctgagactttaaatttagtagactgtaatagctttgcctgttgaacaatagccttaaagaggtttgaccctaaaaagggcttcttatgtgttttttttttttttcgagacggagtctcgctctgtcgcccaggctggagtgcagtggcgccatctcggctcactgcaagcttcgtctcccgggttcacgccattctcctgcctcagcctccggagtagctgggactacaggcgcccaccatcgcgcccggctaattttttgtatttttagtagagacggggtttcaccgtgttagccagggtggtctcgatctcctgacctcgtgatccgcccgcctccacctcccaaagtgctgggattacaggcgtgagccaccgtgcccggcagcttcttgtgttttgggagcttaattcagatgttagatttatcaggttttacactggagattttgcattgagttcttttggtctcacggagtaaataatggaactttaaataggactttttttttttaaggaataaaagcataataaaaaaagttcatagttagaataacctggggccagatagcttgtgtgtcagtcagagggaaagagggaagggagtatttctgagcctgtactattgttccaggtcaggtgggtatcaatttcacttgacgtacagggagactgagcctccaccacaccccagggtaggtgagaagaagatgcattagctccaaagctgcttcattcattcattgcacacatctttattgcatgcccgtgggttgctaggcattgttttggctgattccttgttccattgaatcatctccaggcatacacggcatgagagttggaagatggtccagtgatggtgtgatttataggctggcaaaatgtttgagtcaacttagatactgagtaatttttaccttgcagaaatcagtaaatcagtgttacctgttacttagcggtagcctgtatactttttttttttttttttgagatggagtctcactcttgcccaggctggagtgcagtggtgcgatctcagctcactgcaacctctgcctaccgggttcaagcgattcttctacctcaacctcccgagtagctgggattgcaggcacctgccaccacgcctggctaattttttgtatttttagtagagacggggtttcaccatgttggccaggcttgtctggaactcctgacctaagtgatctgcttacctgggcctcccaaagtgctgggattacaggcgtgaaccaccaagcccagccgcctgtatacttttgaattcttcatcttgaggagctgcaagatagttttccctcagaaacgcattttgtttctgcatcaaacttgaaaaatgtcctaagtagacttgtcagtcgtttacagttttataccttatttatttatttatttagtgatggagtcttgctctgtcgcccaggctggagtgcagtggtgagatctccgctcactgcaacctccacctcctgagttcaagtgattctcctgcctcagcctccataatagctgggattacaggtgtgcaccaccacgcccggctaattttttgtatttttagtagaaacgggtttcaccatgttggccaggctggtcttgaactcttgacctcgtgatccgccagcctcggcctcccagagtgctaggattacaggcgtcggccaccgcgcccagcttgccattacttttattcatagaatgatctttagtttgacctacgtgcatatagacttttgcctgtatttccttctagtttcttggtttttttttaatttagttattaatctggaattcatgttagtatatagtgagtgtaggagtttaactttattttatttttcctaaatagccagttgccttggcaccgtttattatataagctgtctttggttataatggcttagcctagaaatggtgagaggtatcgagtctaaatatacatgccgctgtctgtttccctctgaagaagtggcacgtgtacttaacatctataccatggtcacctggggggcaggtttcttgtgctctcactccgtgctgctcctctagccttggtactgggtctggctttgcagtgatgagcagctgctcaccagcagtgggtgccgtcacacctctgcctcagctcccctttgctgccgggctggcagtgcccttagcaatcttagtagcccttactagccttgagaggtgctacttgataacactggcttcccttgggagtggtttcttctgtctggccttcgtctctcagttggccattgccccccaccaccgtgttccgccacacagccactgtccctgagccttcaggtctttgtgcacctgcttgtgtagcttgtcttctgctagcttgcatgtccccaagggcgaggcccttattaatctgtacattccagggcttagctcagagtaagttttagtaaaacacttgcatctgctagtttgggaaacataaaagaatatatgttgcatcatttggatataatacataaatactttgctgtcagggtggaaaaacaggccttaagttttattttcctcctcctgaagacccttcccttcagtcataggaacctcaaagatgttcagatcaacactttaacctagtacattttaatcttgtttgttgaaaactggtccttaagtgttttctttcactcattttacaaatgtgtattgagtgccaggccggggatatatcatggaacagtatggatgaggtccctagtggagcagcagtatcactcagcaatatattcccagcctggcacaccatggatttgctacagtgaagctggagagccctgtgttaaataaatactaacagttaacatactgtcaggtagaggagtggcctttgttcttttttttttttgagacagaatcttcctctgttgcccaggctggagtgcagtggcgcgatctcggctcactgcaactcctgcctcctggcttcaagcgattctcctgcctcagcctcctgagtagctgggagtacaggcgagcgccatcaggctcggctgatttttgtatttttagtagagacgggggtttcaccatattggccaggctggtctcgaactcttgacctcgtgatctgcccgccttcgcctcccaaagtgctgggattacaggcatgagccaccgtgcccggtcggcgtttgttgttttgttgttttctggcctctttgttagtggagtggaggtggatttctgaatagtcttacagacaacttccaaattttaaaaggaattcagtcttcatatgtatggaaaaagaaaatcatttttccagtgtgtgatgcagagactaacgtgaccctattctcaagcactcatagcttcaccccaaaatcctggaatatatagtctgtatctgctgattcagcttttcttcccttcatgcagcgtctgtcagtccatccattcactacatggactttctgggccaggagctgcctctagaagctgtggagtcctacaagatcaagtccctgccttttttctttttttgggaattttttaaagagacagggtcttgctccgtcacccaggctagagtgcagaggtaccatcatagctgactgtcacctcaaattcctggactcaagcgatccttgtgcctcactgagcctcctgggtagcaaggaatacctgcacataccacccagctaattttacttcatttatttttatttatttatttaggcagagtctcgctctgtcacccaggctggagtgcagtagtgagatcttggctcactgcaacctctgcctcccgggctcaagtgattctcgtgcctcagccccctgagtagctgggaccacaggcgtgtgccagcacactcacctaatttttgtatttttagttgagacagggtttcgccgtgttggccggctggttttgaactcctgccatcaagtgatccgcctgccttggcctcccaaagtgctggaattataggaatgagccaccatgcctggctgtcctgcctttttaaataagagcttatattcaaggtgacattagacacttaatgaatcgtgagattttagacagtggcagtgctgtgaaggaaataactctgacgtgtaatcttgcctccatccctgtcactgtgccgaaaaagatcactgctcactatctttctgttttttaaacttaactatgggtttttaagacttagaaaaaaggagagaggctagcagagggaaccattgctcagtgacagcggctgtcaggcacaacagcacaaatgatgctgtttttatattcccctttcctcccccttttctttctcactttggtgtttgaaagccccttccagacattgcatcacatcaccctgggcctggccctggtggtgcttcgctgtgccatcctcatctgtgagcctgcccggtgaccgtgctgcacctgtccttgatgccctgtgtcttccaggtctgctcctcccctgctgctcttcctgttccatgttctttggctggtttttctttcttcttccagctgtgtgactccttttcaagcctttgtccagttaaacattttaccaagaatgtagtgttcttcctgcatttcattaggaagagaaaaaggcttgcaaacattctgagaaaaaatgttgttcaccgaggctatgtgttttggaaatgccatttagatgttttgctgcttttaatctttggcattaatttcagttgctgtcataaaaaagaattaagacataaaccagaaaagtaattaaatgtgtctgcaaaggaaaaacagaaactgcagaatatggtatttcaaggtcataaattacaaatgtgcatatttattattcccctataaaatgttaattaaaaaattttcatatttacttgatgtaacagaaatgaaacctgtaatgagggatctaatttctttttcttttttcattccagaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggtacgagtgagaatgactcagacgttatcaggaacttttgatggtaaaatggagacttgtttgaaataagcagtttcactaaagaagaggaaagatgattatagaataacagatccaggccgagtgcggtgtggctcaggcctgtaatccaagcactttgggaggctgaggcaggtggatcacttgaggtcaggagtttgagaccagcctggccaacatagcgaaaccctgactctactaaaaatacaaaaattagccgggcctggtggctggcgtgtgtaatccagctactaggcaggcttgaggcaggagaatcacttgaacctgggaggcagaggttgcagggagccaaaattgcatcactgcactccagcctgggtgacagagcgagactttttctcaaagaaaaaacaaaacaaaacagatcatgtgttctgtatgttaataaattactattgatttgggcctatcagaattgtattgattgattgattgagatggagttttgctcttgctgcccaggctggagtgcagtgatgcagtctcggctcactgcatcctctgcctcctgggctcaaatgattctcctgcctcagcctcccaagtagctgggattacaggcatgggccaccacacctggctaattttgtatttttagtagagacagggtttctccatgttggttaggctggtcttgaactcccaacctcacgtgatccacctgcctcagcaaagtgttgggattacaggcgcgagccaccatgcccggcctctgaattttatttttatttttatttttttgagacagtgtttgctctcgccgcccaggctggagtgcaatggctcaatctcagatcactgcaacctctgtcccccgggttcaagtgattctcctgcctcagcctcccaagtagctgggattacaggcacataccaccattcctggctaattttttgtatttttagtagaaactaaaatgttggccaggctggtcttgaactcctgacctcagggcctctctgaattttgaaaagcggatccaaaatagtggatactgctgtgtatcatttaggatttgatttggctgccagtatcaaaaaaacaaaaacagtggcttaaaccacaagatgtttgtcaaataagtactgaggtacactctcctggacgggttctgtagctacacagtcatcggggatactcaggttcctaacatctgccacactgcaccttggcagcctgtcttggggactgagagtgagctccatgtggccctgttctagcataggggaagggaaaggaaggacgtgcctccttccttgaaggctgctgctttgatgatgtgtacagcagtgcttacattgcattggccagaccttatggctgtacctgggtgagtgggagactggggaatgttgtcttcccacttacagtggcaggtccttaagcctaaggaaggagaatggacactggccagtgggtgatggtctctgcaatcccagggccagattgcttcatatctttgactaacctttgtttctataatatcatgcttgacatagagatgaaaacactggaaacatctaggtttttaaatactctctcctgataacttctggctctgtcagcatatcttaggtaaaattaaatataccaaagctttgcttctttcttagcattctctagtttagtgagtgaatagagcagaagaggggctgctggccagcggtttctgctttcatagaggaagtgactgcccacaccctgattttagagtcttcatcctaaccatgttacagccttgagttgcagaactgtagctctgtttggatattgtgaacgtattatttctcaagttctgttaccttgagaacaggtgacatgaatttaaacttgcttttttggtgtcgcagataagagttttaaaaaaagaaggaagaaaaggtcccaccttctggagtttcaggttttaaacctaggaggataataacctggttattatgttatgagagggatgggcagatgtatgttctaaagagagaacagattgctgccagccagctcctagctgtttgtgctcttatgctcctaggaacttgccacagcctcacgctggtctgttccagaaaccagtgagcactctgtaggcagagccctggagtggcccctggattttatgacataaacataagcttatgagtgcaccagtgcattcttactcttggtggtagctacagagatgtcttctctcaccttggaacatcaaggaagatttgtatgtgcactgttctctgacccccacttgcagcccttcaccaacatgcactctgtgcgcagacatgcatgtgtgtacacgaggtcttacacatgggaaagggtctataaaaaattatgttgggcccatcttgatagaaagtaaaataatacagtttcatcagaagggtagctgtgttttcattgctagttcatttggcatgctcttcaaaaaaataagtatttttttgtaggcattctgagcgtgtgatattctttatcataccctgctttgtagtctgtggctgaaggggaaaagagaagtaaatggcagattgtacttatatgtactttggagaaaatatctgcgagtgtaagctacagccccagccacagaatgttcgcacgggtgggagggactcttgctggacaacgtgccacagtgctgcacacgtttctgtctgctcaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgtgagtggctctgtagcaaatgtggtgctaatgtttaaaatggagtcactgggaaagtcatagaggttctgtttgccatattcttttcatattagaacatattagaacattagaacatgcaaaaatgttttgtaaatataagccacaatccagagagacaccattaccttcaacaaggtctgccccgaggtctgtcccgaggtctgccccagcttaggctctggagcttccttgcccctctgtagcttggcttccatgccatcagctgctggtctagcagtggtccaatctggccgtctgaatttggactctgggcaacctctctgccccttagggtgggtgctcttggcattgccattctctttgaaactcccctggccctctggacaccacctggctctcttgccgcctctctcatcctccccttggcttcccttgccagcttatctttctgtatctgcaggggaagaaacgatcttggttttcttcttcttcttttttttacaaggagtctcgctctgtcactcaggctggagtgcaatggcacaatcttggcttactgcaacctccatctcccgggttcatgtgattctcctgcctcagcctctggagtagctgggattacaggtgtgtgacaccatgcccagctaagttttttttttttttttttttttttttagtagagatgaggtttcactgttttggccaggctggtcttgaactcctggcctcaagtgatctgcccacctcagcctcccaaagtgctggtattccaggtgggagccaccatgcccagccttctttctctgttggctctatttggatgtttatcctagtctcagttatttttcattcaacatttatttctgattcagttaactttttttttttttttttttgagatggagtctcactctgtcacccaggctggagtgcagtggcacgatcttggctcactgcaacctccacctcccgggctccagcgattctcctgcctcagcctcccgagtagctgggactacaggtgtgtgccaccacgcctggccaattttttgtatttttagtagagatagggtttcattgcgttagccaggatggtcttgatctcctgaccttgtgatctgcctgcctcggcctcccaaagtgctgggattacaggtgtgagccactgcgcccagccagttaacttctttttatttttttttttactttttttttgagacgaagtctcgcttttgtaccccaggctggagtgcaatggcgcgatcttggctcactgcagcctccacctcctgggttcaagcgattctcccttctcagccttccaagtagctgggattacaggtgcgtaccgccacgactggctaatttttgtattttaagtagagatggggtttcaccatgttggccactcctgacctcaggtcatccccccgcctcggcctcccaaagtgctgggattacaggcgtgagccaccacgaccggcttcagttaacttctttttaaagaaaatttctaaattttggaattattttattttacttatttttaattttaaaaattttaccctcctctcaagtttccaatggaataattttaaattgattgaaaagttgaaaagttagagaagaaaattgatgtgcccataacccagtctcccctgatcgtccataatcatagaacagtggtcagaactaagatattaacatcaacactttactgttaactgaaacacagacttggttggatgtcaccaggccttccactagtatctcttttctgtgctaggacctagtccagtgttccacattgcatttggaactaacgttttttaaatacctgtatgatgccagacatgttcatgtacataatcagaatactagagaggtgcacatttgtgtgtctcgttcgaatccccatcctaagactactgaaacagttttttgcgtagcaccagcaaacctgcatttcccctctgtcttcatctgcttgggctactgtaacaaataccacgggctggatggcttaacatttattttctcatagttctggaagtccgagatcagggtaccagcagggtccggttctggggagggccttctttctggcttgcagactgctgccatctctttgtgttctcatatggtacagagagagagggagtaagctctctggtgtctctttttatgagggcactaatcccatcatgagggccccacactttcgagctcatcttatcctgatcacctcccaaaggtttcatctctaaataccattacactgggggttagggctttaacataggaatttggggagaacacagtttagttgacagcatgctatttcaaaaggcttaccaaaatcctccctcacatctcctctaggttaggggccaactaaatgttttgatttaaaagatgtggctgggcgcagtggctcatgcctgtaatcccagcccttagggaggccgaggcaggcagatcacctgaggtcaggagttggaggacagcctggccaatatagtgaaaccctatctctactaaaaatacaaaaattagccaagcatggtggcacatacctgtaatcccagctactcaggaggctgaggcaggagaatcgcttaaacccaggagatggaggttgcagtgagccaagatcatgccaccgcactccagtctagatgacagagtaaagctctgtctcaaaaaagaaaaaaaaaaaaaaaattaaggccgatgcggtggctcatgcctgtaatcccaacattttgggaggctgaagcgggtggattacctgaggccaggagttcaagaccagcctggccaacatagcaaaaccccttctctattaaaaaatacaaaaaaattagctgggtgtggtagagtgcacctgtggtcccagctacttgggaggctgaggcatggaattgtttgaacctgggagttggaggttgcagtgagccaagatcatgccgctgtactccagcttgggtggcagagggagaccctgtctcagaaaaacaagcaataaataaataaataaataaataaataaaagatgcttgctctagagtgctatggaaatgcaagtactttgcagatgtcgatgccagcagtgattgacctgggacattggaggatgttgagaagaagaaaactggtttcgtaggatcggagacttttaaaatttattattttgaaaaagtgttaaacttggagaaaacatccagtgagctggctctccttaccctttccagagtacttacgagtgcctgtttcttctgaaacctgttcacatagtggcatagcatgtgccacggctgcttactgctgctgggcgtctttccctagggtgaggggttctcctgtggcagtccagggccaagggcactcaggaaattgcacacagacccagtatgtcctctcctctgcagctcatactctccttttgttaactgccaacagcatccttcatggcattgtttcactgtgtcccagggtccagttcaggggtacatcctgcatgtggccgtcacatctgttgagtagcctttcacgtggaatggggtctctgtctctggttgtctttcatgacattggtgtttttgaagaatgcaggccagttattttgtccatcattcctcagttggggttcgtctaatgcctggattatgcatcccagacaggaatattctaaaagcaatgtgtctttatcacattttcccttccggagccaaacagtgttcatctgcctcatgacaaagctaatttcttactggtcaggctgttacctgtcttttccattatgtagtttctgattttatttctttgactaatcagcaaaatgtagggaaacatgggtcacaggcctttaaagctgggaggtttcaaactgctcccagggatcctgccccagagccgattgtggtggtgaggaatctagcccctccacttctctggggatcagagatgcaccattttcacctgttgctacatatttggttcccaaataagattttattttgagtcagggttttccctgctctcctagacctccctcaaagcgcgggagaaggatctgaggcatgaaatgcagccatggcccatttcgtcaaactgtggtctgcactcaagtatttgtattctagtctaaaaagcttttcattactcctgttcaactgatggataagccagattgtcggcgatcctacatttgatgttaaaaactgatcatcttttctaagattcttagttaaaatgtatttaatattaaaaattttcaggacaggatgtgtatagcacgtgtaagatgaagtgttgtcctgggtctgttttataggaggacaaagacactgattctaccaaagagcctctggatgaccttttccccaatgatgaagacgacccagggcaaggaagtgagtgatgggtgatgcaggcatgttaccgagtgcagaagagaggtgttcctcctagaacacggtcatagcaatcagtggcagccttagtgcatgcggcctgcctggaggaagcaccaccagagcggggttgcctttggttttccaaaataatctgtgttgtgatacgggaatatgctagagcagaccctaggatacagcggcatgcacgtgcagttcaggcgtggtctgcagattcttacagggtgaagaggtcagaattacttatcctgcttgtttcatggcgccaagaggagtctcatggcactgagtggccatgttgccatccctgacactgtagtcactactcttaccctgcctgcccagacagtactaggaaaagatttaaatagcactgggggccaagtactaacttgaaccaaagttagtaaagataattttaaagaaactgactcatctggataattgtctttaaaaacccatctgaagtgaactttctcggtgcagtccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacaggctagtcacttttgtttacctactgaattttacctagagacaatgtttttaaccatcttgccccttaaaatatatttttatgtatctgtataaactatttttcaaccatatccacttctctttaaacaggggttaaattaaaaatatttagcaagcttttttttttttttgagacggagtctcgttctgtcacccaggctggagtgccggggtgtgatctcggttcactgcaagctccgcctcccgggttcacgccattctcctgcctcagcctcccgagtagctgggacttcaggcacccgccaccatgcctggctaatttttttgtatttttagtaaagacggggtttcatcgtgttaaccaggatggtctcgatctcctgacctcgtgatccgcccgcctcagcctcccaaaacgctgggattacaggcgtgagccaccgcgcccggcctatttagcaagctttgtggaagggtgtcactgaatcagaagaacagatgctgcccgtgaccactcagttcagcttgtttagaatagaccacagtgtacccctaacgccagccaaacgaagctgttttgaccttttccacaagaccctgtgcaggcggcttcttttgtctaaatagccttcccacttggcctggcggtgtcttcctgccttctgaggcctggtgcgctgtgcctccttttggaatccgggattcaacttgccctttgccccttgtgtgctccccgaaccctttcacccctgttgaaggacgccccgggggagtggtgggctctcagttgtgtggtagaagagttcctttggctcagtgcctaggatgcagttgggggctggagccggaggcagggtgtcctgttgggacaggattgaggttgtcggggtggggcgaggggaacctgagcaaggaggaggacgtggaggaagaggagagtacagggcctaatgacgcttgaagagaaatgcggtgatatgactacccacacgcataagtgatttctttaaaaataagttttgaaagttgataaaataaaaacacacaaataagaaagtaagccccctgttataacaacactatttaaaatgaggccgttccctttggctctgtagtttgtcagcagcttggtctgccccatgactatgcagcagggtttcgtggacattctggacattttttgactgttttcctgttggtgaatgttgagattgtttgcatattttcttttttcttttttttgagacagagtctggctctgtcacccaggctggagtgcagtggtgcaatctcagctcaccgcaacctctgcttcctgagttcaagtgattctcctgcttcagcctcctgagtagctgggattacaggcatgcgccaccatgcctggctaacttctgtatttttagtagagacggggtttcaccatgttggccaggctggtctcaaactcctgacctcaagtgatccttctgtctcggcctcccaaagtgctgggattacaggcatgagccactgtgcctggccaattgtttgcatatttcactgcaggaatttcttagtcagagatatttgcatttagctcttaattagattgagacatttcattgcaaaaaaattttttttttgagatagggtcttgctcagtgatgcgatcatgggtcattgcaacctctgactcctggcctcaagcaatcttcctgcctcaccttcctgagtagctgggaccacaggcatgcaccactacacccagctaaattttatatatttcatagagacagcgttttgccatgttgcccaggctggtctcgaactcctgggcttaagtgatctgctcagctcggtaccccatagtgctaggattacaggcgtgaaccactgcacttggccaaggcttttttttttttttttttttttttaaacttatatgcccattaaaacatatggaagtttctggacagcactggatattattaatataaatgagttaagtaagcataactaggtttttgttgtgcacagcgtgcatgggcacacacatcactgctgggtgctggggatgccatggcctctgtcagtcttgtgtttttccctagcattatagtgtgagagttgacccacgtgcgtagatgtttgggaaaaaaatagtagctacatatgtattcatattcagtattctacctttcagcttgttatttcatcattcttgtattaagggacacataattttaagctttttttttttgcctttaatattttactgatctttataaggtttgttcaagattttggattgattgattggttgtagagatggagtctcaccatgttgctcaggctggtctcaaactcctgggctccaaatgatcctccaccttgacgtcccaaagtgctgggattataggtgtgagctgcgaggtaccacgcctggccaggatggattgattgatttcttttctttctttctgtctgtctgtctgtctttctgtcttgtcttgtcttgtcctgtcctgtcctgtcttgtgtcttgatggagttttgctcttgtcgcccaggctagagtgcagtggagtgatctcagctcactgcaacctcagcctctggagttcaaccatttctcctgcctcagcctcccaagtagctgggattacagacacctgccaccaagccccgctaattttttgtattttttagtagagacagtgttttgtcatgttggccaggctggtctcaaaactcctgacctcaggtgatccaccctccttggcctcccaaagtgctaggattacaggtgtgagccactgtgcccagccatgtatttctttttttaggataaattcctaagacgggttagagtataaacattttatagtccttggtacctgctgccaaactgccactcagaaaggctgtgtctgcccatgcttctgccgcacaggcgccaccctggaggtggggggctctattccgttggtggagatagagtatgcattgtgttttaatttgtatttctttgattatgtatttttagtcatttgtatccttctgtgaatttcctgttaccttgcacatttttctgttaggattttaatgctttagtattctatgtttgttttcttttgaatttgagttcttggtgggcttctttttgttttttttgagacggagtctcgctgtcacccaggctggagtgcagtggcgttgtctgggctcactgcaagctccgcctcccgggttcacgccattctcctgcctcagcctcccgagtagctgggactacaggcgcctgccaccgcgcccggctaattttttgtatttttagtagagacggagtttcaccatgttagccaggatggtcttgatctcctgaccttgtgatccacccgccttggcctcccaaagtgctgggattacaggcatgagccaccgtgcccggcccttggtgggcttcttaaacccacttgatttaacaaatcacagtgtgctagtcccactcccagagtttctgattcagcagggctagggtagtctgggtttctaataagttccagttgaggctgactgctgttggtttgggaccacaccggagaaccactgctaactaatagtcccagacattttataatatgtcatcgtttacagaagtgtttaatatacctcatctcatttaattcttttttttttttttctgaaacgaagtcttgctcttgtacccctggctggagtgcaatggtgtgatctcagctcactgcaacctctgcctcccgggttgaggcgattccacccaccccggcctcccaaagtgctgggattacaggcgtgagccaccgtgcctggccattttttttctttctttttttttttttttttgatacggagtcttgctctgtcgcccgggctggcatgcaatggcatcatcttggctcattgcaacctctgcctcccaggttcaagcgattctcctgcctcagcctccctagtagttgggattacaggtgcccgccagcatgcccagctaattttttttatttttagtagagacagggtcttatcattcttggtcaggctggtctcaaactcctgacctcaggtgacccacccgccttagcctcgcaaagtgttgggattacaggcgtgagccaccatgtccggcctcatttaattctcataacactttaggtagcttattttattttattttttttacacggagtttcactcttgttggccaggctggagtgcaatggcacaatctcagctcactgcaacctctgcctcctgggttcaagcgattcttctgcctcaggctcccgagtagctgggattacaggtgcctgccaccacacccagctaatttttgtatttttagtagagacagggtcttgctatgttggttgatcttgaactcctgacctcgggtgatctacccgcctcagcctcccagagtgctgggattacaggcgtgagccaccgtgcccagccttggtagcttatttttaaattgcatttgctacaattctcctgcctcagcctcccgagtagctgggactacaggtgcatgtcgccaggcctggctaattttttgtattttagtagagatggggtttcactgtgttgcccaggcttgtcttgaactcctgagctcaggcagtctgcccgcctcagcctcccaaagtgctaggattgcaggtgtgagccaccgcacctggccactactttttggaactctattttgtacttgctgactttcacaaaaagtttgaggcagcttacaataggatgtaataggatgaaagaagaaacaacaatatattaatacgtggccagaattagtgtgcttcagaggttgtagaagccttattaacctttctcacgtttttcaggggaaagccttgccaggcagttactactactcaattgagaaagatgtgtgctaagtctcaaaagcaagtacttgttctcagtcacatcagtagtgagtagcacgcttaaactgagagtttctggttctggggtgtttctgttttactccaatcaagaaagattcttcgttcctccatactcaacaaaatggagggagactgggtaccaagttcagacacaacaatatatttacttttgtttgttgttttttaaaatattttttcagtatacatgtagcatatcatcttcttacagcaagactgtgcaatagatcatatacttgctttgtagatgggaaggctgggactgcgtgaggtcacgtaatgcacccaaagccatgtagccattaactggtagagcccaagctcagacactagaattaattctgtctgaaaccaaatgcaagcttggtccattgttctagactgttgcacttattctgtgctggccagctggcataggcaggacaacactgtagtgtggggacattatcttcccagtggcctagatgggaaggttaagttcagaagctagttgggtctgattccagagttcaccttgccagtccatttattggtggatttccttccagtgttttttccccatccataagcttgtggtttttcttttttcttttttttttcttttgagacggagtcttgctctgtcacccaggctttagtgcagtggcgcgatctatgctcactgcaagctccgcctcccgggttcacatcattctcctgccttagcgtccccagcagctgggacaacaggcgcatgctgccatgcccggctatttttttttgtatttttagtagagacagggtttcactgtgttagcaaggatggtctcgatcttctgacctcgtgatccgcccgcctcagcctcccaaagtgttgggattacaggcgtgagccaccacacccatctttttatttatttattttttgagacagtctcactctgtcgcctaggctggagtgcagtggcacgatctctgctcactgcaagctccacctcccaggttcacgccattctcctgcctcagcctcccgagtagctgggactaaagccgcctgctaccacacccggctaatttttttgtatttttagtagcgatggggtttcaccatgttagccaggatggtctcgatctcctgacctcgtgatctgcccgcctcagcctcccaaagtgctgagattacaggcatgagccactgcacccggccctgtggtttttcttaaatagtttaagcttaacttttatttctgtagttgaaaattacatttaaaaaagctgtagtgaggccgggcacgatggctcatgcctgtaaccccagcactttgggaggcctaggcgggtggatcatgaggtcaggagtttgagaccaccctggccaacatggtgaaatcccgtctctactaaaaatacaaaaattagccgggcgtggtgacagatgcctgtaatcccagctactcaggaggctgaggcagagaattgcttgaacccgtgaggcggaggttgcagtgagccaagatggcaccactgcactccaacctgtgcaacagagtcagactctgtctaaaaaaaaagaaaagaaaagaaaagaaaagctgtagtgatctacatctgaaacacttaatgtgtgtttttccatttagggatcagaataaatacaaagatgcagctaacctactgaatgatgccttggctattcgtgagaaaactttgggcaaagatcatcctgcggtttgtatatccagttctttcattcttttaatattttattttccccatatatttcttttatccaactcattttaccattaaactcaacagggaaagtttaagtgctgccttttccctagatggtgcaggtaggaggtcttcacttactcagtgctagtgacaggccagagcacacttaatttgtttatgaccccacctcaaatggatcaccaactgtattgtttgattgtaaatcaaattgcatgtccttctagaaatttttttctgaaaattatattgtcttcattaaaatctggtcagatttgcatatgaatctgttttggttggctttgtggcttccagggaaatttttaaaaagtcaggaatacgttgttgatttgtttaattttagtattctgcagtgttactttgtataatctatactctagtgaattgcgcttttcattttaactgaagtcatattgttctatccgactaagaatgctttactgtatagattgaatataaatgaatatgtggtgtataaatgtactcttatttggttatcttttaccattcttagtggttctctctgtgttgacaggtggcggcgactttgaataaccttgcagtcctttatggtaaaagagggaagtacaaagaagcagagccgttgtgtaaaagagctctggaaatccgagaaaaggtacaaaagaagggggcagtcgttttctttgagatttttgttttgtgtgtgtgtggttttttttttttttttgagatggagtctcgttctgtcaccgggctggagtgcggtggcgtgatctcggctcactgcaacccccacctccatggttcaggtgattcttctgcctcggccttccaagtagctgggactacagggacacaccaccacgtccacctaatttttgtatttgtagtagagatggggtttcaccatgttggccaggatgttctcaatctcttgacctcctgatccgcccgccttggcctcccaaagtgctgggattacaggctgagccactgtgcccggcgctgttttttgtgtttttaaaaatttttcggttttaggttttgagaaataaccactgtgatgtgtttttaactgactattagctgaaaacaactcatttaattagagaatagcccacaaaacaaagccagattggcccatacaaatcagtgtttaagactcaattacaggctgggtgcagtggctcatgcttgtaatcccagcactttgggaggccaaggtgggaggatcacttgagcctaggaagtttaagaccagcctgggtaacatagtgagacctcgtctctaaagaaaaaaaaaagaaaagaaggtccagttatgaggcgtgtgcatttagaaaggtgcagtcctgagtctgatgctgtccaagcctgatatggcctagaagtgactctgattgaagaagacatgtctgaggactagagatggaaagcctgggagcattgcatttgacagtggaacatgtgcttgtcaataagaaaaacatgattaaagataaattcaccaaatatgctttatgaagctgaaaaatgaaataattattattataactaaagattaactcagagctatagattaagtcaatgtcatatatatttaataccagctgctacagttcatggtaattaggtattaaaaaatataacaacttgttcatttcagcagtgctgtgtatgacaatctctttagatgttatgaagattcgggtattgggtctatccgatgagtgaccacaaattgtgtttttttttttctgaaacggagtcttgctgtgtcgcccaggctggagtgcagtggcacgatctcggctcactgcagccttcgcctcctggattccaggaattctcttgcctcagcctcctgggtagctgggattacaggcatgtgccacaacacccggctaatttttgtattttttagtagagatggggtttcaccatgttggccaggctggccaagaactcctgaccttaggtgatccatctgccttagcctcccacagtgctaggattacaggcatgagccactgcacccagccgcacaaatggtattttaacctggtattttttgtgattatttatcagtgattcttatcagttaattttgagccacatggcaaggaattgggggagagaaaataaaaaggggctccttatcaaattatacaggtaatattttatcatgctgtcaatctgcatgatatttctgaaatagaatggttgaatttggggtgggctggagttaaagtcagggagagcacaaaagtatcaaattaaggattaggaaccatataagatgacctgccaaattcattcatatatttaccctttcattcatttagagccccctgcttagagttggtgatttacagatcagacatgtagttcctcccactaggacacagtccactggacagactgaggaccgcagagggcacatcagcatctagaatagagagctctgggaggatatgaagtgtgggcttctgcgggccagagccagggggtgttggggatggtttctcagggaaggtcggtgttggaactgcatcttgaataattgagttaaaagtgtcctaggcagggggaggtagggaatgcagaagggagtagaaaggcagcttacctccctgaggaccacatgtgtaaaggcacaaagcggagagaactcatcacttgttcaaggtactgagggaggaggttagtgttcattcatctatctctgtgccagacccctttttcgatgcggagattacattggtgaagaagagagacaaagaatttatactcttggggcttacattgtaataaaaaatattcaaggtagtttagagaagtgattcttataaagaacaaccaggtgatgtgcctgtgagttcactaggtgaggtggggtggtatagggaagtctcctttgaggggaactgaggagaaccctgaaggataagtcgtagctagtagggagggctaggagaagagcatcctgggcaactgggacagctgtgggctcttcagaagctggcagtaaaactcacatagcctttacaaagcccatttccttatcttcaaaatgtgcctaatgtgtacatttgtacatagtacaaccaatgtacaaaaatataactaccatgaaggattactacagtaattaacacagctaaagaagatgagcacagttccctccctcccctcatgaataagaatttgagaaattctggttattttattactacgtggtgtagcgagccagttaaggatttaaatctgaaagtgtagcacagtcgtgcttatgttgaggaagatcctgatgtgacagtagggtggagaatggattggatggaagcagaacaagtgtctctaatatgctgttttttattttcaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggtgtgttgactgcacagcactagggagggggccaggagtgctttcgtcccaagtccaaacactttctcatttaactggagattaaaatgtatgctttatttacatctgaaagatatgaaatattttattttattttattttaaggcatcctgctatttgaaacaaggaaagttcaagcaagcagaaacactgtacaaagagattctcactcgtgcacatgaaagggagtttggttctgtagatggtaagaaatatactcccgtttcaagtgaatttaattgtataatgacttgactaatagtaatatactaatagtattagttactgtttattaagcacttaactttgtacatcactaagctaaatagtttaaatgtgtgatttcacttcactttcacagcagtcttgtgcagcgggtcaaacattaccccattttaaaagcaaggataccacaggccgggcgtggtggctcacgcctgtaattccagcactttgggaggccgaggtgggtggatcacgaggtcaggcgatcgagaccatcctggctaacacagtgaaaccccgtctctactaaaaatacaaaaacttagccgggtgtgatggcggccgcctgtagtcccagctactcgggaggctaaggcaggagaatggcgtgaacccgggaggcggatcttgcagtgagccgagatcgtgccactgcactccagcctgggcaacagagtgagactctgtctcaaaaaaaaaaaaagacaccacagactaagtgacttgtgtgaggccccgtagctgagaagcagttagactgggattacagtgcccagagcccataacatgtcctcattgcagagacctatacagttcacgcagaaatggagacaggagcatcacccaaatccatcttcatgtcctcattgcagagacctacccaattcatgcagaaatggaaacaggagaatcacccaaattcatcttttcacatttttaatgtctttccttccttctgtgcctttggtttacagatttcaaaccataccgtccatatcatcatgtatactgcttattttctttacatttttagtgtgagtacctttcagtcataaaaatattttcataaacattacttttaaggtggctttttcctccatagcatgggtctgttggttgtctagaaacttgcgtgagtgttccgagaagatgacttaaaacgaatattgattcgtatgcttgttttcttttttttttttgaggtggaatttcgttcttgttgcccaggctggagtgcaatgatgtgatcttggctcactgcaacctctgcctcctggattcaagtgattctcctacctcagcctcccgagtagctgggattacaggcacacaccaccacgcccggctaatttttgtatttgtagtagagacagattttcaccatgttggccagactggtcttgaactcctgacctcaggtgatcctcctgcctaagtcccccaaagtgctgggattacaggtgtgagccactgcacccggccttgatttgtatcttttctacttttgctagcaacatcttgctactttttcttagactattgtttaatgtttttgtttagtgctcacattctgaatactcccttgtgctacttgagcagctggcattttagaaattacattccagggccctagcatttgctggggtgtcttgacagttgctcacctgtctcaggacattgattctgtaccctgtgtcttacctgttgcttggtgtccagctctgtcgtccatagactttttcctccagtgtgaacctaatctgtccatgctgtaagaagtagtatctaacaaggatcatataaaaaagaaaacaggctgggcgcggtggctcacgcctgtaatcctaacactgggaggctgaggcaggtggatcacttgaagtcaggagtgaccagcctggccaacatgacgaaaccccatctctactaaaaatacaaaaaaattagctgggtgtggtggcgggtgcctataatcccagctacttgagaggctgaggcaggagagtcacttgaacccaggagctggaggttgcagcgaggcgggatcacaccactgcactccagcctgggcaacagagtgagactccatctcaaaaaaataaaaaaccacagaggcttcatgatttctagtttacttagcaggctctgttatccttcatttatagtacaggttaaatatcccattattcaaagtgctccaaagtttgaaacttttcgagtgccgacttgacactcaaaggaaattccccttagagcagttcagattttggagttttggattaaggatgctcaacctgtatgctgtgttttcttccctagatgaaaataaacccatctggatgcatgctgaagaaagagaagaatgcaaagtaagaatttattattttgagattttctaaattgtatatactgcattcaagataattattcatttgaaattatttcttataatttagggaaagcaaaaggatgggacatcttttggagagtatggcggctggtacaaagcctgcaaagttgataggtatgtctggaattgcgtttggctggaaaaaccaaaaagcagggggaaggtaattgtgttctacagggcagcttataaatgaccaatgtgtagtgttccttaagtgcacagtcccatgtttttcccgaattccaattaaaaaaaccccactaaccttgtaaatgagatcacttacatgtataaaacccactatcatgttaggttggtgcaaaggtaattgcgattttgccattacttttacttttaatggcagaaaccatacagtaaattcatgagaagcatgccagcaggcctgggaaagccagcccctcacacacagcgctggagacacagatccacacacactccttttcctcacagcccatggggccttgtcctctgcagagggaagtgtaggcccctccgtggccggcccgagagccttgcctcttgagcccgagcctgtgcagactgccctctgtgatggctgctgtccctgggtccaggtggctcacctgtttggctgtctttccactctatttttttttttgagatggagtttcgctcttgtctcccaggctggagtgcaatggcgtgatcatggctcactgcaacctccacctcccaggttcaagtgattctcctgcctcagcctcccgaatagctgagactacagtctgtcgccatgcctggctattttttgtatttttagtagagacagagtttcaccgtgttggccaggctggttttgaactcctgacctcaggtgatccacccgcctcggcctcccaaagtgctgggattacaggtgtgagccactgtgtctttccactcttaactttcctcatcctttaagactcagcctaccattcatctattttcagaaaactctctgaactctctctagggctcccatagcacttaccatagattacttgtttcagagacatagaaaatagcttctttatttctgtacccaaaatgcctattgtaagtaagtgaacagaactctctcgaagtacttatctatgctaaaatgaatctaggtttatttataatttttttagtaagtctgctctatcaagaatgcagaaacatcaagctcaatgatacagtttgaaaaataagaaagaaagaaagaacacagaaacacagccgtcctctcggccatctgcttattgcttccctggtacatgaagcatttatcctctgccctcacaccccactgataaggaggttctgctttgctgtcttctcccgggtacttgaggggagacggcagcacgtgagcagcaacattcagagcactgttcgtcgttactgtcagcgcagaccaagtcgtctccagggaaagcatgctgataccacacagacctggcccagatgtttctgttgacagagtggccagtggtctgtgagagccgcctcagcctggatggagtgtggtgttagcctggcctgcaggggctgtctacaggacgggccagggtcatgggaggtagagctacctgagagggaagaacgctttacaattttacagtttcagaaaagtacaagagaaagttaaaatatattcaagccaaaacagaagtctgttagttctttagattatgtgctgttgatagtggttgttcagagcttatatgtcatagttctgtatgtcatgtgctttcttacagtccaactgttacaaccactctaaaaaaccttggggcactttacagacgtcaaggcaaatttgaagctgcagaaacgttagaagaagctgctatgaggtctcgtaaacaggttagtcatacttctgtccttaaccggcccatgggaactttgaattgaatgcttctcttttacatgaattttattgaaagcttgatttagaaatagaaaatgttgattattttagtttgaacaaataaagttatattgtttaaaagagcatgaggccgggcgtggtggttcacacctttaatcccagcactttgggaggccagcgtgggcagatcacctgaggtcaggagttcaagaccagcctggccaacatggtgaaaccccgtctctactaaaaatacaaaaattagctgggcgtggtggcacacgcctgtaatcctgtaatcccagctactcgggaggctgagacaggagaatcgcttgaacctgggaggtggaggctgcagtgagccgatatcatgccactgcactccaacctgggtgacagaacgagactccgtctcaatttaaaaaaaaaaaaaaaagcatgaggctgggcacagtggctcacacttgaatcccagcactttgggaggccaaggtgggtagattgcctgaggtcaggagttcgagaccagcctggctagcatggaaaaaccccatctctactaaaaacacagtgcagtggcacaagcctgtagtcccagctactggggaggctgaggcaggagagtcgcttgaactcaggaggcagaggttgcagtgagccgagattgcactactgcactccagcctgggcaacagagcgagactccgtctcaaaaattaaaataaaataaaataaaatagcatgaatatgaccccaaaagcatgaacagcaaaataaaaactagatctgttggattcaccaaagttaaaagctcttgtgcatctaaggacatcatcaagaaagtgaaaggggactgggtgtggtgctgagcacctgcaattcctgcacgttgggaggctgaggtgggaggatcccttgagctcaggagttggaaaccagcctgggcaacatagtgatactttgtctctacaaaagtttttttttttaaattagccaggtgtgttggcccaagcctgtggtcccagctatttgggagtctgaggtgggaggatcgcttgaacccgggagctggaggttgcagtgagcttagatggtaccactgcactccagtctgggcaacagagcgagaccctgtctcaaagaaagaaaaaaaaaaagaaaaagtgaaaagacccccatgcaacaggggaagatatttgcaaatgatgtatctcataaggttttggtatccagacaaaaagacaacccagttaaaaaatgagcaaaggacctgaatacacattttactgaagatgatatacagatagccaacaatcacatgaaaagatactcaacatctttagtcattatagaaatattaactgaaatcacagtgagatactacctcatccccactagactggctataataagcgaacaaatggaaaataggcattggtgaggaggtggagatgctggagtctcatgtcttcttgctggtgggaatgtaaaatggttcaggcattggagaagtttgatggcttatctaaaagttaaacttagaaaaccacatgacccagcagttgcagtcctaggtatagacccagaatagttgaacacgggtacacaccctgtgcaatcccagccccatcactgttcctctgaggggtcctttgtgtttccagttccccgcctccaccctcaccccctccaaggaaccactcttccaatgtttttccctccagtgattaagaactgttttttttttttttttctagcgaagtatctcagaaatacctaagaaaatcttaagtgctaatgggtcaaaccattttcccctgcctggctcacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacggggtaagtacagtacacagcgggcacgtgctccgggaggcgcccccaagtggcgcttgccaggccttcctcctgtctcatgtgctagaccttctgcttttctcaaattaagtgccaattaagctttctgtaagttcttcacttctgctaatactgaagtctgttatttgtttaaagtggtaattttcttctcaggaatccatgaaagctgtttggcttaactttgagcacttaaatgctgattgagtgtcctggctatttaaagcatgatccctgtctggtttcattttaatattgggatcagtgtggcagataactaacttgcttctttaactcacccatttcattgctaactccagtgctcctaacttcactgaccaggctgctctagattttgttagaatgagttgaaatgctttaaagggagatgctgtttaagtggaatttgtttttagaaaacaggtcagaaacaagagcttacatggctgctctcttgatgtcctgcctcagtcctgagcgtcctgcatttcccctgagagggcgtccagatctttggggctggctcttcctggttgccagcccgccatgtgcctgagaggctgcacagggccccctctgggttttactggtttgcccctggaaattcctaaccactgctgtttatccagtggttgccaaagaccatgtggccttctggacattttttctccagtgaattttttagcacatggatttttttttttttttttgatacataagctgatgtctttggtattttacttttgtcagggagaattgaaggcggcatttgactcatctaggggcacagttggttttttgaagttgccgtagtacagtttgattagttataattctacagatgttctgccaaattgtagttttgggctttcttacaatgtaaatccttttattctttaggattttctatagctatagcaatttggtaggagctagcattctaaataaatattttataaaaaatgttagtagcaaaatttgagggagaacattctctttgactgtctatctggcagctttcttgctttggtttttctctgtgccaagacaaccaatcagcatctgctttgcccactcaaccccagttgggcagtagtctaaactgaaatcctggcccgcaggcctccctgtcgcccgcatcctgtcagaactgtgtactgtactcttctcttggttgctgtcgtatctgcatgcttcgtatagaaggacaagtcctttatctaggctgtaggagccagggtgcagattgtgatcctcttgaatgaagttctggaggaagtttctcttgagacagtatttctaggtccatgttgacatgaaatcatctgatgataaaatggtgacgattcagagctctgttaccatcttaaagatggactcggagaggaaggagaactcgtgtcccctgcagggggttcgtgggcaggtgtccccgtcaggcccgcgggctggaagtgtcgctgctggggatgaaagcagctgctcctctgcacgcctgctggtttcctccttccacgcttcctttctcactttggacacctgattctataggccatgtgcaggctgtgtatctggtgtgtcccctgatagctctgcaggtttgatggaattcatcccagggtgcgttggccacgggtgatctaccaaaacagtttgagttttaaattatccagtgcagtggttcctagactcactttgtgcatggaggcagccccctcttcagatggagtcttagataaaatgagtgaattcactgggtgggcagctgaggctgcctcagagtcttcagaggaaggccttggcctccaaccccacaactctaaggttctgagaaggcagaatgctaaactcgaccaacttttgattttcttttcaaagtacactttttcccccccgagacaagaatcttgctctctcgcccaggctggagtgcagtcacgctatctcggctcactgcaacctctgcctcctggttcaagcaattctcctgcctcagcctcctgaggagctgggattacaggtgtgcgccaccacacctggctaatttttttatttttagtagagacagggtttcaccatgttggccaggctggtctctaactcctgacctcgtgatctgcccgcctcggcctcccaaagtgctgggattacaggcataaaccaccgacttttcttattttttaaatggtagggcagtatgcacataggtattaatttttaatcaacttttttgagggataattagagacagtaaaaggggcccattttaactgttgtctgatttaaatattaacacggttcaggtcagcacattagtttgtctttatatagatgttagaacaaagtttctcatgctgtttctgtttaagtgaaaatttccctgagattgcaaagcaaaccgttaccactgtagccacttacttgtgtgcatcaagatttttttcagtattatgcaattaagttaaaatagagacataggtgttgaggtaaatgttaagactataccttgccgggcgcggtggctcacacctgtaatcccagcactttgtgaagctgaggcgggcagatcacgaggtcaggagatcgagactatcctggccaacacggtgaaaccccctctctactaaaaatataaaaaattagccgtgcatggttgcgggcgcctgtagtcccagctactcaggaggctgaggcaggagaatgatgtgaacccgggaggcggaccttgccgtgagccaagatcacgtcactgcactccagcctgggtgacagagcaagactctgtctcaaaaagaaaaaaaaaaaaaaagagtatacctgtgcccggttgctgtagctcatgcctgtaatcccaccactttgggaggccaaggcgggtggatcatttgaggttagtagtttgagaccagcttggccaacatggggaaactctatctctactaaaaatgcaaaaattagctgggcatggtagcaggcacctgtaatcccagctacttgggaggccaaggcagggaatcccttgaaacctggaggcagaggttgcagtgagccaagatcacgccaccgcactccagcctgggtgacagagcaagagtgtctcgagaaaaaaaagaaaaaagaaaaaacaactatacctgttatctgtataatgagaaaatgtgatttcaattatatatatatatatgtatatgtatgtatatgtattttttttttttttttttgagatggaggttgcccaggctggagttaggtggcacaatctccactcactgcaacctttgccttccgggttccagcgattctcctgcctcagcctagaaggcattttaatgctttttaaaaggttgaaaactactaccatagggaaaaacattgtgcctccctgttgggaagttacagcttcagcagaagtgactgccaggaatgaatgtgacagcttttgattaagttataataaccacatacaccagatattcggctcagtttttctcaatattcataagtaacattgaaaacaaagagttatgtggtcaaagaaaggacaaactggttaatgataatcgtcccctgtgggccctgggcgttggtgtcacacagaactgagaagcaaagcgggtggtgacagaccctggtaatgtgcagggagcgtccggatcggagtctcgacctggtgggtggtttgtccagggaaggacagttctcttctttaggtacacacggtagggactatgattaaactacttgacagcggcacctctgtgacctcattttcgtgtgacacatgcagatctggaagccgccgtcaccgtgagtctcagttggctctctctcacggtcttgcctctgaaaatgcaactgcattgtgcacagaaatccttttctgggtaaaactgggtcttctataactgctgtccgtgtggcttcatgttcatggtgtgatgtgcatgtgtcagccaccagcaccaggtccctgttgggatgtgggagccccttgggctgtctcatcatttagcagttgtctttacagtggtcccatcctctgtaaagacacacagagccacatcacacatcctctatcctaggtggagcccggggtctgcctcccagctgcaccacctttgtctgtctgcaggtcgccagctctgctggggccttctgaagcagcctctctccgtcttgccattcttttcacactgctcccatgttaagatttctacacgtttcgaagacactaaattcttacctaggattattggggaatggaatatatggttagaaatagatgaatttttatttttaaaaaatgacaataagggctggacgaggtggctcatgcctgtaatcccaggactttgggaggccgaggcgggtggatcacttgaggccaggagttcgagaccagcctggccaacatggcgaaaactcgtctgtgcgaaaaaaacaaaaatcagccaggcatggtcgtgcgcgcctgtaatcccagttactcaggaggctgaggcagggaattgcttgaacccagtaggtggaggctgcattgagccaagatcatgccactgcactccagcctgggtgacagagccagaatctgtctcaaattacactagtaagacaactagaatatgccaaaaataaataaacttaagcactaaattatctgagatcctactgtatacagataataacgatgactgcatatttttaaactgtgaacacattatcctattaatcctgctcaggtaacccacctttgtaatgtgaatattctttcccagtaatataaagaggtagacagtttcttaagctgttagaatgcagtgaatcctcccaggccctgaagtccagttgaatggaaatctgcctgggccagggcagccgccggccttccccctggttctcacagccaaggtcctcaggtggcaagttcagggaagcaggcagactgacccagagtggggcagacccgctccactgccaaccccaggtgctggtctgggtctgcagaggctcagggaggaggaggcagctgggtcggaccccaattctgggactcctgggcccattgcccagctgtcagctgtcagcttgctactccagcagctgcagaggggagagagagcatgagtgagcgtgtgtgcacgcgtgtgtgtgtgtgtcacatgaaatacttttgaatctgagtgaaatgaatcttctgtgttctgccaagcatttagttgaggtgtattataaactactgtagtgtagcgctgagttttgaaatgaacagcaggggctgcactgttaatgacgatacgttagcattttagcatcctttttctcaagagcagcaaaaacttatgttttcttgtcctccccacatttttgaggtgttggtaacaagtgttatttttccattttaaagatgaggaaaatgaagctcgggctggttaactgacttgctcagcgtcccatggtgagtccgagcgggcggggcgcaggccctgccgtctggcgcttctgtcgagacgtcggctttccaacctggcaggacccaggacgcattgctgcctgtggaaattaattttcttttggattatcaactgcatgtttaaaatgggctgtagacttttaaagtccgtggtttcctaaagtttctgaaatgtctaaaatgtgtttttaagagaatgaaagtcatacctgtagcctttattttggtccctatgtttttcattgcataatctccttatatacagttacttgtaaagccttttacaccaagtgtcaaggagatttctaatacgttgccaatctttacgcttaaagtgttgacatttactttgatgaccattgggaatggaccagtctggattctgtgaaatgcaccatgaggcccagcacctgctttatgctggactggtagaagcaggcagaaggtcatcccagtcctaaagccactcagaaggctgctgagacttgtgacctagaaatactgtaagccaggctgttatgcagagcctgttgcctttcctcgccgcggtttcacgtgggttttctctctcctttctgtctgacaggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttacagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactgacctgtgtcttggtgtctgtctgcttggtagaacttctcactctttatccatgaaacgccgcatggcacagctgctaggggtcatggggtgacagttcatctcaccaaggagttccttccaagaagaaatgctgctgtatgcacatcttcttcactctgtgttttttattttcatgttcagatactgccaagtatttcacttattaatacctgaatcaattaagatgagagctgggcactctcacctccctacaaggttgtctgaggatttttagttatttgtatagaatgggcattttatttaattttccaaccacctttgtagttaacatttaatgaaactgttctgtaaaatttactgaaggaaacagtacctccaactattgcatttagacgaaactgttaaaaggaagagcctctgtcagatccaaatggtttgggtcctgtactgtgttacttgtaccagatgcttatgtatctgttaaatgtggaagtcgattttgatgatattcttagaagctgctttaattttcctgagactttgtgtgttggcttttgtctcaaaatagcaggattcacattgcttttgggatgcgatcacttgtttgaatgagcttccttatgtccaaaggttttcatgatcattggattatctttaatgaaacttaaaaagaacaatttctagttaaagtatattcacgtacatggtaattggtggtttctgcaagactctgtcagcagtgagctgctggcaagcagggcggccttggtggagctcttatttgcacccggtgtggctcttgtgggaaggagggagaaccacctgcagcttcacgtttgttcacgtttttttcaggatggcactggatctttaaaacgcagtggttcctttagcaaactccgggcttccattagacgcagcagtgagaagctggttaggaagctgaagggaggaagttcacgagagagtgagccaaagaaccccgggtaactatctcttccagctctcccgactccctgcacgccggctgctgggccgcttctcttcctagcgcagccttcctcacccacagacttgaggaaagacactccagttggttcccgtattctcacaaccgaagggtttcatagttgccacgtaggtttttcccaggataggttgagaagtaattgggtaacttcctgttagtggctaaagggcgaatacctttaaaagaaatttatggaattttttgattctgtcacatgttctaagaaagccttagcaacgaaatgtgggcatttatattaaaatgttgagcattttgaacttgtttactctagatatgcattattttttaaattagcattagtttaaattctttaaaaattttaatcttttaaataaatcagatgttagctatgactatattaaatctcatacagtattataatagggagaaaaatggtttcaaataggatcagaacttttaagactttattataaggagattttcaaaacctcaggcttttcatatgtttaaaaaaaggtttgagtcatgggtcttagaggcttttgaaaaataacatttaagttgtcaaaggaatttggttcttaagatatcctttgtttttaatatggtgcacaaagttgacagattgtccctgccgcagtgtccagggtcacctctgggcagctgctcctggcttggacgtatttctcatgaggcagacttttgccagccactctgtgtaactctgacttcctaaatggtgaccgactttttagagactgattcctagtaaaactattttacaagtgatcccactttaagttctgtgagtaagaagtctgatcacctcaggatggtgaaaccgagttcttctggagaacatattggaaataataaagttatgtgcctgatcagttgtttcgttactctgtctttttcgttgttgttgttgagatggagtttcgttcttgttccccaagctggagtgcaatggcaccatctcggtcaccgcaacctccgcctcctgggttcaagtgattctcctgcctcagcctcccaagtagctgggattacaggcacatgccaccacgcctggctagttttttgtatttttagtagaaacggggtttcaccatgttagccaggctggtctcgaactcctgacttcaggtgatcttcccgtctcggcctcccaaattgctgggattacaggtgtgagccaccgtgcctggcctattttgtcttttaaaagctatttaaaaaaaaaagtatgtccactttttcatctctctcagtatccctgataacctaagcccttagaactgttgccatacacggccagggtgcggggtggccagagatggcccagtcccttagtggtagggctcaccctcttgtccgcttggtatccctgtgggagtctctgtcgtggatggagacttctcttcatggctgtgagagaggtgcaggcctgaggcaagaggagtgacgtggcttttgtaaggagcttctcacaactgttttccagcccatttctggagagggagttttaggagccccacaaatgttcattcagaaaactccctggaagatcccaaggatttgaagactggacttctggaagtttatggggacttagcagcaaattgcttacaatgaaacaaatgaactcttatttgggggaaatggattttaaattgcctttggaatagtgatcttattttaaaatgtttacagatttccagaaccaaaatgatagattactatctgcctctcgatgaattttgagattacacatttcttcttaaacagcattgagagggttggagcagtgctgtgtgactgcttggtgtcgcttccttggaatgatgtgaggtgtcacacagcagctctcagatcccctccaggaattacatgatgcccagagagagcattctggacattatttaattcctggaggggatcacactgattgtttgaggttcttaagttttgaagccttttaagtgcagagtccagttctggtgctgagtgttgtaacttggaccacactcccacatgacagctctcagagttgttctgttttctcgtgttttgtgtctttgccgtgataaaaatgtagcagtgtgtgaccagtccccagtgttagaactgtggtcagtgttcatggggctgtagcactgccagcctgaaccatgtgacatagatgcacacacttgcacggactaacgttttctacatgactttggaaattgcatcccgtaaaatgcatacaactgaataatctttccaaataagagtgactgtttttattaactagacagtagtctcagacatcttttggagggtttgttcagacagagactgtgaggccccacccctgagtttccaattcctgagtccctgatctcagaatttgcatttcacacaagttcccacagtgctggggctgctggcccggggccactttttgagaatcgctcaaggaccagggtgtttgcagcttgctgtttggctgactcctaacagtgactgtactgaaaggttttgaatgccacgtgttcaaacaaggcagttcgcaagagtggtaggaagagacgttgaggattcgagttgttctttcgtttcgtaaaagggggtttgagggaaggttgtgtagctcttttaaaaagagttaatggcggccggtgcagtggctgatgcctgtaatcccagcactttgggaggcctaggtgggtggatcacttgagatcaggagtttgaaaccagcctggccatcatggcgaaaccccgtctctactaaaaatacaaaaattagccgggccaggtggtgcatgcctgtggtcccagctactcaggaggctgaggcaggagaatcactggaacccagtagggcagaggttgcagtgagccaagatcacaccactgcactccagcctgggcgatggagtgaaacttcgtctcaaaaaaaaaaaaaagttaatggccactttatagcaagaataactgagtatgtcagatgataatttacttgtgatttggtttgattttatactttgttcttgagtggttctaggtagagaaaaacctgtttgggactccagcaatgtctgttgtgggcttcattgggatgtttttgttttgtcctggttgggacattttgggggtgagttttgcctggggataaggaaattcaggtcttgcttttggtgcagttgttcggcaggggctggctgagtatctgccatgtgccaggcgctgtgctcacagcactgctgacacacgggtgggtgccctgggctttcagcctcatcccagtgtcctgtgtgaggctgtccctgtcacccctcaagcctgtgcctcagcctcacagccaccgtccttggctttcccaggaactgctgcgctcatgttcgctgtcccatgttgcatgcagttcacgttcagaattcaagtaaccctcagtatcggttgctttagctttaaaacttcaggggagtttatgttcaaaggcatccatggtggtggtgaacaacgatagtcattttatgactgtccatcatttaagttatagattatttataggctgtttcatcaagtattttaaatacatcagatggaggaaaagtaaatatatgtatacattcctgtattcctttaagtggagaaccatgactttatgttacattttgctttctaagtagaaaaatactggcttcagagtttattttactaacaataaagttgatttcccagcttttaatatagaaagataaaaaatatgacagtatatttatgcatcatcttttagcagtgagttttgagtgtctcttcatgatcccttagtggtgacgagtctgacatgagccctggagcaccctccctgaaaagcatcagactgaaggcagagcctctctgctcccagatggttccccccactttttttttttttttttttctgagacagagtcttgctgtgtcgcccaggctggactacagtggagtgatcttggctcactgcaacctctgcctcctgggcttaagtgaatcttgtgcctcagcctccagagtagctgggattacaggtgtgtaccaccacgcctggctaattttttgcatttttagtagagacagggtttcaccacgttgcccaggctggttgtgaactctgggcctcaagtgatccacccgcctcagtctcccaaagtgctgggattacaagcatgagccaccacgcctggcttttttttttttttttttttttttttttggtaggtggagtctcactcttgcgtaggctggagtgcagtggcgtgatctcagctcactgcaacctctgtctcctgggttcaaatgattttcctgcctcagcctcccaagtagctggaattacaggcacatgccaccatgcccagctaattttttgtattttagtagagatggggtttcaccgtgttgctcaggctggtctcaaactcctgagctcaggcagtctgcccgcctcagcctcccaaagattacaggtgtgagccactgcagctggtcttttttttgtttcgttttgttttaaagagagacagggtcttgctctgtctcccaggctggagtgcagtggtgcagtcatggctcactgcagccttgaccacctgggctcaagtgatcctccacttctgcctcctgagcagctgggactacagatgcatgccaccacgcctggctaatttttgtatttttgtagagatggggtttccccatgttacccgggatggtcttgaactcctgggcttaagtgatcctcctgccttggccttccaaagcattgggattacagacttgagccactatacccagtctagatgagccactttttaaaagtgcaagtctaaggacattttgagtttgcatatggtactttaaaagaagcattttgctgtgaaagatgcagagaagctgtggtcttttctcctgggcactaaatagagtgagacataggactccccggttacccaagcaagatgaaggcaaggtccctagagcccccagtgtcacagaggcgttggagggggctttgcttgtgcttcctgttgctggttgaccgatgtgctgatcgtttgtccttgcatgtccgtgtccgggttgcagcatgaagcgtgccagctctctgaatgtccttaacgtgggtggcaaggctgctgaagatcgctttcaagtaaggagcctaccccgaattgtgtcctaggctgcccagaccacgctggcaggtctgctgcagacccgcactcggcccctgctcggcccctgctcctgcagagggctggggacgccgccacgtttgttcctagacagacagttgtgacagtagtatttttatattctgcttaaccactgattatgtgaattatgggcatgttcacactgtgaacattctcagaatattaattaatgatctcaaatggtctttaaaaatagtttaacctaattaatgtattctgttaaagtactgtcaaagctcgaccaattactagtttgtatgattgtttgattttagcctctactaagtttataactattaataattaattgtctacttaagctgttgttcagtgttcagaagtattcaaaactctgttaacatgatgactagcgtgctgtcagtttgacactaaaacctgaagcactcggtgcagttgctcgggcctcacacagacacatcaggtttacatctgaaagtactgcctcccttccccatcacggaggccgtttgagttttcatccactccgccctttggtgtggctgtcagtgggtggccgggtgcctgtggctgctctagaacctgtttctcaggtgcctggggcccacccggcagctcgagctgttgggacttggcagtccctgcccctgtgctggtgctgagagttcgcgacagtggccaggcactgccctcccagttgtccagatccactaatcctcacagacaggccagtgccccgacctgtcccccaacactcttgggaggcagccatctcgggaaagcttttccccagcccccttctcggtggctgttaaagaggcttgtagggtgctggacatgttgcttgaagcacccctaatgacaagaggaaagaaagtctcttcattttacagggtcctgtagctgacccagtgtttgccctccagtttcttggagtttctacatgcacattgacccctgggcctctcgagtgccaacctagatttagctgtgcagctggtactgttaggcctgaggccatttgaagctggcatcatttgaagtcctggttaagtgtaatttttctatttgttttttcatgcaggaacgaaataattgtctggccgactcgcgagctctgagtgccagccacactgacctggcccactgagagccagcagggctaggtaacctgtcttgggagtgtgagaccgccccgccctgccacgcccctcaccgccctgcccggaggcgccagccgcactccttggcttcctttcctagatagtgacgtccaccaaccttggaggtgccttttcaaaacacccgggaggccgtgcctcagcattctgttactcggcctgcagccccagtgccaggagccaccccgaccgcgacccggccaggctggctcagggaggccgaggtggcgctgaggtggcttcagcacgctggggattggctcctgctcacggatgctgttgcatttcctgcctgccacctttttgccatgacaccagactctcttttaaattgtaatattgtaataaggctgtaaattaagaatctggaaacataaagtacccctttcagaacgataggcatttagtgatctatggcagtaaagcctgaagcttagcggacactggtcagtgggaagtgaattccttcccagctggagcatcttccgggtctctctttccaaggtccccatgcctgtggccctggggccccatgcccccttttgagctgtgttctcccggacgcccctgcacacgaagcccatagagacgtgtgtttcactttttttttttttttttttgagacggagtctaactctgttgcccaggctggagcgcagtggcccaatctcggcccactgcaagctccacctcctgggttcacgccattctcctgcctcagcctcccgagtagctgggactacaggcacccgccaggcggatcacaaggtcaggagatcgagaccatcctggctaacatggcgtttcactttttaaaagcttaagctttatggaatgagggagcacggtggactctgacaggaaccttttcaaatcaatgctgaggctgtatttcttagccgtccacaaactagtccataggtaaagagcatacaaaacagacgccgaggtgatcagtgattccaaaggctgacgctcagcagcgccacctccatgccagccaactaggctacgggatggaggggcggtctgtgaaacaccagccatcccgtgaaagctcagcttgccactgtcatgtaacagggtgggtggtggcacagcagaggctcacacttgtcaccttcagcctctagaagctccccgtggggcacgaaggctggggacagagtgtcctgaggttttgttacaaggctagactttaaaatacctttcaaagtttcatcccgcctcatgtcgcaggactgctgtgtttgtgaaagcgcgtttgtttccacaagacaagctccgtgtagtcgccagcgggtgcctggcccaggagctgccctgtggagccagcgttgtccccgagctgctcgcctgtggccgtggctccttttctgaggctcctgactccattcttgcagattctggtggatcaggagcttacattctaaatgctacatagaggtgttgaagaaaatttcataggttctgtaatagtggatgggattaaaagaaaaaatgttaaattatatatatatatatggctgggtgcggtggttcatgccagtaatcctataatcttagcactttgggaggctgaggcgggaggatcacttgagcccagttcaagaacagcttgggcaacacagcgagtccctgtgtctagcaaaaaaaaccatgtgtatatatatatatatgtgtgtgtgtgtatatatatatatatatatatacatacatatatatacatatataatttgatgggttgtgagaagccaaccccccccaaaaaaaggggggtgtagagcagcttcccctgacaggtgccgtggctgcccccgtagtgggctatgtctgtgcacaggcgacagggaggagggctccggagcttcccttgtggtgggggtgccttctccctgtgaggatgctgagcagagtttggaacccagacagtttcccttagtgacagttatctggaaaggaaaaagggcatttagaaggaataaacatagggctgaatatggagttgaattttaacctcttcagactgatgggtgcagacgaggttgtgtggggcctctgtggagcctgctgtggcttccagccatgggactttagggccgaggtggcctctgcagcactgtggctgtgggagcactgtgtgttggggtaagagaagccagggggcctccctgaagccagctcataaaggaaggttcgtgtttcagagggaggcggcaagggaatctgagtacctgagtccccgatgtttgaacccttccacccaatagaagtgcggtgatttcagccatttcccatctggcggtctgaatttttcccttcagaggagagaagtggtgggcccaggcatccctcctcctgtgtgtggtcgttctggtgagaggaaccccacgcgagagtcagcacctgtttcttcagagttgctgtcaaaataatcactgcgcccccgccccccgcccccccccacagcagccgtgtgtgcagcgcccgtccccagcaaccatggcatgggagcgtctggatctgtgggcggacagcatatctctgggtagttggtgcagctgtggcagaaatcaggcccctggggaagtcctgtgacatggatgcttccctgaagcagcagcagtgtgtggctcaggggtcctcagaggccggtggtgcccgcgggtggcacggggcactctcatgggcagcacttggtcttgtgtttacagtattggagggattcacatcgttgttttctggattaagctgctaggagtatcatgtacttagaaattcagtgtttatagtaagatgtattaaacattgctaatgatgtatcgttacaatgtataacaggttttccattgtcataactgtatggaattttcttggaggatgtcattagcttctgtttgcactgacttgtgagctgtgtgtacgctgtggtcagatttctgaatgctgtagagcacttaccagctctgaccgtgtcttgctggggccagcaggctgcgtgtgcagcggggccagctgtctcagggctgatatgtagacgtgtattctgtttacaattagttccccaactctgtggggaagaacttaagcggttttagtgttttataatatggtgaggcaatgagggtcagggcgcgtggtccctgagggagggtcttcagggcaagacccatggccctggcctggaactgtgctccccagggcgtggtgcctccctaaggggatggtcagtgttctgggactgactgccaggccagcccgtctgcagactcctgtggtgggagttccctgggacgggaagcccctcggccccttccctccaggggcaggaactgagccagcatgggcggggccggccgagcttccaggcgtgttttctctgttaaatgtacctctgtctttaagctgtctcattttctaatcgctggcatgtcttgcctagaaaagcatttggaattgcttatgttcaattacagaaataaaatgtcttacttgccattgtagaattcctgcacttttgcagaaaggctgttttgtaaaaatccaaccccaaaataactttttcccatgttcatgccagtgattcttaactttagggtcatagagagccttgataacatgatgaaggtttaaacggattgtcccaccctggaaaacggcaaacagaaaaattctgcacagtatggccccagcccttacctttcccccaaccagtgccagccccccttcctcccactgtaggagcacccacaggctcaccctgggcacataaggtggggggtgacaatttctgcctctgggttgtgggaggagtcaagctacttaacggttctgggcctgaatttccctacctgcaagtggagatgtaacagtacctatccctaggagttgtgaggagaacatacttcaatgtgtataaattactcagagcagtgcctggcagacagcaagaagcaggtcctggaactgcatccattgaacatttatttgtcaaaggcctggtctgtgccaggcagcatgtggaggcactgagtggggggtggagggggttgtacggtgggaatcaagggggtcaccactgtgcccatggggaggccacgccactctgcctgctgggtggatatttcagcctgtgcagccagatgtgttcccaggaggctctgctttccagccagatgtaaggcctggccacagtgtgggactgggtctgcacagtgtgggactgcaggacagggtcctgcaggtggccctgccaggagtcctgccatatccctaccagaataccacccagccaggccagggctgagctggacgcccagacccccagggccaggatacaccgggaccctccttcctctcaacctcggatcctctttgcccagaactgtgttcccaggtggctgacgagcctgtcacgtgccagccctgcgctgcctgcgctcctctgaccggctgtggtgctggcacaggccacactactagagacaaggcagtccccccacccccaggctctcctggaccctgacactggaggttggtgggatatgctttctccaccttgtaccacactgaagttttgtggggcacagtgtgtgccgaggtggggcccccgggagccaaggacccagaggtgggtgaggaggagccgcctgcctgcagccccactgtggcctgagtggtgggggagtaaggactgccctgtgtgcaggaggggagaccctcgtgggcacggtcccaaggctgagggggtctgaggccccagcccagggggcaggcctcagacgcaaccccagttgggcttccatgtggagagaagaagcaggcggctcccagggagtcactgtaggacaccccaggctccagccctgagaatcacctctccccaagggccagctcagcagtggggaccaggtacccagcaagcgggcctgtccccagacccagggagaggcagaacatccccccagctcagatgggggtcagtctgtggccaccatcttcggatgagaaagtggagccgctgccctggaagagctgtgtctgaaccaggctcccagctgtgccacggcccaggcagacgcgttttaaaggcccgagccccgtgtgtcggggcttctcaggcagggctgttgtgcagccgccaccgtgtcagtgggactgggtcccaggtgtccctcgcaccccttcggcactgatcgtgtaggaacaggaggaggggggcaggtggggggcagagagcacccgcagggtccgggctgggcagccgagggcagcctcttcctcgcggagccggtcagccagcagtctcaccaggagctggttagcccaggttatgccaagggctggggaaacacgttcgtcccagaacctgagaaacaggaagcaggcaagctggcgctcaggcttggtggccccgcccacttcggcccagctgtgcccctggcacctgcacagaggtgcacacaccacatggctgcactcaccccagcggcccgtgtgctgcgccctgctcctccatggcctctgtcacctggaagagcacagtccaggtcagctgcaacggctgagggtcttctcgatggttaggcacaggctgctacccgcaggagccggaggccacctcactgccacccgccccacctccagaccggctctgcttccgcatcctggctaaaaatacgagctcaggggtgcaaccctgccttggtgctcacctggttgatgcacagcacagggctctggaaggcactgctcagctcacgcagcgtggcccccagggactgcagatgcctggccctgggggcggaggcctggctgtcaaattcacagcggaatggggctgccaccgagtcgatgaccaccaggcgagccatgccccgagacagcagtacggggaccttcttattcacacactccaacaaggtgtcctgtggggacagctgtcattgtctatgctggtcagcaagtccccgccccaggtgaccagaccccgtttggactgtcactcgaccgtctgaaaaccttcctacccacctggggctcacagtgcccatactctgtagtccccatactctgagcccaattctgtatttttctcaaagaggccccaactatagaagcttcaggctcacacaactggttcccttggccccatgtccttcctctggcccccccaggcagtcaccccttggctgtgccaacaccgtcctctgtagaggtgtcctttgcgcaggctcctgagtccttgcgggggtctgctctccttctgccatggtttcaccctctccccctcacaggtcagcagcaaccagccccctccttcagtggccccgcaccaggtactcagaccacccaaacctggccacagtgccaccaaagccagcccgtggtggccatgacctcttcagacgctcagcaaggcaggggcctgatgcccttcaggcgttactcaggcgagtcaggcctggcctgcctctgccaaggcgtggggcactctgggagaccacctgggggtcaggatggggctgtaggttgagacaccctcaaggccagtgcctcccgtgcatccaggccttagccctgtgctctgagctggcctggcctggccaaggggtggaaacagccctgtgcccaccagctcccaggagagcttccaggggaggacccccccagtgaaggcaggtgtcctcggcctccctctgggtgctgccgtggcctgtgggtgccagagccattggcatggctggcctggcctctgaccgcacagcttggtgagccatggtgatgggggagggtgacacagctgctcctggcaccaagcagtgtagttcaggccccacgggccttgccagcagctctggccagatggaggctgctaaggggcccctaggctgtccctcaagtccaaggtctgcagccacacgctggtgtcacgcccggagctctgaagacgcctgagggccgcctgcacgccctgagtgaaactcgtctgtgcttcatctccagggcgtctctggccgagcctctttttgtggaaaacgacagcagcagcagtggcctggaagacgccaccgctaacgtgagtcccacggcctgcagccccaggaagcaggcagctgggccagggagggactttgcacatgcagggactggggggagctggggatgggcaagtggtgactgctgctagctgccaggctgggcctccaagaggggcttggctcagggtccccatcctcatgcaagcccaagggccacagagtgggggggtgggaatggcaccaggctctgcttatgcaagagaaggctctgtgtccacacccctggcttcccccgtgccagacgcaggcctttggtgctccagggagcagagaccaaagacgcaccagtcccccatgacccctcggccccagggaggctcacaaccagcaacaccctcttctctaggcagacttggggtgggggttccccagagagctgtttccagaacagaacttagtaacactgtcaggttttggcggcccagccctgaccttctatcttctcttgcagtgaccccgacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtacatttttttaaattaaaagtttatatgccttatgctttacttgaaagtttttataagacctcttagaagtgggggaaggctggcgggcgcggtggctcacgcctgtaatcccagcactttgggaggccgaggtgggcggatcaccaggtcaggagatcgagaccatcctggctaacatggtgaaaccccgtctctattaaagatacaaagaattagctgggcgtgttggtgggcgcctgtagtcccacctactctggaggctaaggcaagagaatggcgtgaacccgggaggtggagcttgcagtgagctgagattgcaccactgtactccagcctgggcgacagagcgagactgtcttaaaaaaaaaaaagagaagtgggggaaggcccacccaggagctgctctgccaggccacagccatgtctagggtgggctggacatggcagccgctccccctgcacagggtggaatttccttacttgcctttggtcaggggtttactcccaaacgtcccatcttttcttctgcgtcttttctacttcatcacttctccctcccaggatgatgtctataaactaagcactgacagctcacagcactgctgccccagctgcagggatgggtcccagcctctcttgcctgcttcttggctacaggacggactccactggcccccggtgagtggcccctgctctctgcaaggccctgccataggtccctcctccaagcccagccagtgtctgcagggaagccagcagccaggcagtggtcaaggatctgaggtcacctgtctgagctgggtgcccagcaggccttggccaggtggagcccctgtgcccctagtgagggccgtcttcccctcaggggcaaggggaaaccaacacagctatctcaccagggcagcagcctggagagcaggtcgcatccttctcagggcggtggtctcctggggcagctggtcaggggcccacagcccagaggaggtccttgccacccgcctggggcttctcttccccactccgtcttcatgggcaaggttgacagatggtgtacaggcgcccagttacatctgagtttcagatcatgaagaaagttgatctgaatatgggcatcctcattctagaacacgcttcaaagctgcctgagattcagatgtaactgggtgtcgcagcctgccgccctgcctgcctggcccacagccactcctggccaggattctgtttggccaaactgccgtcaggctcctgagcctcctcctaggcccatctgtgcacgtcctcatgaaatccagttttggcaatccctgctgagattgtagcaggacccctgctctccgtatccagtcgccctcagtagctgactggtccatcctccacagtccccagaggccgtctgatccccaaggcacaccttcagcaagggtcctggcaggatgctttagccagaattccctcccctgccagttcctctcagtcactctccatcctctgaccccacctgctcctcgggcgtaaacccccatgacccatgctgtgttcagagctgagccccaactctccctgccctgctgtgagaccccattgccgtggtggctacacctgccccaatggtcctgaatagcttgccttgggggtgtcatggggcttctcccacactcaccacatcggccacgtgctcgatgaagatctggctgccaaatcggagcttctgaagcagctctcctggaacgtcagtgcgcagccgcggctgctgggccatgagctgctgcaggcgcttgtgcgggaaggcgtcttccgtgcagatgtagacggctcctgggaagcaagagtgcctgatgtgcccaggggactccagacgggcctgtgactgccacacaaatcaagtgcagatgtctcccgccatttctaactctctgcccctcacaggttctttgcccctcgcctggggagggaggaggctggtgctttttctcaccctcccactggcagccacctccggggccaggtgacccctcaggaggaatatgggctgggtctccacttctgacacccaggcaaggacttcccctgtcctgggccctgggctggaatggccacagatgggaggcctctcctgctccaccctgcccctccttccccctgtgaacctccgttccccactgcagggcagggagcaagtggcagcatcagggcaacgccttctggaaatggcccctgagccccgacacatggccaccctcaaggcccccactgagcaagcgtttcctctcttcaaagctcctgcaatctgggctccatggtgaaattcaaaaagccagcttgaaaagacacgtgttggtgaggatgtgtaggaggcagacccctgacccctgtgcactgccgctaggaatgtaaaatggtgcagctcggaaaacaatcggtacttccttaaaaagttaaacaaatcacatgactcagcagccccactcctaggtagatacccaagagaaagaacgtccaccgtagcacgtttcatgacagcccggggggagacggcccaaaggccatcaactgaggagtggacgaatgaagtgcggcccatccttacagtgggatgatcgaatcttaaaagggaaggcagttctgacacctgctccagcacggatgaacctcgaaaacacaatgccaatgcaggaagcctgtcacgagaccacgtgctgtccggctgcacttgcatggagctcccaggacaggaagagtcacaggtagggaaaggggaggcaggctgctgggggtgggggctgactgctcatgggtagggtttccttttggggtgagggaactgttctggaattggatagtggtgacgggcacagaactttgtgcttctattaaaagccactgaatttatttattttattttaatttttgagagacaagagactcactctgtcgcccaggctggagtgcagtggtgcgatctcggctcactgcaacctctgcctcccgggttcaagtgattctcctgcctcagccttctgagtagctgggattacaaggcgtgcgctaccacgcccagctaatttttgtatttttagtagagactgggtttcaccatgttggtcaggctgctctcgaactcctgacttcatgatccgcctgcctcagcctcggcctcccaaagtgctgggattacaggcatgaggtactgcgcctatcaggccgaactgtacacttttagagggaattttatggcatgtaaattacatctcaatttaaaaaacaggaaggcttagggggactgatttgagtaataataaaactccagtttcctgcaaaacaaaaacaaaaagacaaggccggcgagctctctaagcactgactatgccaggaaggctgcccagccaggaccccgtggcccacggggcgtcgtcctgttcctgcagtggcacatgcagttgtgggagagccagtgcccccacgccgtgtcatgcagcctgtttgtgagtgtccgcgtaacctttaattctgagctgattttgctttgacagaatttcaaacgtaaagaagagttgcaaaaatgggtcaggaaccccccgccccattctgtgtcagaactaagcttctgagaagcatctggcccgcttgaggccaggaacgtataaatactgccttgggaggccacatcccttttgtggctggttcccttccccaccagtgtccccagcagtgactgtgcccctagtcaggagccacaggaaggtcggggccctgggcttcctccgtcctgttggctggagagaggctgggctggaaggctcggaagcaggtggaaccggtcaagcagcgtgtttttgttggggtgacgttatgtaggggctgcacagtcatggggacatcgtgaagctggcaggagggtggctgtggacagcccagcggtgggcggggccccagcaggcctgggagagcctcacgcggcttaagcacgggagtcggaatcacttcagagcccgcctgccgctttcttttcaaaattcgggcctttagattggatccaggaaaggaagtcatttccccaggaaagcacatctgacccctaaccttgcatgtggtcacggtggccgtggggccccctcccttcccctggcccgcaaggctggactgtgctgtcatcccgcagcagtcactgggctgggcacagctgggggattcagggagggtgtcctaaggcttctgtgtccctgggtatcggggagtgtgggcttcactgaaaaggccaacggggtggaagctgagggggagtcattgcacaaatcagatttgcacgaagcctggcacggaggacgctggagaatgagggcggctcccgtcccgttcctgagcacgctcgagtcccgcctccacctcacagcagctcttccgtgcggtaagcgggagactcccattttcaaggccaactcctgtcctcccggcttctggctgtctccaggctcatccccaagaccagccgcagggactcaggcacctgacaagagggtgccctcccctgggctgcagggacaaaaatgcctgtggcgtgagcagaccccagctgggctctcaggagacccctcaccctccacccgacacggaggctcaggagacccctcaccctccacccagcactgaagctcaggcaggcacagcacaccctgggtcctggggatgacgctgacctgagggtggcagaggtgaggttcccagccacaccgctgctggcaggtcaggcccgtgaggaggtggctggctgggcctgtgggtccagggcctggggtccggccctgtgtgggaagtgagcctagcagatgtgctcggaggtgccaccgatgaaaaaatactgccactctgttcacgtggagtttaagacaacgtgggaatcgcatgttgacaccagggaattagtttaaaagttaaggagctactgagaaacatctctcctcctcacagctcacagtttaaaactacgtgaacttttaacacctgagagacccaggcaggcatgctctgaacgctttagtccaatgcagggaaccctcgtttcacagacagagcgtacaggctcacggggccgcgccaggagcatacctggcctggcggcggggcacccggggaaaggctgtgctgccctccctgcgttgctggctctgtggactctgggcttggcagctgtgcggaacgtgggccggcatcgctgtgctcagccagcgacccctgggggcctagctctgctgagggccggctgcctggtggtggggttcgtaccctcccacccctcctgctgtcagctgagcccagcctcacttccccctccctgttctggaaggagcgagggcaatcagggtgagaaggagggagacgcaatggtaggaacagcgcaagaggcggccactgccccacctcaacggaaagctgtcccacacaaagcaggggccgcccacctgcccagaccccacggaaggggtggccactcaccagcctccaggcctccgtgctgccgcgggaactgcacagccaggcagagctgcagcgccagctgggtcttccctgccgagctgcgtccggccagctcagtgatgccgtccaggggcaggccaccgcggagcagcgcgtccagcaccgggcagcccaggctcaggcgctggtgctgcgtggggaaccgctccttctgctggtgcagctgcagtgctaaagggcagggatagtgtcaggcctgactctcctgggcctgcgggcagggctggggactgcgggaggcatggtcagcctgcctgtgccaggtgcagtgtggctggagcacaggtgcctgcggtcatgggggtgagcaaggtgctgagggcagggaggggggcccagccgggaagggcgggtgcacctgagatgcagagtcagggggagccccagggccaccatcacatgcccgcagggatccccctatggggcaattgcagcaccagacgccttcagccaaagcttccagagagccccgaggcgctccctaacagcctccatgtgaagaaaaaggcacagctctgtccagctgggatgccctggggtgctgaacagttctcaagcggctttaatgggctcccgcaggcgcgcacacatgcacaccacatgccgtcagttctctgtgacagataccattctggagcaatgctggtctcagcctcttggctaaagggccttggatgagccatttgacacagcctcctccacgacaccgaagcccctcagggcaaggctcaaggtgggacatgcggtgcaggctgcgctcttggcctggggcctgggccgggaggagcagcccctcccttggagtctgcacactgccttgggcaccccgtccaggtggagcaggccaccctgactgtgaggcctgcccagagccctgcccacagcaccgtgtgtgtggccgtggcacctgcccaccacggcagccccaagttcagcacgttcctcggggcctgggccactgagccacctgcaggggagagagggccctgctcatgccaggaccccgctgcctactagggcctgctgagatgcagggatggaaaccttgtccgtccaggcgcatggggttccctgggtacctccttcccctgctgagacctggtttcccacacgtggtggtgggaccgtggccagggccccatctcacaccgttcccaccctgccagagcctgaagggctctgggtgctgactgccaaatccacccctgcttcctgcaccccctcctctggtccatggagcaaggtccccaggaggtcccacagcccgtgtccacctcacgcatcttctgacccgatgctgtgaccacagccccatgggtgtaggacaagcaagatgggaactctggggctggagcagctgccacacgccctgaggctggtccctgggtgaagtctgcacagcccctgccctgcaccactgggaccatgatgctggagccacatgtcacccctggcagagatgccagggcccacctacctgtaaggatgctgcttccccgcaagtgtaaggaggccgttctcagcaagtgccagacctcggggctggagaggttggtcagtctcttcaagtctggtccagaaaagtgtaaaacctcctttaccgatttcagtttggctgaaataacacagataaattacaggaaaatgtcagactgtcacaacgcagggcaacacagtgacaaaaggtgctttgttaagagcactgtgagagcaccgtgcttccgattctggggacaaggtgggtagggaccggatcccctgctccctggaaaccctggacacagtgtggccgatgcacaggcacgaggaaagggctgctggacactgcgccctgagtcctggcactcggacagataccagcctcgtgagctggggcagaagccagaagacagggctgggcaggtcccggtgctgagagcaggttccggtactgagaagaaacgacaggcacccagttccatgccagctggagacagtgctccagaagggggcaggaaaaaaccagcaccgagctttccaccacccgcccaccaggcatggatctgggctgagccgcgggagaggacatgtgccctggggaggggagcgctgggagggtagcagagcccaggtccaaacgccagctgcgcagggcagtcagggcagggggcagagcatgtgcgaatcagaacggcggtggcagcagttacaggggtgcagatccccaggacctgccatctggggaggagggcaaggaagttaattttggactcagataagtgcatcactttctaatttcaaacttgtagaaagacgacaaatgctgcagactgatcagccgatcagggaagtgcgaggaagcgcacacgagagggagcagtggtggacgaagcgccccacccggccacggggacttacacccaccacatcagaaaccccctcaacacgggtgcgctgaacgctgcagtgaaaagacaaccattgtgcggctggaaaacagtaagcactggtgtgatcttcagaaaagccacacagaaaacacaaggagatggaagggtgggaatgaagaaagcgcccctgggtttcaccagatccagcggagggggcttcccgcagacaggctgctccagaaggctctgtgggccctgaggactcaccgggatcggggctgtggcagggcgctccccctggtaagcctcacagccccagcccccttcacagccgtgaagtctgcagggacttctggaaacattggtttttggataagagacacaggtgagaaaggaactccctggctgagcccttctctgtccctggtctgcaagcgtcgtgtctgcagctgtggcagcagctgtgatcacaaggccaccaacaggaggataaaaaccaacagccaaggatggagggtcaggacagcgaggccctgccctgtcaccaggctgctgcggcagctccatgagcactccggcttctcgccacagacagcgtgctgaggttcacgtagctgaggcccggggagacgggggaggatggaagctggcaggagggtccccggatgacagccaggcggctggcatggggagcagggggcaggggctgcacgtggggcctgagttttgagcatttactaactcgggcgaaaaaagatgctgtaagaaagaaaaccatcccctgcaccaccacaccaggttcaacaatggccagtatgcacccagtcacaaccctgacagctgatgtcacccaaactaggttctaagtatgggcagggagctggggggagaggaagttggggtacacaggtgtaggcacgctcagtcctcacagcccccaagagaagtccatggataatcagtaacactgacaaatcaaacattacaacataaacacgtttaggagcccagatgtaaatattttttaaaaaaataactaaaagacggccgggtgcggtggctcatgcctgtaatcccagcactttgggaggctgaggcgggcggatcacgaggtcaggagatcaagaccatcctggctaaaacagtgaaaccctgtctctactaaatttacaaaaaaattagccgggcgtggtgactggcgcctgtagtcccagctactcgggaggctgaggcaggagaatggtgtgaaccccgggaggcggagcttgcactgagctgagatcgcaccactgcactcaagcctgggtgacagagcgagaccccgtctccaaaaaaaaaaaactaaaagactttatgtggctccattttaccttttagacaatatgcatgtattactttgataaaaataaaagtaactgaaagaaatccatgtagttaagaacacacacacacacacacacacacacacacctgaaaatcccatagtacatcccgccctcggtttaataatcagggtaggcaaaggaaggaaggcttagccagccagcgttttgttaacctgccttatataaactgcacacacccacccacaccctttatgtaaatagaaataaatgtacctttcttaattgcagcaataattctgggattcaggtccagtagatccaaatccattttgtcggtgggctggccaccaggatgaataacttcccaggaaagacagaacaatggatgcaaattctgaggcactcgccttcaattcaaagcctgtgggaggcccgaaccagggaagtgacagcagccgaggtgtccgtgtcatcggggctctgtcactgagggtggaggagacttcactgtagagggaaggctgtctagctacatctagggcaacatgtctgtcatttacctctaagaattatttagcagcttagaacccattccagacactgatgcatttg

SEQ ID NO: 37815 - DNA, 3611 bp, Homo sapiens; identical to SEQ ID NO: 36400

SEQ ID NO: 37816 - DNA, 43041 bp, Homo sapiens
cagtttcagggtctcgccggcagccccagccggcgggcgcggagcgggcagcggggcccggatcgcaggctcctctgggggccccggagttgggaagcggcgtccgggagcccccggaggaggatgggctgcagacacagcaggctgagcagctgcaaacccccgaaaaaggtaaagggcgccggcggagaagtttgctttcagaggagaggggagtgcggaatcgctccgccgcagaggactcggcgccccgggctctctctggtcggcccgggataccggacggagaacctggagaggccagctcagagacgagggaggctctgctgggaggcgccctttaccccggcccgagccgcaccaagcagccgagtttacaaacacggcacccgggccagggaaaggcagctgattcccgctgcctcgggtggggagatgtcgtgtgtctgtggcaggtgccctctgctttcggtctggggctgttcgctgtgtggccatggacaagtgacttgacctctctgggccttcggcttcctccccccgggggttaaaggctgataatctcagggctgctcgaagagtgttccacagactcgcagtatcagcatccctggggacctgtcagaaatgcagaatctcaggctcaggcccagtcttgccaagacagaagctgccttttaacaatatgcccaggtgatgacgctttaaagtttgaggcgctggtcttagggctcttgcaggccccagagctggtgagtgtgggctgcccttggggtagctgggaggggccaaagagggaggagatctactgcgttctgtggccctctcctcccttcctgtccttcccccaaggggccttggagctgggtcagggcccaggggacaattctcaggtttcttgcagtgagaccagctgccccttggggtctgacgagcccagaaggtcagagcctggagctagaaagatagcctcctcaggggacactgtgaggcagaggggaagaaggaccctcaaattctggccccttttcttaccactacctgccccctagccaggtgggactaggtgatcccttaaactttatcatcattcccccttgagaccttgagaggccccaaactgtgacagtgtttaatagttttgcaatgaactttagtcctccctctgctcctgctttgcttgtgccctgagtacaggtttttctgcctaacagtagtcctagcctggaggattctactcccttctctgacacctcctggctttccttgctctccctttattaccagattgaaattctcaccaactcctgacctagaaaccctcatgtctttactcactccaacagggaaactgaggcttggctctatcagtagaaggaaggggctggctgacagggatgacaaggcggagagacctgagccttggctgagacttgtaactgagcaagtggtaggcagacattagccctgggtgtaagtcctggtggtgccataaacatactgggtgaccccaagcaagcccttgtgtctccctgggtctcagtttctccctgtatggggagtgatgagcaggatgatccctaagcatctgagagtctgtgttctctgcacctgtgtcaaccttgtagcttgcaaagtggaccaagggtgaattccatctacctagaggtggaggaaacggggaagagcctgacccttccacaagctggaagaggaggtcacagtaagcacaggttctttggctcctgctccttctgagagacttaccagctgttcctgcctgtccctggcacagccaaagctctgaagggcaagtaaagctggcacagcctgtctgagttggaaagggcctttgggtactacctgggctgacgcacccactatacagataggaggttaaggcctagaaaagggaaggagcatgactgaggtcacagagcaacacagagcagaacccaggtatctagtcccctagctccgtgttctttgtctccacctcctcccgctgtgcttccagtggcttcttgatgactttagcgtaaaatcttttactcctgttgcctcagagaacagcctggcatgccttcttggccccagccatgccaggcccctgcccctatatggcaagatttatgggctgtttttgtttaaagttctcatccctgtaggctgtgctcctgcccaatttctcacccaggtgccaaccccttggaaggcatgagctcccaagttcatccccaacaggctaccagccccctgggagagagggggactccagggatgggatggacaaaaatgagctcaggctacagaggggttaggttctgataaccatgactcaccctgagtgtttacagcatgctttcacatcccgcccagtctcacagaagccctggaagttaggctgagctgcagaatctttcccactttaccggggaaactgaggctcagtgaggaacgatgggtccaaagtcacacagccagttggtggcaaagctgtgcagttgagcctggctttctgcactccccatctggtgctcattgccttatacagatcatggagcaggtgcttaagtagatatttgagtgaatgagggacaaataagagccatgctaggggttggcccagggagcagtaggagcatcacatctagccttgagagatgcaggaagggtttttgaggaagggtggtttggaaggtatggcaggagttacccactcatggccaaggcctaagcaaaggctgagccactgaaagcacagcgtgagggggttctttgtggagaatggaggtggcaggcagcaaggaatgaggcaggcacttttagaaaggattatcctggctagggacaggagcttgaccatgaggccttctcatgtccctccaggttcaaggatctgggggtctgctgagttctgtggtctatggtgcctgttgggcttggccgactagatgttctagaccaccctgagaggcctggcctgggactaggtcactgccttattgggacaagttgaaatgctgggaataaatgaatagggttcctggcaggctgggggtgggtgctgaggaaccatctggatcgtgtggtcctgcctaaacccttcttcttggcaaagaccatggctaatgtggtcacatcccccaggaggactcaggagaaggccaggcagagtgggtaggggtcaaggaaacaagccttctggggagttgccagccacagtggtaaggaggggccttcctatccccaacaggttaccagcctcccttgggcaatagggtaggaagcggagggggggtggggactggtgcaggaggcatctcgtggccaaccccctttgtgtgacactgcagagtaccaggaatgatgtctgaactctccattcccgaaggctgtggctatagctccatagttccaagcaggacctctgagaaggggctcagcacagctgccaaagctgggcctcaggtgacaggtacttggtgggtcagtcattcagcagcccttcatgagcacatccatgtagcaagccaggtgacagaagtgaatgataaggaagaggctggtgcaggcttgggtaattctgaaatcaaccagtagacaacaagggcatggctaacttggcaaacatttgtgggtcgaccacaccgggctctgggttggatgctggttcagtcctgactacatggaagatccattaagtgaccttaagagtggcttggcttctccatgcctcagtttcctcatctgtaagataggcttggtattagctcctgtgccatagggttgttctaaagattagatgaaagactgtatgtgacagagtctctgataccctgactagcaagaaggatgcctttgaaggagataaggaggcacagacttaatgttatgctttaaggacatcactgcctagattgtacccaaggaaagtaccccgggacgtgggagctaaaggacattagtgttcttggaaggttgacgcgggcagggtgggaggatgcaggctagtgtctggcctcttccttcaaatctctgaagtcttgtcaaggggcatggaaagcagtttttttctctgttgttccagaaggcagcacagtggccagtaggggaggctaaatcgagcagatttctactcatgaggaataagtggccaaaaaaaggcctcaaagggtagtgagttcctatcactggagggttcaagcaggggtcaggtggcattttggcaagaatattagaggggatgcaaacctacgactagcaaatatttacgattccattaaaaaatggaattgttctgattattattttgagtcaaaatttcaaaatgtgggaaagtataagaaattaaaaaatcttttaatctcacaattaagagatagccactgtgtacatttcagtgtcattctttgtaccattttttcctatgtatattatagatgtgagtatgactatctgtataaagctaagagtatgttttatatggttatattccagttacttaatattcttccgggggcattttcccatgttaagtagtccatggaaacacggactttttaatggctacctaatgtcctgtggctgttccgtggcttatttaaccggtttggacgcgtggttctttgcagtctgcactcctaccctggtaattgatgaacatcccttgtgttttcctcctacctggggccagtgtggctttggactcgggggggtcaaggaaggccccttagagagacagcatcttggctgggtttagaaggggggcgggggttaggcacttatggggcaggcgagttactcaggagggcatgctaggcagaaggaatatgggagcagcccttgacacctggtcaggaggagtgggcaaatctgatcttctagctcggttggtaagggcaggacagttgaggagcgtgaaggaaagctgcctctgcagcactcagccccctgccccaaccatcatggagatgttggcatgtacatggcctccgagctgatgattttgcccaacctagaaactaatgcccaccaatcttcctagctaaagccagtacaggcttccatgcacaaggcactctggaagacctgtgagattaaataccagatttttgcgtttggcaacctaaaacacactagaataattcccaatactctctgcctttgagatacaacctttggtgatatattttctgcacatgtacatgtttttaattcttttcctctattgaattcatgggtggctgatgtaggtcccctgagagcctgacgagttcccagatacctaagggctcccatttttgcttcagttggctgttaggcttgggacctgtgcttcatgtcagcactgtgtttcttttttgtcataaaaagggaagaaaagatgaaattttaaattaattgcacagaaacaggctgctatataaatcaagacagtgaaactctggttaggaggggctgccccctgacatctcagggtgcatagatcagccagtgaacagaagtctgagacctgcctggaaaaggagctctaaggggtctcagtatgaaattcatgaatgttcatattcaaaaaataaactcgaagagtgtaagtaccctcccaacgaaaggaagagcctctcagatgaccctagttctggctctgacacctcagggtgtacttgggcttccgtccacacggctggcactcggtcctctgcatcatcctccctcagcactgtgagccgtccccagtgaccaggggagagggccagactgggagcccccactgcagcaggactggcagtggggagggagctcctgctgtcccaccttggcagagaaaaggagcaagagaagatccatccatctttagcagatctaaacccatccattacctgaagacaagccatcctatttgtcttgcaaggtgaatcttaatccctaaaaatagtttatcttgtgtcaccttattttcaaatctgaaccttccagaacatctaggccaaacactgtactatacctaaaacagccatccacatccatgcatccccccaagacaagtgatatgcagtctgacctacttccagatttcctcctctctgcaatggagttttttttcactgagtgtacaatgacctttgtggctttcctcgccattttctactgccccatgtgaccctgcccctgtgccttccttaaggaaatggcctggacatcagaaaagctgttacctttactggattcagtaatgtcccctcctacatttacattcacccagaacctgtaaatgcgacattatttgaaatagggtctttgcaggggccattgagttaaaatgaggtcacattggatgggccctaatccagtgactggtgtcccaacaagaagagggaaatttggacacagacacacagggagaagagcagggaatgaagtgacacatctcccaagccagagaacgaaggattgccagcacccaccaggatctgggagagagggaggtaacagatcctccctcagagcctccagaagagccagctcggctgataccttgaatttacacttctaacttccagaactgtgagagaatacatttctgttgttttcagccaccaagtgcgtggtaatttgttacagcagctttaggaaactttcatatcgcaaggttaattgctccttacccaccctctcacccccagccccaagttgccagcaatcaaaaatgacagcaagaacccagtgcctccctttggaacccatcttggcagcagaagaggcagcactgtaaacaaggaggtgcctggacagggcccattgcttttggacaccagcagctgcatctgtagaggaaagagcactggactgggagtcaagaatggggcctacttctttatattttttattgatatataatattttacatacttctcaggtacatatgatattttgttaggtgcatagactgtgtaatgatcaagtcagggtatttggagtttcatcacctcgagtatttatcatttctatgtgttgggaacgtttcaagtcctctcttctagctattttaaagtatacagttcatggttgctatggaacattagaatgtagtccttccatctggctgtatgtttgtatcgtttgaccagcctttcttcattccccgcaccccacacacacgtccttcccaacctctggtattcatcattctaacaatgggtccacttctgcctcttttgctaactattctcttccccagccttgatttctctgtctgtaccttgactctgggggaggctttcaggttccaagagaggtacctttttcttgttgttgttaatttctttgtatataagtaattcttgaatgcgttgttgctttaaaaatcctaagaattggccaggcgtggtggctcacgcctgtaatccctgcactttgggagactgaggcgggcggatcacctgaggtcaggagtttgagaccagcctgaccaacatggtgaaaccccgtctctactaaaaatacaaaaattagccgggcgtgtggcacgtgcctgtaatctcagctacccaggaggctgaggcaggagaatcgctggaacctgggaggcagaggctgcagcgagccgagatcgcaccactgcacaccactcgctctaggtgacagagcaagactcagtctcaaaaaaaaaaaaaaaaaaaaaaaatcctaataatttaggtaaaatgtaaaatggaagctacccttccttgaccacagtaattttagtccattctctggagatgacaactgttatcagtttgtgcttttctaggtactttttcctatgcatttttttatcattagtaatagttggccgggcatggtggctcacgcctgtaatcccagcactttgggaggctaaggcgggcagatcacctgaggtcaggagttcaagatcagcttggtcaacatggtaaaaccctgtctctactaaaaatacaaaaattagctgggcatggtggcacatgcctgtagtcccagttactggggaggctgaggcaggagaattgcttgaacctgggaggtggacgttgcagtgagccaagaatacaccactgcactccagcctgggtgacagaaaagaaatagtttagtttggatattggtattttaccaaatgcctttccatctttgtacataaaggtctacttcactctcttaaacatatgaatgaaatgacatagtattatgtccctgagtatatccagccagtcctcagtttacagcatttccctactgcaaatggtcctgccctgagcatcctgtgcatcctccttgtcctcactaatgggtacttatttctgttcacagtgctactgtagaattaggagcatgctgcgtgcaacttgggagatggctgagctctgtcattctctgctttcaggcaatcccgccctctcttttacaaccacccttacactgtctgctgaagaacaggggatggtgtggagggctccaggttctcacccaggcctcctgagcaagggaccctcctttcctgctctccagagaagccccctccatgaccagagctaacagctgagtgtgtcaaactgcctctgccctgcccagagcaaacaagccggacaggatcgacagaagatgagatagcaagatgacctcactctgccccttcttccccatccacagcatgtcaaaaccagaagggctcttacgtatcccattgcacaattccatgccatgcagaggagggtacagaagcacagaaaaggaagagtgtccactcaaggtcacacagcaagcagatggcaagctaggaccttggctctggactctcaatttgccattggactgtgagacaggtatccaggcgctcagcctcagatggcaagctaggaccttggctctggccttccagtttgccattggactgggagacaggtatctgggccctcagcctgtctctttccccacccccatccagctactgacaccattttctgtccagctccttcagggtcctgcctgccaggctgacccaaatgctagaaataatgtctagtgcttttgccagctccaggccctctgaggcaaccagaactagcagacaccctgggaagctgatatgggacaagaaaacgggagccctagggaggaagaaaataaataaggtgtattagaaaggctttctctaggcctcagtgtcatcgtctgtgaagtgaggccttgcactcaaggcccttctgatgcttgtctgctgtggtctggctcaccaggtgcaggggtatttaagaaggaagtggtcctttgctcccctgagacacctcatcagttggtcagataggagcagtggagaccacatccgcccctgacttgtgtgctctgggggtcctgcaggtgttcagagcataggccgtgtccccggtgcagcggagtggtgcagcctggcacttctaactttaagttggttgtacaatcacattggactgtcctccagccagtgaggaaatgttgaccacacactatatgatatgaaggggatgaattaaatctttaatgtccctggcagtgtttgagtttcaatgacatcaaattcaggcattactttggcagaatatctctgcccatcttagagatggggaggctaaggcctgtatttatggtgttctgtctgagcttctgtaattcgggtgtgaacactaacatttctcaacagccctgatcatttaggccccgcccttcctccccgaaggccctggagtggggccccttgggccacactccccgcctccttcctgcctctaccctcggccaataggctctgactgtggttacttagatcccagcactagtggtgctgggccagacaccggaaaggcagctctgatattgaggagggtgtgacctgagccccttgagacttagaatcacctctcccctacaggctcagctactcagataaagctgaccctggcatcagggggacggaaaggactctagcctcagctgtgagtctggattctccccagggctctgcttccctgctttgcagcttctgacaagttatctgcccacccacctctgggcctcagcttttctatctggaaaaaggaggtggggattggagtcagctgcctcctggggcccttccaaccctgctctgggttcccgtaagccttcctcagccaggataggtgtgatagaactacatgctcagaggaagccaggcctgtgatgtatgggacacggaggagctgggtgaactcttaaggagtcttctttaattactaaattctctaagttaagcaggaacaatgaggacacaaagcacttaatcagaaatacacaagccttgaaggctgacaaacagaatggagtgatggctcccaaagagggctagctcaagtctctgcaggacaggctgaacctccctcagggctactcttaccttccatcctactaggattcccaaggtagggaatagctgggcggcttctatccaagttgcttctgcctaattcactcttgcctggtgaggctcagaatttgagggtagttggccgggcatggtggctcacgcctataatcccagcactttgggaggccgaggcgggtggatcactaggtcaggagattgagaccatcctggctaacatggtgaaaccccatcttcacaaaaaatacaaaaaaaaaaaaatagccggacatggtggtgggcacctgtagtcccagctactcaggaggctgagacaggagaatggcgtgaacccaggaggcagagcttgcagtgagccgagatcacgccactgcactctagcctgggcaactgagcaagactccgtctcaaaaaataaaaaataaaaaataatttgagggaagtttaggggtctatcccaaaggcttgagtatgtgactacagccattcaccccaaaatgctgctccctgaatagcattcaacagagctccctgaggttccattaatgctggtggtctttacatgccatgtagtagataatttctttatgcttaccagaggctttcacttgccgaacatcagtgatgctttttagaattatagactgttagagttcagggttctaaaagatcaccagtccaatctacagcatgaagtttgactctccaacctcttcttgcatgctactaatgatggagcgctcacttccaccacgattccccaccctccaatgaggcagcctaccagtttgtgatggttctgaaatttttcttcatactgaactgaaacttctggaacctcctcatgcttggccacaatcctgtcctccaaggctgtagatgacacgccagcagcttctacccatgacattcctgctgagatttgaagacaatatcaggtcttcctgcctgttctcaaggctgaccaactcttgttctgttaacagcccctcctataatttggttttgagccacctcctacatcctgtcggtttctttgggacgtcttccagtgtgtcagtttaccctctaaaatgagagtatactctagagcatctcaccagccccaatctgagctcatgtggctctccatggctctggacactgtcttctcattctaccctgactctgtctgcttttgacagctgtgtcctactatctcaggtttgcttcaggttgaacctactgcagggctctggtctgcttgacagcaaggatctaggccccaaagctgtgagtgtcacctgggtataggggctctatttccagccttcttaggagaagggctgccctggagctcaggaggactgaagagagcatctgttccagccctgacccttcacagatggggaaactgagaaggaacatgacttacctaaaggcacacagtaaagctggaattgagtctcctggcctcaaccccaggcctgggttctccctgcatcctgtactgccggcagcctcctctgcagctttcttgctaccaagtttccgttgactcaggaagctgtcatccctcttccagagtgtagtccggataccccaccccagccctatgctccccacccctcttttggaagggaaaattcttatgtccccctcccaactcccccccccaccaccaccacccacgcacacactgcaggtgccgtctgctccatgacctctgaggaggaagtggtcaggaccccaacctggggattttccactcagtagttgcttgttgagacctacctagctcagggtcacatgtcctcaggcttttgtgtgcactaggatcatctggctagactgctaaagatggagattccggccaggcgtggtggctaatgcctgtaatctcagcactttgggaggctgaggtgggtggatcacttgaagtcaggagtttgagacctgcctggccaacatggtgaaaccccgtctctactaaaaatacaaaaattagcctggtgtggtggtatgtgcctgtaatcccagctactctggaggctgaggcaggagaattgcttgagcctgggaggcagaggttgcaattgagccaagatcgtgccactgcactccagcctgggcaacagagccagactccatctcaaaaaaaaaaaaaaaaaaaaaagcagatgcaaattcccagcacacatactgtaggtctagaatgcagcctggacattcgtgttaagcaagctttccaggtggctctagtacaggaggtccatagaccacattcctaagaaatactgttctgggcatcataacatactggggcaagtccaatacagatttcaaaatcctgtccttcaggagccctttgggctagcaggagagacagacagctaaccagatgtagatactctcaggggtgcctggaacatggagaaaacaggaactaactccgccccagggcaggtcaggagagaagcagagaaatggtgtgtgcactgagcctgggggcccgaggtagacctaaccacgcgtcacggtgggatggtcttgagcatgtaagatgtctcgaacatacagatgcctgtgttgggggcaggcatgtaataggtagcactaggttattttagttgggttttgacctagcaaatttgccaacatttttttaaaaagtgataatattccacattggcaaggttgcagtgaaactggtctttttcttttttcttgagacagtcttgctctgtcacccagggtggagtgcagtggcccaatctcagttcactgcaacctccgcctcccaggttcaaacaaatctcgtgcctcagcatcccaagtagctgagattacaggcacgtgccaccacacctggctaatttttgtatttttagtagagatggggttttgtcatgttggccaggctggtctcaaactcctggcttcaagtgatcctcccgcctcggcctcctaaagtgctaggattacaggtgtgagctaccacacctagctgaaactgatcttcttgcgtgccatttgaaggtgagtaaattggtcgaaccttccaatattagacatgtaatattagatgtgtataaaattttacaaatcaatatgtttattttttaattttaattttaattttttattttttgggacagggtctcactctgtcgcccagactggagtgcagtggtgcgatcttggctcactgcaacctccacctcctgggttcaagcaattctcctgcctcagcttcccaagtagctggggttagaggcgcatgccactaccgcctggctaatttttgtatttttagtagagacggggtttcacaggttggccaggctagtctcgaactcctgacctcaaatgatccacccacctctgcctcccaaagtgctaggattataggcatgagccaccgcacctggcctaaatcaatatatttattaaagcaaattaacctgcaaattaaaaagtggaaacaatttaaacactcaacagtgaatgactaaattcatccatagggatgttctgctcatcattaaaattaacacatttgcagaatagttaatgctgtgtagtaagtgctcgtaatatatttgaaaaagtaagatatgaggaagtatatgtaatatcattgcatatgtatatgtagatgaacaatatatgccaccaggttatggggttctctctgggtcgtgagattttctttctatattttcatgtattttctgtactttctacaacaaatgcctactagtactttaactggaagaagatgtttataaataatttaagtattaagaaattgaggctgggtaccttggctcatgcctgtaatcccagtactttggaaggccaaggcaggcaaatcacttgagcctaggagtccgagaccatcctgagcagcatggcaaaattccatctctaccaaaaatacaaaaattagccaggtgtggtagcacacgcctgtagtcccagctacttgggaggctgaggcaggagaattgcttgagcctgggaggcggaggttgcagtgagccctgatcacaccactgcactccagcctgggcaacagagcaagaccccatctcaaaaaaaaaaagacagaagaaaaagaaagaaattggaatgggggtagactggggacagatggtgatagccttaactgccattctgaaggagttatcttgttttgtcaagagctggggactcaagtacaaggccacgtgctgcctgtggtctgaaagctgtttgtggaaaagagttctccaccattctctggtggtggttatctgaaagaaggcagcatttcatgagattatgaacttatttcagatgacaaaactgagacccaggggcagcccaagaggtctgccaaagcagatgacgtgggatctttgttcttgccatgtttgtgaaacatggcaatcgtcttatgcaatatttgagctcttagtatgtgcaagacactgcagttgcattatttcatctcatcctaaaagagcctcatgagaaatccgaggcatggagaggtcatacagtcacacggtgttggatttagtatttgaacccagatctgtgtgattctagaattctggagttcttaaccactctgctctgcagtctctgatattctcacacctggttctaatgctgatttgaacattatggcacagtgtgacagtgtcttaagtctccctgagcctcagtttcctcgcctgtagtgacctttacctcacagtgctgttgagaggagctgagatgagagcttagagtttgaacactatgggatcatccagttaaaccaccagacgtcctcatccccacctcacagaggaggaagcagaagccagagtgggaagggatttgcccaagtttgtaacagagctggcactagaatctaggccttctggctcccataaaaacattgtctgagttcagctaatcagtcgtggcaacaaggaagagacaaccatttatgtttatctcccttcttcctccagcccagggtggggaggctggctgctgtcacttccccagattccggagttgacagcttctctgagtcgtgcctggaccaggcttcctcctcttccctggaaagggaggattgagtcttcaccagggtggtgggggagctaaattgtcaggtctgcccagccactcagcagatttggggcacgaggacctgggggaggccccatgactccctcagtcctccaggggcttacacatgccaggctctgtgcccagcaccatgggggagaagcaggctattctagaagacttcccttgatacatcttccctccccagtgagaagcatgctttctagaagtatttcagtggttcttcagtttaggacatttttaataatttttgtcgaacattttcatagcctcttcatagtttgacttgtgtttttgtttgtttgttttttgagacagagtctcactctattgcacaggctggagtgcagtggcgagatcttggctcactgcaacttccacctcctgggttcaagcaattctcatgcctcagcctcctgagtagttgggattacaggtgtgcgccaccacacctgcctaatttttgtatttttattagagaggggtttttgccatgttggtcaggttgatctcgaactcctgactgcaaatgatttgcccacttcggcctcccagagtgccaagattataggcatgagccactgtgcccaggcctgacttgttttttaaagtgtttcttaaaattgaatctagaacatcttcttccttccttccttttttccttcctttctgccctttcccttccttctctctttctttctcttctttgtaagagaagagaaaagcatacaaaagggcttaaattttttttacccaaatcctggtctggtgaccaccgccagacttcaaccaacttttcacctctccagcatgagatgagaaaatgatggtgtgagcgagtgtgtaatgttcagtaagcacgtcagttctcctttcctggaagactgttcttaagcttttccttactatattttggaagactaaaatgtcctttattttatataatgatagtaataatctataaatagttaggccgggtacagtggctcatgcctgtaatcccagcactttgggaggccaaggtgggtggatcatgaggtcaggagatcgagaccatcctggccaacacggtgaaactccatctctactaaaaatacaaaaaattagccgggcgtggtggcgggcgcctgtagtcccagctactcgagaggctgaggcaggagaatggcgtgaacccaggaggcggagcttgcagtgagctgagattgcgccactgcactccagcctgggtgacagagcgagactccatctaaaataataataataataataatctacaaatagtttttttcagcatcctcatcagcccatatcaactctcccattaaaaaatattactcatttggccaggtacagtggctcaggcctctaatcccagcactttgggatgccaaggtgggcagatcacttgaggccaggagttaaaaccagcctggccaacatggcgaaaccccatctctactaaaaatacaaaaattagccaggtgtggtggcacatgcctgtagtctcagccactctggaggctgaggatcacttgaacccaggaggtggaggttgcagtgagccagaatcacgcaattgcactccagcctgggcaacagagcaagactctgtctcaaaaagtaaaaaaaggtcgagtgcggtggctcacacctgtaatcccagcactttgggaggctgaggcgggtagatcacaaggtcaggagattgagaccatcctggctaacacagtgccaccccatctctactaaaaatacaagaaattagccgggcatggtggcatgcacctgtagtcccagctactcaggaggctgaggcaggagaatcacttgaacccaggaggtggaggttacagtgagccgagatcgtgccactgtactccaggctgagaggtggaggttgcagtgagccgagatcacaccaccgcactccagcctgggcgacagagcaagactcagtctcaaaataaatacattaattagttaattaattaaattttttaaaaattactcatttatgaaatctgggagccactgacactgctttgtgatgcagaaagcccttttgtattacttattcctcttagaggtttgggactttcacccccacccgacaacctctggggaggggagagggactagaatgtcaaattgatcaccaatggtcaatagtttaatcaatcatgcctacataatgaagcctccatgaaaaacccgagaggattgggtttggagagcttccgcatagctgaacacatggaggttcctggatggtagcccccaaggagggcatggaagctccctccctttctcccataccttgtcctatgcagctcatcatctgcatccttcgtactatcctttacaataaaccagtcattataagtaagtgttttcccaagttctgtgagccactccagcaaattaatcaaacccaaagaggaggtcaaggaaacctcaacttgaagcccatctgtcaaaagttctggaggcccagacttgtgacactatctccaggtagatagtgtcagaattgaattagaggacacccagctgatgtctgctgcagcactgatggggagagcccctcccacacacacagaagtcttcttctgtgtggatgattattgtggtgtgagagcagagaaaaaatggtttgagttttctccaagcaaaaatcatctccgaattgggggttgggaggtttctagggcacctcaagtgcatagctggagtgagggtaatagcaggtccggccagatcccgggagaagaaagaggtggtctgagaggcccccagggatggcagcaggagccagactgcaaggatctagggacaggtcaagcagtgtcaaactcccctgagggtttccctgacagggatgagaagtcctgttctggggcccctcccccggtagagggtctgctgcctggggctgcgaggcagcccaatgcgcaggcgtggggcagggtctggtgtaactgaaggtcctgccttgcctttggaagagtcccactatagcagcccgtcctcgcattgacctcccaccctctacccacgccttgctgttgtctcatttcttccagaagcgccaagaaccagaaccagaacagccacccagaccagagccccatgaattaggtcccctcaatggggacacaggtgagtagccagccccacaaaggccccaactgccatctgtgaggttcctaccttataatcaacacagatgatacagctgctgaaatatctcatgagatctcagataggttaccttaataggagtatcgtgtctaaaatcagggaggtaattaatagtcctgacctgtgcttccctattctaggctgttgataccacacctagagtgctatatatgtttctggaaaatacatttttagaggaatccagaaaaaaattggagggagtacaatggaacaagatcagactggtgaagaatctggaaaacatgtcctataaggaacagttaaaggaacagagaatgttcatctggaaagaagatgtcaccatagggagggagggagggagggagggatgggagcaagagttgaaaaactgttgggtactatgcttagtacctgggtgacaggatcatttgtacccaaaactcagcatcacccaatatacccaggtaatgaatctgcatgcgtacccctaaatctaaacaaaagttgaaaaagaaaaatatatacatatatataaaataagttaaaatcaattttaatttgtaatggatcatgtgggaaccttctaacttgaatatctaattttctttttcaaatgagtagagctaaatacaatgaaataatatttgttttcttttctttgaaatgtccatggtacgaaaataaaaattactacatccagaaaaaaaatatatgttgccataaaacaacagttttctccacatgtctgaagtgtcctaatggagaagaaagatgagccttgtttagtgtgatacagaggtcagtattaaggcctcagggtagcagcaacatgcaggcagaattcaacacaatctcaaagaattttttgtgtggttgttgatttaaaatcatcagagctacctggtaataggaggagctccctatctctgaacgtgtttagttacagcctagaggctgttgggaatattgtgggtgaagttcaagtaccgcataagtaattggaccacaaaatccaatctgattatatataagaattatccaggccaggtgcggtggctcttgcctataatcccagcactttgggaggccaaggtggatggaatgcttgagcccaagagttcaagatcagactgggcaatatggtgaaaccccgtctctaccaaaaatacacacacaaaaaactagcctggagtggcggtgtgcctgtagtcccagctacttgggaagctgaagagggaggatcacctgagccaaggaggttgaggctgtggtgagctgtgatcacaccactgcactccaacctgggcaacagagcaagaccctgtctcagaaaaagaaaaattacctggagaacttcaaagatgcagattctagggacctaccacagaccaactaaataaaaatctcagatttgtattatatatatatagtatatatattttatttattagtatatatactatatatacgatatatattttatatatatactatatatacgatatatattttatatatatactatatatgatatatattttatatatatactatatatacgatatatattatatatactatatatattttatttattagtatatatatactatatagattttattagtatatattatatatactatatagattttattagtatatataatatatatactatatatattttattatatatactattttttatatatactaaatatgcagaagctgcatatttagtacatatatataactaaatatatatatttactaatatataaatatatatatttactatatattaaatatgtatatttactaaatatatatatatttattttttatttttatttttatttttttgagacggagtttcactcttgttgccaggctggagtgtagtggcaggatcttgactcactgcaacctccgcctcccaggttcaagcaattctcctgcttcagcctcccgagtagctgggattacaggcgcctgccaccatgcccacctaaatttttttgtatttttggtagagacggggcttcaccatggccaggctggtctcgaactcctgaccttaagtgatctgctcacctcggcctcccaaagtgctgggattacaggtgtgagccatcgcgcctggcctacatttccttttgtgcacaagcaagcaggataaggtggtagttaggagtatttgctgtggaaacagattgtgtaggttcatatccctgctcccttaattttgaactgggtgactttgaacaagttgcatgactcctctgagcctcagcttcctcgtctgtagcatgggggtaataatattactcacgactatagggtagctgtgaggagcaggtgagtcatccctctgaggcacttggaacagtgctggacatgttgcaggcatggtaagctctcagtcctcctatcctgcttttactatttttattgccattgtttcctgatttaatcatctcagcctcactcatgtggtaggtgccataattatcctgatcccatgtattaggtaactgaggcacagagaggatggccactgccttaggtcatacctagtatctgatagactcagtgtggcattggcaggtcctgttttggagtttcccgaagcaggggctagacttcctgtttgtgtttccttcctgctctcaagtagcaccctctactaccagctgaggagacgctaaaggtgaggggccacaaactcagatgctcatgggccccagcaggtaaagcaaatgacatgtggccctttgtatacatttttaataacagcaggaggtgaagactatagccaactgcagagccctatcctggccggccaaagaggaggcagctgcttctggctccagcccctggttgacatgaaggcatacattgccagttcttctttggattcttcaagaaaaattggaaatcagaattattaagtaaaagcttcccagttattaagtatcaacaactaatttttaaattattattattattttagagacaggatctcgctctgttgcgcagactggagtgcagtgatgcagtcatagcttactgcagccttgaactcctgtgctcaaaccatcctcctgctttggtctccctagtagctgggactgcaggtgcatgccatcatgcccagcttttttttttttttttttttttttagagatagggtctcactatgtttcctagtctggtctccaactcctggtctcaagtgctcctcccacctcagcctcccaaagtgctgggactacaggtgtgagccaccatgtctggccagcgactaattttttaaaaaatggggtagaacagggagaccagaggacaaaatgagaccattggcttattccttgaaagaggatctccaagtccaaagagactcgaggggctgtctctggagactggtcccactcgaaatcattcttgaggcagagaccagaagacaaaatgagaccattggcttattccttgaaagaggatctccaagtccaaagagactcgaggggctgtctctggagactggtcccacccgaaatcattcttgaggcagagaccagggttctcatcccttagccccatttcccacactctctctgccagctctgactgtacttccactctgtgagtttttttatttttatttttttgctttttcatctctagctataactgtccagctctgtgcatcagaggaggctgagcggcaccagaaggatataaccagaattctccagcaacatgaggaggaaaagaagaaatgggcacaacaggtaagtccaggtgcccccaccccctgtctttctcctgctcagctaactttggtgaatcccagagtgagtgcctaccttaggtttttgttgctgttgtaagagtcccttactcattttaccaggaagggagtcctttatctgttgaacacatatttttatcagggcactgtgtgctgggcacattggttaaaacaagcagagctggcagctgctttcacgaagctgagagtctatttgggaagagtaaaagctgttgatgccactagattaattgcctttctgggcccacctcatggttgggtgggaccacggaactcgttctggctgatgcgttatagaaagaagaaccagtgtcacttctagggcaagcatttagttgccagttcaagaccctcaaggtctttctgtctagctaagtgacgggactgttgtaatggccgctctatcagcctgatctctgggtgattatccctggataatcctggataatccctggcagcagagctccctgccacacaaaatgggtaggtagtgagggcaaaataaacattttgtcttaagccactgagactttgtcattgtttgttatggcagcataatttagcttatatgactgagatgggacatcagatgctaaacacaattacacagaaatacttactgcaaatataagtgctatgaaaagtttacagtgccgtgaaaggacataatagaacccttaaccaaggctgtgggatcagagaaggcttctctaaagggatgacacggaggctttaaaattacccagaaatgaaaattgagggacattctacagaatttccagcctatattagtcaaatgtcaaggccatgaaacatgaggaaagactggggaacaattctagattgaaggacactaaagtgatgggatgactgaatgtaacctgcagcccaggatttccttttcctcattctaacttggtcactcacccttcacctctctttgcctccatttcttcctttaccagagggaatgggtagagcagcaggaaagatttggtggtgtacacaagttttctctaaattttctttagtttaaattataaatatgaaatatgttcagggtaaatattcaaaattctgaaatttaaagtcactgctttaagatagatctgggccaggcatgcctataatcctagcactttgggaggccgaggcaggcagatcacctgacgtcaggagttcgagaacagcctgggcaacatggcgagaccaccgtctctacaaaaatacaaaaattagcccagcctggtggcacatgcctgtaatcccagctacttgggaagctgaggcaggagaatcacttgaacctgggaggcagaggttgcagtgagctgagatctcaccactgcactcttgcctgggtggcagagcaagaatccatctcaaaaaaaaaaaaagtctccgtagttataaactaatcactctattaaatcacatggttatttattactgaaagattttctgctagattttattcacccagtcgacttgctgggggagattactatgtgcggggagggtgcggcctcagcactgccaggggtacagggagaaatcgggtccagaccctgccctcaggtgttcgctgggtggaaggctgtggcaagtgcccccacacacattaaaatggttttagcttagacgcatttttcagaaacacaccttttatgaaaggtaagttaactgtatgcagctgctggtctttagtttgttttggtagagttaccatggtaatgtcatttggccctgaccattacctgtggaatccttaaccttgagacttgtaagggccccaggtattgtcaagttgagtcccttcattatacagtggagggagctcattacccaggaactcagtggtatgctggggctagaatgcctaatttaagtcatgccttgcctctggatatgccccatcagctgtaccttacaggtggcaaagggactggaaaacatctcaagtgggggacaatgagaatggctgggagggttcagcctggggaagagaaatgttgggaatatgggccactatgctcagatctctgaggggctgcctgggttgagggaacagtctggctctgtgtgaccccagagggcagatctgggacctgatggtagaagttggaggtcacttgaaacagtaagccttacgcaagcagagaaacaccatgggaggcttcctgccttgaggaagcatcaggattagaatactcctaaatccttttccatgtggataattacatgggaaccccctgctaaaccctaaagaaggcaaattctgccacgcttgctgtgtcttggaagtcttgtgtcctttctgggcgtgtcattcccatccctcagaggaagggttaggactctggtcaccaagttccacgtaggcccaggtgaggggataagagatgctgtgctgatcctgctcaatctcagtcctgcccgggactctctgcccccaggtggagaaggaaagggagctagagcttcgagacagactggatgagcagcaaagggtcctggaaggaaagaatgaagaggccctgcaaggtaagggtagagatgttccactggccaaggtggtggggggtgcttccttctggccccacctgcccagttcacctgggcactcccactgttccctccctgtctgtctgatccacaagcaattgactcaaatctacaggatccttggccctagagggttgatggacttttcctttggggcatggatttaagaggctggcatcaacctttctttttccttatttgagaggtatttttttctttccatttaaaaagcaatccatatttattaagggaaatttggaaaacccagacaaatagaagaatttttaaatacacatattccatccccacgatgatggtagctcttatttattgttagattgattattttgaaaaatgactttctttcctcttatatcaccaaaggtgatcatcacagaaaatttggaaactgtagattagacaaaaagatcttacagcacagtggttaacgtctcattcttggctgggcattgtggctcacgcctgtattcctggcactttgagagtccaaggtggatagattgcttgagcccaggagttcaagactaacctgggcaacatagcaagatgctgtcactattaaaaataaatagatagatagatagatatcaaactttccagtttggtaagatagatagatagatagatagatagatagatagatagatagatagatagatagatcaatctcattctctagagctccagtccctgggtctaaacttcagccccactgcttaccagctctgtaaccttgaagaagttactttacctccctaataggttgtttgtaagaattaaacaatttaatgatagatagaccgagatagaatttagaacagtgcaagttacttagcaataattcttagcactgattttattattgagaaaatttaaatcataattccacccagagttagccactgttacccctttgaaatagattccttccatttctttttctgtaatatacatagaatatacatctatacacacacactttggggtgaggaagtgaattattttttccactttgtgttgcattagcatcctgtcattaaactcttctataccaagagttttagtaactacatagcattccaatatgcacccttgttcatttaactgagtccctttgttaggcatttaggtaatttcaagatttttctcattgtctataacagcaatgatacttacataatcaaccccggttttataacatctttgtcacattcatgatttcagcattagaataacatcctaatagaattggtgtggtaaagtttatgtatatctattttttattttggtaaaatagacataagatttaccattagtgacatttaatacattcacagtgccatcaccccaaaaggaaactcccacccaccgagcaggcactttttttgtttgttttgtttttgttttttttgttttgtttgtttgtttgtttgagacagggtctcgctctgttgcccaggctggagtacagtggcacgatctcggctcacttcaacctccgcctcttgggctcaagcagtccttgcccctcagccttctgagtagctacaggcgcgtgccaccatgcccagctaatttttatatttttttgtagagatggggttttgccatgtttcccaggcagatctcaaactcctgggctcaagtgatccgcccacctcggcctcccaaagtgctgggattacaggcatgagccattgtgcccagcctaagcagtcacttcttatcttaccactagcccctggcaaccaccaatccactgtctgtctctatggccttgtccattctggacacgcatataaacgggattgtataacccacatgatcacccacatctgacttctttcaccttggaatgttttcaccttgaaatgtttccagggctcatctgtgttgcagcatgcatctacactttgtttctttttacggctgggtaatttgccattgcacagacacaccacactctacccattcatcatcagttgatggacacctaggctgcctccaccatttagccactgtaaatagtgccactagtacaggcacctacttgaacagctgttttcagttccccctgggtgtacacccaggagaattgctgggtcatacgatcattctgtgcttaactttttgaacaactgccaaactgttttccacaggggctgtaccactttatgttcccatcagcaacccacaagagttccaatggtggcacatccttttcaacacttgttattttctgcaacacctgttgctatcctagtgcacataaagtggtttcgcattgtggttgtgatttgcatttccctaatgcctaattctgttgagcatcttttcatgtgcttcttggtgacttgtgtatcttctctggagaaggttatgtatattactgatgttactgaaattgaccttgaaaatgctttactgatttttcctttcatcatgagtattcgcatggcctttccccagaattatttatcttcttaaaacatggctgtggctgggtgcagtggctcacacctgtaataccagcactttgggaggccgaggcgggtgtatcacaaggtcaggagttcgagaccagcctggccaacatgatgaaaccccgtctctactaaaaaataaaattagtctggtgtggtggtgtgcacctataatcccagctactcaggatactgaggaggctgaggcaggagaattgcttgaacccgggaggcagaggttgcagtgagccaagatctcaccactgtactccagcctgggtgacagagcaagactccatctaaaaaacaaaacaaaacaacaaaacacatggttgtgattattttgtacgtaaaagtgtatatcctgttcttttcatttaacattgtatcaaatatgtttccaagtaattatgctgctactaaaatgtttataaaggcaagaccgtaaagtacatggctttccttatttcttgtgagtctagacctctagatctcaaaacagcttttgcataatgttgccggtatttcacattatgtccttagatttacccagatggaataactagaacagaggtctgaatgattttaagaatcttgaaacatattgcaacattagcacacattattgcaaacattgtgaaatggaattaaagtccttgcctggaaattgaagaattgtggttttgtgggtgtgggtgtgtgtgggtgtgtgtgtgggtgtgagtgtgcgtgtttttttttttttttttttttgagatggagtctcactctgtcccccaggctggagtgcagtggcatgatctcggttcactgtaacctccgcctcccgggttcaagtgattcttctgcctcagcctcccgagtagctgggattacaggcacctgcaaccacgcctggctaatttttgtatttttagtagagacagggtttcaccatgttggccaggctggtcccgaattcctgacctcataatccgcctgcctcggcctcctaaagtgctgagattacaggcgtgagccacctcgcccagccgaagaattgtgttttaataataccataccctgttgaactggggctatcactcaacctccttgaatcttggttcagtttctctatctctaaaatctaccttctgtacctcacaagactttatgggaaaacaactttattctccaagcattgctttgatattatttttagcgttacaaatatattaataagaagaatttcctactgtaacacccaggggagaagagattgcctgtcttgagtttttcccattagtcagaattcttctatagttatttttaaattgtttggcacatactaagtgctacataagtctataatgaatgaatgaaagcacaggatggtggaaatatatgacattttatatgtatggggagaggtacacagataaccaggagagactagtggtgattttccacattcgatgaccctttgctgtcttttttttattttttaaattatcatatagtaaaattgactctttttgaggggatgtgcattttcataaattctaatgcatgtatagattcttttttttttttttttttttgagatggaggctcgccctgtcacccaggctggagtgcagtggcgtgatctcggctcactgcaacctccgcctcccgggttcaagcaattctttgcctgagcctcccgagtaactgggattacaggcacgtgccactatgcccagctaatttttgtatttttagtagagacagtgtttcaccatcttggtcaggctggtcttcaactcctgacctcgtgatccacccgccttggcctcccaaagtactgggattacaggtgtaagccaccgcgccctgccgcatgtatagattcttgtaaccatcgccacaatcaggatacacaacagttttatcactcccaaaaagccgtctcaaaatacccttgtattcacatccttctcccaccctaacccctggcaattactgatctgttctccatctctgtagctttgtcttttctaggctattacataaatgaaataatacaatatgattttttatattggcttccttcatgcatcacgatgcctttgacattcattccaattgttgcatatctcaataattcatacattttcattgtggagttatattccattgtttactcattcactgttgcaggacatttgaggcaattatgaatagagctgttctaacattcatgtgcaggctttgtgtggacataggttttcatttatcttgggtgaatacacaggagtgggataggtcatatgataaatgtatgtttagctttatgagaaacagctaaactgtcttccagagtgaccactattttatatcaccatctgtgatgtatgagttataccgttgctacttcatgccaatacttgctgtcactggttttttattttagctgttctaataggtgtgcagtaatcttcaccataggtttaatttacatttcaataacaactcatgtgcttatttgctgtctacatatcctctttggtcaaatgtgtgttcaggtctttttcccatttaaattaacttgcttgtccttactgtggagttttgagatatctttatatattttggacaagagttctttgtatttgcacatattttctcctagccagtggggtgatttttttcattctgttaataatgtctttcacaaagccaagcttttaattttgataaagtccaatttatttttttctttgattatacttcttatgtcatgtctgtgaactctttgctaaaccccaggtaacaaagattttcttcaatgttttcttccaaagccttatggttttatatttagatctaagatccatataatcatgtggtctttctttctctctctctttcttctttcttcctcttttttccctctcctctcctctcctgtcttcttttttcttttcttttctttccaacaggatgtcactctgatgcccaggctggagtgcagtggtgctatcttggttcactgcagcctccacctctggggctcaggtgatcctcccactacagcctcccaagtagttgggactatagtgcacatcaccatgcctagctaatttttttttttttttttttttttttgtagaaatgagtttttgccatgttgcccagcctggtctcaaactcaaatgaaccactggcctttccctcccaaagtgctgggattgcaggtgtgagccaccgcatctggcctggtttttctttagatggttaatatagtggattacatttgtttgagttttcaaatatagttatccctaggtatccatggggaattgattctcggacccactttggataccaaaatctgcaaatgctccagtcacttatataaaatggcgtattatttgcatataacctatgtacatccttccatacattttaaatcatctctagattccttataatacctaatacaatgtaaaagtaaggtgaatagttgttagactgtatttttatttgtattatcttttattgttgtttggtattttttatttttattttttcaaattttttttatccacacttggttgaatctgaggatgggaaacctgcaaatacagaaggctgactgcattgaactagccttgcattcctggcataagctccacttggttgtgttatattactctttttatgtattgctgaatttgatcctctaatgttttactgagaatgtttgtgtctatgttcatgaggaatattggcctgtagttttcttacactatctggttttagtatcaggataaagcttgccccatgtagtaatgtcccctcatcttctctttctgggagagattatatagaattggtgttatatcgtttttaaatgtttaatcgaatttttcaatgaaataatctgtgcttgggcatgtctttcaaagtgtttaacaacaaattcaatttctttttaatatttaaaggaatttcaggttatatacttcaccttgggtgagttttggtcattttttttttttgaagaattgttacattcatctaagttgttgaatctaggtgcataggattgttcagcatatttccttaatatcatttcatatatctgctgtgtctgtagtgatatttcattcctgatattggtcatgtgtatgttctctcttttctttgtcagtcttgcttgaggttatcaattttattaattatttcaaagaaccagcttttggtttcattgatttccccacccaccccccttattttaccattttccatctcactggtttctgttattttcatttccttccttctgtgtgcttgctttatatttggttagcttttttttttttttatttcttttcattctttttttttttttttttttcctgagacagggttttgctctgtctcccaggctggagtacagtgtcatgatcatagctcagggcagcctcaaactcctggaatcaagcaatcttcccacctcagcctcctgagtagttgagactataggtaccccaccacacctagccagctaatttttaaatttttaacagaggcaggtctctctatgttacccaggctggtctcaaattcctggtctcagcagtcctcctgactccgcctctcaaagtgctgggattacaggtgtgagtcactgggcctgataccttttcctgatttcttcagcttagaatattgatttgagacctttctccttttctaatataaacatttaagctataaattttctcctaaactctgctttacctgcatcctacatattgatggttttattttcattttgttgagttcaaaatattttcagtcttattttccttgagacttcctctctggcattgaatatgtggaagtgcatttccaagtgttgggagattttctggttctctttctgttatttgatttccagtttgattgcattacagtcagagaacatagtttgtattttgctgcttttatagtttgttaaggtttgtttcatgactcagggtatggtcgatcttgtttcatgtatacttgaaaggaatgtgtattctgctattgttgggttgagtattttagatataaatcaattagataaagtttggttaatgttagtattcagttctatattcttgctgattttcaggctgttttatgtggaatgctgaggagtgttgaagtctccaattataatgcatatttgtctatgtctcctttcagttctttatctgcaaatcatatagctactatgactttcttttgattagtgtttctttttccacccttttacttattacctacctataacatctatttacagtgggtttcttgtaaatagcacgtagttagttggtgggtggtttttttttttaatttcaactttaattttagattcaggacacacatgcaggtttgttacacgggtatagtacatgatgctgaggtttggggtatgaatgatcccatcaggtgggtttttaaaaacccattctgacatactctgtgttttatttggtatgtttaagccatttaatttactgttgttattgataatgttgatgttcataatgttgggttgaagtctaccattttaggatgtgttttctgtttgttctcgctgatctttatcctctgttttccctttcctgctttttttttgagtatttgaacattttttagtgttccattttaacttatttattgtctttcttactgtatctctgtattttttttaatggttactctaagaattacaatatacttaacaatctacttagagttccttttttttttttttttttttgagacagagtcttgctctgtcacccaggctggagtgcaatggcatgagctgggctcattgcaaactctgcctcctgggttcaagcgattctcctacctcagcctcccaagtagctgaaattacaggcacccaccaccaggcccagccaatttttgtattttgggtagagaccgggtttcaccatgttggccagtctggtctggaactcctgacctcagatgatccacccaccttggcctcccaaaatgcagggattacaagtgtgagccaccacgcccggcctgaaattgctattttaccacatctaatggaatgtaaaaagcttaccgtcatgtaggttcctctgttctctcccatttttgttacatttatctcatgtattacatctacatacatctaatgccccatcagacaaggttataatttttgcatttaatcatcaatcatattttaaagagctcaagggaagaacagtctattgtatttacttaggtctttaccagttctgttactcttcctacattcttgaagtttcaagtttcaagtttccctctggtttcatttgaagaatttcctttagcaattcttttagagcaggtttgctggtgatgaattctaagtgtccttcatctgagaatgtctcgatttaatcttctttcctgaaggatattttcactgcatatgggattctgggctttttgttatggttttgtactccaaaagaaagcaggaaagagaaaacagaggataaagatcagcgagaacaaacagaaaacacatcctaaaatggtagacctcaacccaacattatgaacatcaacattttccagcagtttttaaatttttttcttctggtctctaaggtttctaatgagaaacacacagttattcaagctgttgttccctatatgtagtgtaccatttttatctggttccattctacaccttttctgtgtcattagcttttggaaatgatgttgtctgggtgtggatttctttgggcttactttggagttcagtgatcttctttaatctgtaggtttatgttttggcaagtttgtggaatattcaatcattctttcttcaattttttttttttgcactgcaccctttttcctctaattctttgactgtgatgatagtaatgttagctatttgggcattatcttacaggtctctgaagctccgttcatttttttttctaatctttttttctcctctattgtccagatcagataatttctattgatctatcttgaagttcactggctctttcttatcatctcatctccattctgctattgatttcacctagtgagtttttatttcacttattatactttttagttctaaaatttccttttggttcttcttaataactctatttatttgctaagactttctatttttctattattcctaaaagtatattcactcttactttccttttctctttttccttcttgccgtcagtgacagaacacccatacttcttggagtctttttacattgattaccataaaaactctgttaataattcctacatctataggatctcagtttaggcatctgttgaatatctttcctcaagggagtttttcttctgcttctttttaggctgagtgattttgtattgtatgctgagaaatttggggttgtatcctggacatttaaaatatctaaatacgtgagattctgggtttgtctaaatctgttgggtcagtggtacttcaaattctggtcttcttgctcagtctgctgctaccatttacttttcagtctgcaaataactgcagaattcattctgtccaggttttatagctacattcagtaggaaaaactggatggagtgtgcttccttcatcttacctgaaaccagaacctgtcttgataggcaaattaacaaattaggccaataattttaaaaagttaaggctgtaatttttatatgataaattgatattatatatttataaatattatatattgataaattcttataaattttttactactctaccacagttatattactgaacattatttttttcttcttttttttttggagacagagtctctgttgcccaggctggagtgcagtggcgtgatctcagctcactgcaacttctgcctcccgggttgaagccattctcctgcctcagcatcctgagtagctgggactacaggcttgcaccaccatgccaagctaatttttgtatttttagtagagacagagttttgccatgtcggccaggctggtctcaaactcctggcctcaagtgatccttccacctcagcctcccaaagtgctgggataataggcatgagccaccgtgcccggccttgaacattatttttttcatcactgccagatacctggctctttggctgtattatactttcctgtctcctctgttctatttcccattctgcccgttgattgtcagttgcccattgtcttttttcagctgagacaaggttggaattttccaaaaggaactttatgaaggagatgggatgatacatacaactgtattgatttggggaatgacgataatttcagctgtgtacagcaccgccctgtctgtgaagcccttgcacgtccttctcatgtgatcctcaaatgacccctttgagacaatcagatccagtttattgatcccatttcacagttgaggtaactggacttttagatgtctgatatgatcttctcaaggtctctcagtttcggaaaggcagagccaggaccaggtggatttcctagccacaaatccaatgtacttactgcagttttgtgctttagtttgacaactaaggatttaatgattttgtgatttcgctaatccagtttacaaagcattgtcctatgcattttccgtggcccgaggtggtcttaggtgaacatgcttcctgcaagatctttggatcttagctttagtgaggtgtggatggcacccgcaatctggtagcgttcctcccaggctatagtttatttcaatttccttgaggttttattaaatacctagtacatttctggcacagcccccaagcaagcctaggagacagaaggatgaataagaccgttcctagactcctggcctctatgggccccagttaaatatctggaccttcctggccaccaaggggcctgcagaaggctttggggagaagtgtcttgagcttatggagttctcctttccctacagtcctccgggcctcatatgaacaggagaaagaagcgcttacccactctttccgggaggccagttctacccagcaggtgagaggggctgggtcgtgtcagtcttggataagggtaagtgaggaccaatgggaaagcagcatggagccccaaggcagccaaaactgattacgtgtgcctaggagtgaggggctgaggtgattgccttctgtgtatccaggccccttgatgtagtaaccaggctattagctcaagaggactgagtgtgaaattgagttgggcctatttttccagggactgctggggagatcttggagaggcatgggccaagtgccacagtgtgattagattcatgggtggatgcacagggacctgtggaaggatgcagggaagcatctgactcaatgtggctgtgcaggaaagatttcctagagggagtgagatctaagctggagtctgaaggatgggttggaattctttggtaaagaagggtaggaagggtgcctcaggcagaaaaaaagcaatgtgttcaaagacatggaggaaaaaggaaaaatatggaatacctgaggaaccgaaagatgtccaggatgcctggggtatgagtttcagtgggagaggggactaaggctaagaacgtgagcaagggccagagtggaagccagtgagccaccttaaggggttgtgctctagcctaacggtagtggtcacggttcaagtagagaaagttcttggcagtgaaacagtttggagataagaatgtaccctgcagctgggggactattgtgatgtttggctgcaggagaggatgtatagaaggagcagtgagaggtgagcttggaaaaattcattgagcctggtttggatgtgttttgaatgccaggctaacaaccatcttttatagcaggacattgttccctgcagtatggggagccgttaaaggcattaaagcaagaggtggggttggtatgttcctttcatctcctctccttctccctctccttctccttctccctccctctccttctccttctctgtccccctcccttcccctccctatctccctccccctcccgtccccctcccctcccctcccgtcttcttttctttcctcttttcttttctcttctttctttctcttcccagcatgcaattctgcactgtaagggctggtagatctcaagcagtggtcgaagtatgttgatgttgcattgtcatgtagagtagccaaagacagattgaagaacccaaaaccgttctccctctgggatgtggcgaagttcacctacagcatttatgaggcaggctttgattgtctccatcccactccctgctccaggagaccatagacagactgacctcacagctggaggctttccaggccaaaatgaagagggtggaggagtccattctgagccgaaactataagaaacatatccaggtaggtggcagcaccctgggcgcttttcctccttgaatctccagggaggtcagggccgggcaacaggaaagaccagcccctcttcaaggacaagactcagacctggcactcttacctacacaagggcctggaaataaaagagttcccatttcaccgatgggaaaattaaggcccagagagcagcatctggaatagtaaagtgctcacgttctggattcagagagaactaggtgcacatagcaaacctgccacttagcacaagtgactcaacctgtccgaaccacagtctcctcatctgtggtgctagcacatgtctcaaaaggtgatattcggatacagggagataaagcatattaaacacttaacatgggctgagagaggaaggtgggtgacttgtgaaagtccaacaatgagttgctggcagaatggggaggagggaggtagcctactggcctaatgaggtcactctgtccctgtctaggattatgggagccccagccagttctgggagcaggagctggagagcttacactttgtcatcgagatgaagaatgagcgtattcatgagctggacaggcggctgatcctcatggaaacagtggtctgtgactgggagtggctgggggatgcagcctcaggctcccgctttctgggtgtttcctttgtaaagcatgcagaggggaggtggtttgaggaggtcccagcctagttcactccagctttgacctgccacctgtgctgaccactgagcatggtctgtggccaggctgggtcaagcagtggctccttatcatctgagtcctgtgccttttgaggctactgatgttgctgtagcttgggtgacactagggcaggtagcattgagaacacgggaggacagaagcctcagaaaccctagggttgaatctaagcagagattatgttgctgtagaagtctccctggcctcctgtgtgccttacaacttataattaaaaaaataaaactaaggagttaacaaaaagctgctgacttttaattttgccacatgagaatgtttaaaaaaaaagtcttacaggcactaccatctcatgtcaccatccgttcttttctcaggaaggaaagagggtaggagggagatggggagccagggtgtgtgcccagggagccctgggggcttgagtcacgtgacatggaatcacccacagggctttattttaatcagatcatctcaaacattccgtatagattttgttcgctcatttttgtggaaacacataacagacaaacttaattttatttatatagatcatatccttctgacttttggagaacaaaacatattctttcttccatgaactcatggtgaaatgagatggtagggcctgtaatttttttttaccattctcctgtggcaaaaagccgcagccctttgttaactttttagttttacttttttctaagttaccttattgctccatgaaatgtaacatctagtctagaatgaatcagtgctttcagtgaccacagataagagggaggtgacagcacacatcgtgcagcgtgagtttggcagctttctgagctcattctcattgttatagaaagagaaaaatctgatattggaggaaaaaattacgaccctgcaacaggaaaatgaggacctccatgtccgaagccgcaaccaggtggtcctgtcaaggtagctgtcttcctgcctcctttactcccatccccaccctttttgccaaaattcccagctgggagagtcttagaggggcctgaggaatggactgacaggtgggcccagggcctatttagggaatgtggctcctctttccctgggagtcaagaaacccaagggggcagttctgctcagaaaccaaagtcccaatgccttgattagtatctgtttgtctctgtcctggctgagtgtactctgtgggaaagcccaatatagggaggaggaaacaggaaatttatagtgcaccaggcctaagtggaatgaatcagttcttagggcttagtaaataagagctagtatcatgtgtcagacataatttattgaatactgtacatattttctcatctaatcctcataattactctaagagctgggtcctattcttcttcttcccattttacaaatgagaagactgaaatttaagaagaatgaataacttattcaagattatatagctaagtggtagagcagagatttgaagcagctcagaactgcctgcctgtctgtgaggcccccgctccttggtcaacagattgaattgcctcttgtatacaggccaacaaggagggcagtggggaccctgcagcaggctgctggtccatctaaggaaggcttcctgggggaatgggttggtctctgtggcagctgctcccagtaggcaaccctgggctctgtgtgcatccacaggcagctgtcagaagacctgcttctcacgcgtgaggccctggagaaggaggtgcagctgcggcgacagctccagcaggagaaggaggagctgttgtaccgggtccttggggccaatgcctcgcctgccttccctctggcccctgtcactcccactgaggtctctttcctcgccacatagggtgcagggcctgggcccaccacgacgcctgaagtcacagctccttccaaggtttttctggagaagacagcaggagcctctcagttcttttccaggaaggaacgagggtgggagcgagatggagatcctgggtgtgtgcccagtgagccctggggccttgagttacatggaatcacccacagggttttggaggccccgagaagcgtcttcccttgagttggccaagggaataagcaagaggagacatttcctccctgccccagcactctgtcccaatccgagaagttccgaggctttcccaggggcagtctgtgtcacgctggccatttgacataaaggagacagcccctggtcccagcttgtcagctctgctgccgacttgctgacttatcaacttcctctaggtgtttccactccaccctggcctgctcagagcctcagtttacccctgcattaaaatggtggggggactggtcaaaggactcttatgtcactgcagtgtcccattctaggattgtctgaaggccagagtaggggttggggggagtgtggacaaaccccgcaaatcagagtggggaaggtgagtggtagagagggggtctctgaaggcccttggggctgacagggccaggcagcctccccagctgaggcatcattcctgggccagagtcgtgtccaccaagggacagtagccagagctcctcttcctttaccaggcaaggtgcatcccctcagccctcctggcccttcagtcttggtgccacctgggcacaggggcaagcttggtggttgtgagtccattcatctatcagagctggaacctcatccctgcacagatgaggaaaccaaggcatggagcagttcccagagtcgaatctagatctcatctgtcatccgggtcttatcctttgctctgtttttctcttcaggctctggaaaatcagatctgtgacttaatcttcctctccctggccctcacccacttagtttctttttcattcctgctccctgccttaactcctcctcccactgcccctgatcccaggcccaggcttttacaacctggtgctcagcttccccatcagtgaaaaggggtggctagagtaactaacctcagcaggccgtccagtcctgatagtctgtggatttcggatccttctcaggaagcttcatgtctaatggagactataattataactcctgttctgcatagagcatttgcatcaaaggctttccatacccctccctcccctggtcctcataagatccttgaagcaggttcctattcctcattggcaacatggcaaacagatcacaggagtcaaagggccttgctcaaggtccccagcttcagccccaggccctaagccagcgtcagaacagtcaatctgcatttttcatcagtcattctatagtgacatcatcccagactgccttctgtattcccctgtgtacagtctccttctgtttctaggtttagaagttcagaggtgactgtgtttctccatttccacagccaaatgggggaagaggtgaggctaggggagtgctgtgctgattctccagccatggtcagacaggtcacccaggagcctcgaggaaagccctggagggaatcacatgtgtactttttcatgaagctttttgcaaagcacatctgcgatacactagtttattgaactaatgtccaggagtagacatgattggtggccaagttatttggggacacctaaacagatcagtgacctgaatgacttctcagaacctttaatatgccaatgtgtgtggcaaacttacaagaagggagctaagtatccagcctctcccaaacctctttgaacaaagcttctgtccctcccacacctctcacctcacaggcacatcaggctgcagaatgcgctttagaaagcattgttttagtccaggcacagtggctcacgcctgtaatcccagcactttgggaggccgaggtgggtggatcacaaggttgggagattgagaccatcctggctaacacagtgaaaccctgtctctactaaaaaaatacaaaaaattagcttggcgtggtggtgggcgcctgtagtcccagcagcttgggaggctgaggctggagaatggtgtgaacccaggaggcggagcttgcagtgagccaagatcgcgccactgcactccagcccgggtgacagagcaagactccgtctcaaaaaaaagaaaagaaaaaagaaagcattgttttaattgagaggggcagggctggagaaggagcaagttgtggggagccaggcttccctcacgcagcctgtggtggatgtgggaaggagatcaacttctcctcactctgggacagacgatgtatggaaactaaaaagaacatgcggcacctt

SEQ ID NO: 37817 - DNA, 78986 bp, Homo sapiens
ctgccgccttctagccgggcgttcgcggccccgccggcccgactctcaagcctcagctcccaggctaggctgtggccgccggtggcctggggagagtgcggcgccatgcctcgggcttaatgcgcccccccctcttctcccagtcttcagtcttaagtcgttagcctcctccctccgctttcagcagtggtctttcagctctcttcttgtgcgctgttgtcgaccccgaccagccccttccaacccagtcatcatgtcccagccgggaataccggcctccggcggcgccccagccagcctccaggcccagaacggagccgccttggcctcggggtctccctacaccaacggtgagtgctgtccggggggagggcgcagcctggccagggctgactgacctttgcgtgccactgctgcttgaggcgacatagatagagagagtgacctccttaccgggttctggcgcggatggtggtgggcggctgggccaggggaccacggcagttgtgcacctgtagccccaggctcgtctcagtctttcacatttatttagtcggtcaccaaaacagtaaatgagcacctgctgtatgcaacgccctgggtgaaacacgggtgagaaaatgcctcaaaactcgaatataaggatcatagtgtttgtgtgccttcgccttccttgccacctcaccccagtctcctagagagcaggatgtggggtctgattcttctgggttccgcaggccctgaagtggggtgggggtcgtactcagtctgagtttctggagatgaatgcatgcttttgggacacccctttagggcctactcatctctcccagaaccttcccagaattgtacctacaacagctgttcaatgtttcagctgtggaaaaaccaaatagaagggaggatctcctggttgacttctagatgtctggacagcatttggaaagtgggtggacacaactctctgaatctctgacaagagtctacatgtacattatagtttgtcatttgatgtgagaatgtcttataattttatacctcttctaggattccttaaatcgtcctacattgtgatttgctaagattatttcagttgttacaatagacaaagactttctgccgacagattgcctacttaccaatttacttacaaatctttggtttacagaaataagactagtagaataatgctaaagaacttaagttgcccattagagtctaagagttctgtgaagttggagaatacagacagtgactaaaatctctaatttacattgtttttagagaagaccgctgttttctttacaaagatggctctaaaagacttttaaaaatgtctgtgagtaggcaactatgtgggcagaagaaagaataagtggaggaaagccactgaaagggtactgagttaaccattctttctcaaaattatggtaacagattatgtacactacattttattctagaatatttagtaacatttacactgaggatgagaaaaaatgttacatggctatggatttttcttataatctataaattgcagttttacattaactttaaatgacaaatcctcaaatgtgcttcaacatttatatatgagtgtagttgtcataatattgaaatgttaaagggatttgaccactgtggtatgctgtattagagatactgtcactatgttgatttgatacagtccaacagacatttgttccacatctttttttttttttttgagatggagtcttgttctgttgcccaggctggagtgcagtggtggtgatcttggctcactgcaacctctgattcctgggttcaagcgattctcctgcctccttaaccttccaaagtgctgtaattacaggcctgatccacggtacccagacctcttttttaaaatataattttcatagtctttttataagttccatttctacagggttttttgtttgtttgtttgtttgtttgttttttgagacggagttttgcttttgtctcccaggctggagtgcaatggcgctatctcggctcactgcaacctcctcctcccaggttcaagcaattctcctgcctcagcctctgaagtagctgggattacaggcacgtgtcaccacacccagctaatttttatatttttagtagagacggggtttcaccatgctggtcaggctgatgtcaaactcctgacctctagtgatccacccaccttggtctcccaaagtgctgggattacaggcatgagccactgtgcctggcctctacaggttttttgtattttgccttttttttttttttgagacaggatcttacttaaactgtccctcaagctggagtgcagtggcaggatcacaactcactgtcactcctgggctcaagcaatcctcacacctcagcctccccagtagctagaactacaggtgcataccaccaggccccattttttatataagtatataatatatatatataatgtatatattttattattattttttgagtcagagtttcactctgttgcccaggctggagtacaatggctcgatctcggctcactgcaacctccatgtctcaggttcaagtgattctcgtgcctcagcctcccgagtagctgggattacaggcctgtgccaccacaaccggctaatttttgtatttttagtagagatggggtttcaccatgttggccaggctggtcttgaactccaaacctcataatgatccgcccaccctggcatcccaaagtgctgggattacaggcatgagccaccacgcccggcctaatgtaaagatatatgtatattatatatataatgttttatatatattttgtagagatgagtctctctatgttgcctaggctggtctgaaattcctgacctcaagtgatcctcctgactcagccttccaaagtgctgggattagaggcatgagctaccaagcctagcctgggttgttttattgttcatcctgctaataatacagagagtagggatatggtatcaagttggagaacaggatatttttcaagaaggtgagaaaacgtttcaatgctgggatctagttttgcttaactattccaaagcagtagttgatgcttgcatattctgttgaaaactctttttttttttttttttgatggagtttcacttttgttgcccaggctagagtgcaatggctcattgcaacctctgcctcccagattcaagcaattctcctgcctcagcctcctgagcaactgggattacaggtgcatgccaccacacccggctaatttttgtatttttagtagagacagggtttcatcacattggtcaggctggtctcaaactcctgacctcaggtgatccgcccgcgtcggcctcccaaagtgctgggattacaggcgtgagccaccgcgcctggccgaaaagtcttaagtatttaatgaagtttgcttaaattacatattacagtataattagatcttcagtttgcttttgttttttgtttttgagatagtctttctctattgcccaggctggagtgcagtggcgtgatcttggctcactgcaacctccatctcctgggttcaagcaattctgcctcagcctcctgagcaactgggactacaggcatgcgccactatgtctagctaatttttgtatatttagtagagacggggtttcgccacgttgcccaggctggtctcgaactcccgagctcaggtgatccgcccacctcggcctactaaagtgccgggattacaggcgtgagccactgtgcctggccagtttggtgttttttgtttttgagacggagtcttgctgtgttgccaggctggagtgcagtggtgcgatctcagctcactgcaacctccacctcccaggttcaagcgattctcctgcctcagcttcccgagtagctggggttacaggcacctgtagcacatgccaccatgcctggctgattttgtattttgtttgtttgttttgttttgtttttgtttttgtttttttgagacggagtctcactctgtcacccatgctggagtgcagtggtgcgatcttggctcgctgcaagctccgcctcctgggttcatgccattctcttgcctcagcctcccgagtagctgggacaataggtgcccgccaccacacccggctaattttttgtattttttttttttttttagtagagacagcgtttcaccatattagctaggatggtctcaatctcctgacctcgtgatctgcccgcctctgcctcccaaagtgctgggattacagttatgagccactgtgctcggcctaatttttgtatttttagtggagacggggtttcaccatgttggccaggatggcctctatctgctgacctcatgatcctcctgcctcagcctcccaaagtgctggcattacaggtgtgagccaccatacccgttccagtttcgtttgtttgtttgttttttaaagagcctgggtcttgctctgtcacccaagttgaagtgtagtcacttgatcatggctcactgcagcctcgaacctcctggctgaagtgatcctcccacgtcagcctcctgtgaagctaggactacaggcacatgccctgaaacctggctaactaaacagttttttttagaaaacagagctgcactctgttgcccaggatggtcttgaactcctggactcaagtaatcctcctgccttggcctcccaaagagctaggattacaggcatgagccacaacatctagcacagatattttatatattatagtcaaaagacctcaccaggtgtggtggctcacacctgtaatgtcagcactttgggaggccgaggtgctaggattgttttagcccaagaattcaagaccaccctcggcaacatagtgagaacctgtctctacaaagaatttttaaaaaataggcatggtgcgggcccagtagtcccagctactggggaggctgagacaggaagatcacttgaccccaggaggtcaagactgcagtgagctacaattgcacaactgcactacaacctgggtgacatggcagtatcttgtctcaaaaataaataaataggccgggtgcagtggctcacacctgtaatcccagcactttgggaggccaaggcaggagggctgcttgagcctaggagttcagaccagggtaggcaacataggaagaccccatatctataaaaaagtaagaaaaattagtccagtgtagtggtgccagcctgtggtcccagctactcaggaggctgaggtaggaggatcacctgtgtccaggaggttaaggctgcaatgagccatgatcatgccactaccctctagcctgggcaacagagtgagaacctgtcacaaaaataaataaattaataaaaaacaaaagacctaacagtagcctttttcaaaaaaaaaaaatatatatatatattttttgagacggagtctcacgctgtcacccaggctggagtgcagtggtgcagatcttggctcactgcagcctctgcctcccgggttcaagtgattctcctgcctcagcctcccgagtagctgggactacaggcgtgcaccaccatgctcagctaatttttgtatatttagtagagacggggtttcaccatgttggacagggtggtctcaatttcctgacctcgtgatctgcctgccttggcctcccaaagtgctgggattacaggcgtgagccactgcgcccagctgagaggtttttctaagtctttgtgtatacatatttcctttgcaaaaattgatagcagactacaagaccttaaactaatggatcttaatctgattatcatgtattaacgctaaaggcaaataatgactcccaccattaattagtgcctttattgactgaatcaacttgcaaagccagttagaaactgcagttttgttttgttttgttttggtttttcagaaatggtctcactttgtcccccaggctagagtacagtggtgcagtcttggctcactgcagccttaacctccatggttcaagcaatcctcctgcttcagcccctgaagtagctgggattacaggtgtgcgtcaccatgcttgtctaatttttttgtgtctttagtagagatgggtttcaccatttggccaggctggtctcgaactcctgacctcgtgatcctcccaccttggcctcccaaagtgctgggattacaggtgtgaaccactacgcctggcccaggctttcctaaagaaacgtacagctttttggccaggctggtctcaaaatcctgacctcaggtgatctgcccgcctgagccaaagtgctgagattacaggtgtgagccaccgcacccggccacatgagattttttactaatgcagattctgggatccttttgaatcctatgaaataggattttacaaaggtgggacctgggatctcaatttgtaccattattatagcaggttcctctgattctgaagctgctggttgggtgggaagcactcatctgcattcattcttgcctctaactttctaatttagcttctttacccacacatcccaaaattgtccttaataaggccacaaggctgggcgtggtggctcatgcctgtaatcccagcactttgggaggtcaaggcgggtggatcacaaggtccggagttcaagaccagcctggccaacatggtgaaaccttgtctctactaaaaatacaaaaattagccgggtgtggtggcgtgcgcctgtaatcccagctactcaggaggcctcagcctcctgagtgattctcagcaggagaatcacttgaacccgagaggtggaggttgcagtgagccgagatcatgacattgcactgcagcctgggcgacagagcaagaattcatctcaaaataaataaataaataaataaggccacaaatggcttcctggttattaaatagaaaaatatttttcagttctcattttccgagctgcatttgatacctttggctgttattttgtttttacaacaattgctttctttggtttctaggatatcaccagaagggtagttatggttttctttcttttttttggttgctatttctcaacagcagtattctcaatatttcttccatttctgattgtttttttctctctcctccttaaatattggtgttcttcaaggtgacctatttttcttactcttatatactccctgggtgtctttaattcccatggttttaaatcttatgcatagatcagtgactcccataattatatcttaaggtgaaatctgtcactttggctgcagctaaatatctttttttttttttttttaagacagagtcttgctctgttgcccaggctggagtgaggtggcacgatcttggctcactgcaacctttgcctcctgggttcaagcgattctcctttctcagcctccggagtagctgggaccaccggcatgtgccaccacacccggcaaattttttgtatttttagaagagatggggtttcaccgtcttaggatggtgttgctctcctgacctcatgatctgcccgccttgacctcccaaagtgctgggattacaggcctgagccaccgcgcccagcgcagataaatatctttatactggacatctccacttagatttcttggtggcacctgaaaattagtgtgtttaaaataactcttcgatctctcttccctttgccattccccacctttgtttttttgagacagagtcttgctctgtcaaccaggctggagtgcagtggcacgatatccgctcattgcaacctccgcctcccaggttcaagcaattctcctgcctcagcctctgagtagctgggactataggcgtgtgccaccatgcccggctaatttttgtattttagtagagacggggtttcaccgtgttggtcaggctggtctcgaacttctgacttcaggtgatccacccacctcggcctcccaaagtgttgggattacaggcatgagccactgcatccgactttttttttttttttttttttaaagacagctctcattctgtcgccctggccggaatgcaatgatgcaatgatagctcactgcagccttgaactcctgggctcaagtaatccttgatccttgatcaagtgggtggagtggctcatgcttgtaatcttagtactttgggaggtcgagtcaagaagatcccttgagcccaggagttcgagaccagcctggacaacttagggagaccccatctctacaaaaaaatttaaaaattagccaggcataatggtgcacgcctgtaggcccagctactcaagaggggaggtgggaggatcgcttgagcttgggaggtcgaggctgcggtgagctgtgacacttcagcctgggtggcagagcgagacctcatttctgaaaaacgcacacacacacacacacacacacacacacacaaccaaaacttatattttgtagagatagggacttgctattgcccaggctggtctcaaactcctggcctcaagtgatcctcccaccttgactttctaaagtgctgggattgcaggcatgagccaccgtgcctggcctacatttctattcttttctctttctgttcaaatgaataaacacggccatccaccaggttgctcaggtcagaaacctaggagtcatcctagattttttcctctcttcatcacccatattcaattccacataaaatcccatgaatgctgtttcctcaaatcagtttttaaaaatttgagtaatgtatagatactaaatatttctctgctgtcccaatgttaaattatttatttatttattttacttctgacacaggttctcactctgttgcccaggctagagtgcaggggcatgatcacagcccactgcaggcttgatctcttgggttcaagtgatcctcccgcctcagcctcccaagtagctgggaatataggcacgtgccaccacaactggctaattatttatttttttgtagagacgaggtctcactatattacccaggttattcttgaactcctgaggtcaagccgtgctcccaccttggcttttcaaagtgctcggattacaagatcaagccaacatgcctggcaaaaattatttttattaaatgtgtatatgcaaacacaaaactagatgtaaacttcatagggttatagctattgtactattgtaaaaccaaacattaaaaatatcaacatatggctgggcatggtggctcacgcctgtaatcccagcactttgggaggctgaggtggccagatcacttgaggtcagaagttcaagaacagcctggccaacatggtgaaatcccgtctctactaaaaatacaaaattagccagcgtggtggtgcacacctgtaatcctagctactcgagaggctgaatgaggcaggagaatcgcctgaacccaggaggcggaggttgcagtgagccgagatcgcaccactgcactttagcttgggcaacagagcgagactctgtctcaaaaaaaaatcaaaagcaatataattcaattttaaaacattaaacaatatgctacattttgtttgaaaccacagttgatttgattgttttaattttgaatatgttggaacattacttgggtgactatcatgctcactttttcctttttgtttttgagacacgttctcactctgtagcccagggtggaatgcctaattatagctcactgaagtcaaactcctgggctcaagcagtcctcttgcctcagcctcctgagaagctagatctacaggcatgtgccacaactcctggctaattttttaatttttaatttttttgtgtggaaatggagtctcgctgtgttgcccaggctggtctcctactcctgagctcaagtagttctgctttggcctcccagtgtgatgggattacaggcatgagccaccatgcccaacctctacacgattttaataggggaagaatggggtgggggagaggacatttactggaaaacagacgacttataggaaggataaatgggcttttagaatagatatgatagttttgtgatgatatctgtttaggtgtggtgtggaaatttctcatctcaggtcatgagtcagattgacatctttcctggttgcccctgggaagtagattatgacaattgagttcttttggaaggctctgttttaggcagataagagattttaggaactcaaatgccttctgcttaaaataatttttatgccatagtagcgtattctggaccccttcacaatcactgacccatttatttttatttatttatttatttatttatttatttatttatttattgagatggaatcttgctctgtcacccaggctggagtgcagtggcgcgatgttggctcactgcaagctctgcctcctgggttcacgccattctcctgcctcagcctcccgagtagctgggactacaggcacccgccaccacgctccactaatttttttgtatttttagtagagatggggtttcaccatgttagccaggatggtcttgatctcctgacctcgtgatccgcccgccttggcctcccaaagtgctgggattataggcgtgagccaccgcgcctggcctcacagacccattattttgatgggctacttagtaatgacttcagaatttaaaaaaattatccatttagtgaaggtgtcattatatatttattactacactttttgtgaactacttgtaattgatccatatatgattttcacatagtggggagggatgtcagaaaaaaaaattttcatgtaatagttactcacaataggtctatgatggtgactaccacaaaacaagttcttttgtatctgtcttcctgccagttggccttatgacctcatattcttttttttttttttttttttgagacaggatacagggtctcactttgtcacagaggctggagtgcagtggcgtgaacgcagctccctgcagccttaacctcctgtgctcagtgatcctcctgcctcagccccaagtagctgggacttacaggcaggcgccaccacacccaactaattcttatattttttatagagacgaggtcttactattatgtccaggctggtctcgaactcctgagctcaagctatctgcccgccttggcctcccaaagtgttgggattatatgtgtgaggcaccatgcccagcatgttttcatctttattggcctgtcaaatttttgcttattttgtacattttgatggtatttggctttcacttggctgtacctggcttgaaggcacctctttagcgtattagcttgtgataagattgtaaatacaacctgtttgctcacgcctgtaatcctagcgcttatagaggctgaggcaggaggattacttgagctcaggaatttgagaccagcctgggcaacatagtgagtctctgtctctacaaaaaaaaaaaaaaaaaattaggccggcgtggtggtgcatgcctgtagtcccagcttctcaggaggcttagatgggaggatcgcttgagcccaggaggtcagagctacagtgagccatgattgtgccactgtactccagcttggatgacagagtaaagtgctgtctcaatcaatcaatcaatccataagtaagtaaataaaattgtaatacaaatatgaaactaggccaggacatcttgtggcaacattgggctgtgagatggcctatttttatccaagtgacccaacatatgcttatatattatttttttacaaatgttttcatttattgagacatctctgtattccctctgttacttgctactgtttagtccatcttttttttttttttttgtcacccaggctggagtgcaatggtgtgaccttggctcactgcagccttgacctcctgggttcaagtaatcctcctgcctcagccccccaagtagctaagactacaggcgcataccatcaaggctggctactttttgtttttttttataggcatggggtttcaccatgttgcccaggctggtcttgaactcctgggctcaagctatccacctgccttggcctcccaaagtgctgggattacagatgtgagccactgcgctggccttcattgtggttttgatttacatttctgttatgactaattatgtttgtatttctctaatgactgatgatgttgaatgttttggcatgtgcttattagctatcttctttggaagtatgtttgaatgtctatttaagtcctttgcttattttttaattgagttatgtgtttttattgctgactgtaagaatatatgttttactttatttcttaaagtattgctatattcgttggtaagactaatttttcctccttttattggaaggtcctgtccaaaatgcattgctgtcttcacaagagtcagtgagccaaggatacaatttccagcttccaggatcctaccctcatccaataccagcaaagactttgaatccagtctctggacagtctaactatggtggttctcagggatctgggcagactcttaatagaccacctgtggcctctaatccagtgacaccttcgcttcatagtggtcctgctccccgaatgccattacctgcttctcagaacccagctactacaccaatgccttctagtagctttcttcctgaagccaacctgccaccacctttgaattggcaatataactatccatccacagcctcacaaacaaaccattgtcctcgtgcatcatcccaaccaactgtatctggaaatacaagtttaaccacaaatcatcaatatgtttcttctggatatccttcacttcaaaatagcttcataaagtcaggtagtattcttatagaagtgcttaaaatgtagaaatgtgaaacttttgcttatttagatgtttgaaataatacttgaaacctgaaaaccatatggaaaatgtgacttttaaaattattagtagttttttgttgttttttgtttttcggctttccagcaaaaaccagaaagcctgctagacaaattaagtaagctataacactcattagtagttttttttttcattcttttttctcttttttttttttttttttgagatggggtcttgctctgtcacccaggctggaaagcagtggcacaatctcagctcactgcaacctctgcctccctggttcaagcaattttcctgcctcagcctccagagtagctgggattatgggattacaggcacgtgccactgcacccagctaactttttgtatttttagtagagatggggtttcaccatattggccaggctggtcttgaactcccgacctcaggtaatccgcccacctcagcctcccaaagtgcgaggattacaggcgtgagccaccacacctggccacatttatttattttatttatttattatttatttatttttttgagacggagtctctctctgtcgcccaggctggagtgcagtggcgtgatcttggctcactgcaagctctgcctcccgggttcacgccattctcctgcctcagcctcccgagtagctgggactacaggtgcccgccaccacgcccggctaattttttgtatttttagtagagacggggtttcaccgtgttagccaggatggtctcgatctcctgacctcgtgatccgcccgccttgacctcccaaagtgctgtgattacaggtgtgagccaatatttctttgaaaagcatttaaaattctgtattgggatctgcaggttgatacttctcagcagacagcctcaagtttatgaaatagtgtaggcttccaagtgaaatagtaatatcaatagttacctttttaaccttatgtatgtttatatggcatatactccatcaggcttgtaaattgttaatggctgaaactttatttttccaagcctttgatcagacattggccctggtgaatgcattttggccttgtaaagattaaagctgcttctagaaacttaagtttctttgtggaaatcttctgacctgcaattagtagagctaaaatccttcatgttacttttgttctaattcatttgataccatgagtgagcatcaatcacttgaaatgaatgaatatggtggcacacatcaatcacttgaatgaatgaatgtgtggtcccagctactcggggggctgaggtgggagaattgcttgagctctggcaattgaggctgcagtgagctatgattgtgccactgcgctccggcctaggtgacagagtgagacttggtctaaaaaaaaaatttaagtgttaaaaaaaatgttatctatattattttccaggctctatcaaactttgatatcattatctgtttttctgttttgctttttattttttagagataggctgtctctctgtttcccaagctggagtgcagtggtgcaatcctagtgtcatcaaactgctgggctcaagctatcctcccgcctcacctccctgagtaggcgtgccacagtgcctggctaatcttttgttctttatttttttgtatagacagggtcttaccctgtcgcccagggtagagtagggtaacacgatcatagctcacttaactgcaacatagcttgctgtaactgctgacctcaagccatcctgctgcctggatttcctaaagttctgggattacaggtgtgagccacctagccaggcctgcattatcttgtttaatcttcgtaacagtctcttacagatctaaagtataagacttgaataatttgcccaaagccacagtaaaatagtttgggaaaacatttatttaaaaactatttaagggccaggcgtggtggctcacgcctataatcctagcactttgggagtccaaggcaggaggatccacttgaggccaggaggccaggagttcactagcctgagcaaaatagcaagaccccatctctatttttttaaataattttatttaaaaataaataaatactaagagtaggtgtagcttctcttaaaaaggtacattatcaataatctgaaatttctttagctataatagaaaccctcagagcaccttgtctccactacagatttggtgagagagacataaataagtgctgaggctgggcatggtggctcacgcctgtaagcccagcactttgggaggctgagtcgggtggatcacctgagggcaggagttcgagaccagcctggcctacatggtgaaaacctcgtgtctactaaaaatacaaaaattagccaagtatggtggcacgtgcctgtaatcccagctactcaggaggctgaggcaggagaagcgcttgaagctgggaggcggaggttgcagtgagctgagattgcaccactaccttcagtctgggcgacagagcaagactccatctcaaaaaaaaaaagtgctgaaacttatgaaagaaggggaaataaaaacatataaactaataaaatgaacctaaaaagtaaccttcttttttctcatttgaaccttcaaagaaccttcaaattcctcattttttttcttttttccaactcataactgagagttggtacctgatagtctggtatcaaagctgtgagtatttaggttatactaagtttttagttcatatattaaattttcctgaatttttttaataggtcacctttaagcatcattatactcatttaggggctgagagggcagactctgaaactctagctatcagtgtcgtaaataagaattcttcaacttgaaaaaatgttcattttatgaaatatatgattatctgttcaaaaatagtcttctaaaagctgtgaaaatctctgtaagtttacttttattcgttaaacattaggttgtaggttacatctttgtggccagatgtattttacattcttgttcatgctgagttggccatgtaccttgcccctttgttcctttgacttgtctatactgccatagatatgtgtgaccacttctttgataagggagttacatggcaataatctttgtcttcacttttgtcaacaaggcactgatagtcttgttagcagttgtaagattcagtaataggcaatttttctttttcttttttttttttttttttttttttgagacggagccttactctgtcgcccaggctagagtgcagtggcgcaatctcggctcactgcaacctccgcctcccaggttcaagcagttcttctgcctcagcctccctagtagctgggattacaggcatgcgccaccacgcccagctaattttttgtatttttagtagaaacggggtttcaccatataggccaggctggtcccaaactcctgaccttgtgatccacctgtctcagcctcccaaagtgctgggattacaggcgtgagccactgcacccagcctaataggcaatttttcaacttgatactggagtatttaacagtattggtgaaacattttgaaaaatttcaggctgagcgtggtggctcacgactgtaattccagcactttgagaggccgaggcgggtggattacgaggtcaggagtttgagatcagcctccagcctggccaatatggtgaaaccccatctctactaaaaatacaaaaattagccgggcgtggtggcgcgcacttgtggacccagctgctgccggaggctgaggcaggagaatcgcttgaacccaggaggcggaggttgcagtgagccgagattgcgccattgcactccagcctgggggacaagagtgagacttcgtctcagaaaaaaaaaaaaaaagtgttccttctgcctcggtctcccaaagtcctggtattatagacatgaaccactgctcctggccccctatttttatttttatttatttatttatttattttgagacagagtctcgctcttgttgcccaggctggagtgcagtgacgagatctcagctcattgcaacctctgcctcgcaggttcaagtgattctcctgcctcagcttcccaagtagctgggattacaggtgcccaccaccacacctggctaattttttgtatttttagtagagatggggtttcaccatgttggcaggcttgtcttgaactcctgaccacaggtgatccactgtgcctggcccagccctctattttcaggctcactctaaacttagttgatgttaatggaacagactatgttggtaaacaaaattaacaaaatattacaaaattaataacattgaaattttattcatgttaatttgtactagaatatgacacatggcctattgaatctaatgatcagttaatgaaaaattaataaacagggctggccaggtacagtggctcacgcctgtaatcccagcactttgggaggccaagacaggaggatcactggagcaccggaattcaagatcagcctgggcaacaaaatgagacccccgtctctattttattaagatttaaattattaataataaaaacaaacagggcaatgtatctactctaaaagtgatttaatccaaattttatatttactctgctttaataattgacaggtaagaggcctggtaggggagagttagaaatttgtaaaatatggtccgggcacagtggctcacgcctataatctcagcactttgggaggccaaggcgggcgaatcacctgaggtcaggagctcgagaccagcctggccaacatggtgaaaccctggctgtactaaaaatacaaaaaattcaccgggcatggtttcacatgcctatagtccctcctactcaggaggctgaggcaggggaagctcttgaacccgggaggtggaggttgcagtgaactgagatagcgctatcgcattccagcctgggcgacaagaaagaaaacaggaaagcaggaaggcaggcaggagaaaagaaagaaagaaagaaagaaaaaaggaaggaagggagggagggagagaaggaagagagagaaatttgtaaaatatgcatgtagattgaaaaattgtaaatttaggaagttaacatgtttctggtaactctttggttattataatttaaatgtaagtttggaagttactcagctttggtaaaaggctgattttggccatagtcttgagttctcaagtgacgtgtgaaaaaccaatgtttccataggtccttctgtacctcccttagtgaatccacctctgcctacaacttttcaaccaggagctcctcatgggccccctccagctggaggcccacccccagtgagggccctcacgcccctgacatcatcatatagagatgtaccccagcccttatttaattcagctgtcaaccaagaaggtaagtgaaccaagaaacaaagtcaaatcctcaagttttgacttagggtagaaagatgaatattagctgaattctgtgcattaaaatcacattttttccagaaaatctagttttggttagggatgggctacaggaatttacaatttaaagttcctcaggaattccattgccatccgctgggctgtgactaccattgggaaaaaagctcttagtgttttgttactttttttgttgctatgcggattttttaaaaatcatggctataaagtcaggtggcttttggaggagaattactacttttcttgacatgatgttagaatgttaggaatatccttttaaaatattgacctttttcattcaagacgtattttgagccaggcgcggtggctcacacctgtaatcccagcactttgggaggctgaggcaggcggatcacgaggtcaggagatcgagaccatcctggctaacatggtgaaaccccatctctactaaaaatacaaaaaaattagccaggcgtggtggcaagcgactgtagtagtcacagctactctggaggctgaggcagaagaatggcgtgaacccgggaggcggagcttgcagtgagccgagattgcgccactgcactccagcctgggcgacagaaccagactccgtctcaaaaaaaaaaaaaaacaaaaaaaaaaaaacaagatatattttgattgccactattatcgtaaatgttaacacatacttatgaaactaaataaaagtcatttatacaagcagtggaaaaatacaagcttttgaaatttgattttcccctccctggaatcaatgttagctacatgcaattttatgtaagtaaaatatgttaaagcatcatcttgggatgtaatggaaataagagtgttcatttaaataagatattttataaagtaagaaatttgattttaggctgggcacagtgtcttacccctgtaatctcagcactttgggaggctgaggcaggcagatcacttgaggtcaggagtttgagaccagcctggccaacatggtgaaaccctgtctctactaaaaatacaaaaattagcctggtgtgctggcatgtgcctgtaatcccagctacttgggaggctgaggcaggagagcttttgattttagcagtaatataatcgttgcagcaagatgtagaaaacagatgagggggtaaaaccattgcccatattctactactgaatacaatcaatattatcatttttgtgttttcttctagcattacattaagtattataagtcgggaaaagaataatgttagcaacgagtaacaaggccgggcgtggtggctcatgccttcaatcctgacactttgggaggccgaggtgggcaggtcaccttaggtcaggagtttgagaccagcctgaccaaggtggtgaaaccccatctctactaaaaatacagaaattaaggccaggtgcggtggctcacgcctataatcccagcaatttgggaggccgaggtgggcggatcacctaaggtcaggagttccagaccagcctggccagcatggcgaaaccctgtctctactaaaaatataaaaattagccgggcatagtggcgggcacctgtaatcccagctactcaggaggctgaggcaggagaattgcttgaacctgggaggcggaggttgcagtgagccaagatggcatgatcgcactccagcctgggtgacaagagcaaaactccatcacacacacacaaaaaaaaccaattagccaggagtggtggtgggcgcctgtaatcccagctactcgggaggctgagacaggagaattgcttgaacccgtaaggccactccagtgttgcccactgcactctagcctgggcaacagagcaagactctgtctcaaaaaaaaataaaaataataaaaaataaaaatacaaaaattagctaggcgtggtggcatgtgcctgtaatcccagctacttgggagactgaggcaggagaatctcttgaacccgagaggtggaggttgcagtgagccgagatcacaccacagtactccagcctgggtgacagagtaagactcagtctcaaaaaaaagagtatcaaaatgatgaggcattgtctcattggttgccacagtattactttgaaaatcaagttacattaaatatttaaataagaaaaaaaaattttttttttttgagagggagtttcattcttgttgcccaggctggagtgcaatggtgcgatctcggctcaccgcaacctccgcctcctgggttcaagtgattctcctgcctcagcttcccgagtagctgggattacaggcatgcgccaccccacccagctaattttgtatttttagtagagatggggtttctccatgttggtcaggctggtctcgaactcctgacctcaggtgatcctcctgcctcaccctcccaaagtgctggcattacaggcgtgagccactgtgcccggcagaaaaaaatttttatttatttatttttttgagatggagtctcactctgtctgccaggctggagtgcagtggcacgatcttggctcactgcaacctccgctcccgggttcacgccattctcctgcctcagcctcccgagtagctgggactacaggcgcctgccaccacgcccggctaattttttttgtatttttagtagagacgaggtttcactgtgttagccaggatggtctcgatctcctgaccttgtgatccgcctgcctcagcctcccaaagtgctaggattacaggcatgagccactgcgcccggccccagaaaaaaaaaacttttaagagatagagtttactctgtcacacaggctggaatgcagaggtgcaggaggctacagctgcagcctcctggtctggaactacaggtgtgtaccaccacacctggctaatattttattttatttatttttgagacataagtctcactcttgctgaggctggagttctgttttccaggctggagtgcagtggaaggatcttggcccactgcagcttccgcctcccaggttcaagcgattcttgtgcctcagtctcctgagtagctgagattacaggcatgtgccaccacaaccagctaatttttgtattttcagtagatacagggttttcccatgttgcccaggctggtgtgaactcctgagctcaagtgatctgcctgccttggctcccaaagtgctgggattacaggtgtaagcgtccacgccttgcctacatttttttaacaactaaaaataattcacaatatgcccagtgtttttgtttctcctaaaagttttactgtggttttctgttacaaattcatggctaaaatcatgttggtcttgagaactggaaagaagttactgactttaaaccattaaatgtatctacttcgtgttaatacagctattgaagttagcagttttgtacttaggtgctagaggttaatgctattcactgaattaagtgtcttctattcctgaattagagctcatacttagtagaggtaactagaaataaatatttagttctcataaacagatgtccctggcatttgtctttaatcctgtataattttgggagaagagatgttaagattttaattctattttagtggttgtcctctggacttaaagcagttgttctaattcatttatgtcatcttcaaattaatttggattccactctcattgttagatattttgaaaataagggctgggcacggtggctcatgcctgtaatcccagcactttgggaggccaaggcacgcggatcacgaggccaggagtttgagaccatcctggccaacatggtgaacccctgtctctactaaaatacaaaaacattagccaggcgtggtgacgggcacatgtagtcccagctacatgggaggctgaggcaggagaatcccttgaacccaggaggtggaggttgctgtgagctgaaatcgcaccacttcactccagcctgggcaacagagtgagactccatctcaaaaaaaaagaaaagaaaagaaagtaaggtctttgctcctcataattttactttctttttttgtttgtttttttgagatggagtttcgctctgtcgcccaggctggagtgcagtggcacgattttggctcacagcaacctctgcctctcaggttcaaggaattccctgtctcagcctcccgagtagctgattacaggcatgtgctgattacaggcacgcgccaccacacccagctaattttttttgtatttttagtagagacggggtttccccatgttggccaggctgatctctgactcctgacctcgtgatccgcccgccttggcctcccaaagtgctgggattacaggcgtgagccaccgcacctggcctctttttctttaggtagttttgattttgataattttttttcattgtgtactgctccttagaggtttttaatgcagctctcacaactgctgaaatctttcagatggtatataattttataaacttcataaagaaccatcttttgctagaagttattttgctggagtaggttttgaaaaagccttgttatttgggcctttggcttaggtacaatgtaaggtgaaaaaagactctttccaaagactcatgtttcctttccctgaagttgcagctaaattacttgaaactatcgtatatgtaaaaacttggattttttatgttgttaataggctgtggttttaaattatttgttgtttagaaaattatttaaaattttggatattagttaaaatcatacagagattgtaataatcattctaattaaaatcttgttgatgaacttccttcttaggtattacatcaaataccaataacggatctatggtggtccacagtagttacgacgagattgaaggaggtggcttattgggtgagatgctatgaaagttttttttttaatctcttttttctgattatagaaataatatgtggtaattgtacaaatatataggaaactaagagggaaacttcataatcatgtagccatacatactattaacttatttatttatttatttggacacagggtctcactctgtcgctcaggctggagtgcagtggtgcgatcatggctcactgcagcctcagtctcctgggctcaagcagtcctcccacctcagcctcctgagtagctgggaccatagccacgtgtcaccatgcccagctttttgtttttgtttttgttttttgagactgagtctcgctctgttgcttaggctggagtgcagtggcagtatctcggttcactgcagcctctgcctcctgggttcaagtgattctcccacttaagcctcccagttagctggtattagaggcacccgccaccacaccctgctgatttttgtatttttagtagagacagggtttcaccatgttggccaggctgtcctctaactcctgacctcaagtgatctgcccgcctcggcctcccaaagtgctgggattataggcatgagccaccatgcccaggccctggctaatttttgtattttttgtagaggcagggtttcaccatgttacccaggctggtcttgaattcctgggctcaagcgatctgcccattttgcctcccaaagtgctgggataataggcatgtgccataacatctggctctattatttaacattttttatttctatgcattagattttttgttaagtttttcttctgtcagaattgggatcatggatttattattattatgttttgactatagagtacttttaggattttttttttttgagacagggtctctgtcacccaggctcaagtgcagtagcactgttatagctcactgtagcctcaaactcctgggctcgtgcgatcttctacctcaccctccctgagtagcagggactataggcatatggtaccatgccaggctagtttttttatttttgtagagatgggggggtgggtctcaatatattgcctgggctggtctcgaacccttggcttgaagagatccctcctgccttggttccccgatttgctgggattacaggtgtgaaccatctcacacggcccatttaggattttttttttttttttttttctgagatggattcttgctgtgtcgcccagattggagtgcagttgtgtgatcttggctcactgcaacctccaactccctggttcaagcgattctcctgcctcagcttcccgagtagctgggattacaggcacgtgccaccacgcccagttaatttttgtatttttagtagagatagggtttaaccacgttggccaggatagtctcgatctcctgaccttgtgatccacctacctcggcctcccaaagtgctgggattacaggtatgagccacctcgccctgccaggatgttataattaaagttgttttgaattaaaattttagtctgaatacaaaatttagtacatgatatgaaagtaaattaactgttcttttgttttgttgtttttgtttttgtttttgtttttgtttttgagacagtttccctctgtcgtccaggctggagtgcagtgggcacaatctcggctcacctccacctcctggattcaagcagttctaccacctcagcctctcaagtagctggaactacaggcacatgccaccacatctgggtaatttttgtactttttagtagtgatgggatttcactgtgttggccaggctggtctccaactcctgacctcaaagtgatccacccacctcagcctcccaaagtgctgggattacaggcatgagtcaccacacccagccgacatgaaagtaaattaactgtgcaaactagtttttgtgtctactactatagtataaaatattaactagtgtaaatccattaacaagatttttggccgggcacggtggctcatggcctgtaatcctatcttcgggaggccaaggcaggcagatcacctgaggtcaggagtttgagaccagtctgaccaacgtagtaaaaccccatctctactaaaaatacaaaaattaggtggtgtggtggcacacacctgtagtcccagctactcgagaggctgaagcaggaaaatcgcttgaacccgggaggtagaggttgcagtgagccaaggttgtgtcactgcattccagcctgggcgacagagtgagactccatctcgaaaaataaaatgataaataaaataaaataaatagattttagtcattgctatttgttactggtgtttgtcttattttaaaaatttgataaatgaaagtattaaattatccaaagaattttggagttataatacctataacttattagatttatgtgttgatttaaagcattctgggccaggcatggtggcctacgcctgtaatcccagcctggacaacatggtgaagtcccgtctctacaaaacatacaaaaacattagccgggcatgatggcacacaccagtcattccagctacttgggaggctgacacaggaggatcacttgaacctaggaggttaaggctgcagtgaggtgtgattgcaccactgcactgcagcctgggcaatagtgagaccctttctccaaaaaaaatgtttttttaaaataaataaatcaagtattctggagtataaaatagaacttaaaagttaccttgtttctagcaacaccacagcttactaacaagaatcccaaaatgagccgaagtgttggatattcatatccctccttaccacctggttatcagaacacaacaccacctggtgcaactggagtaccaccctcttccttgaattacccaagtgggccacaagcctttactcaggtaaactttttgggattttctttaacctatttctccatttggtttaaactgtatacacatgaagaaagttttaggaaggtatattatacatttttataaccatttagaataataatggatatttcataaagcctttgtctttatacatttttccagaaccaaaagattggccaagagatctagattacacttttgttatttacagagaaattaaccacttccctacacacttaataaaagttacttactttaaaattatgtatctgtagactcccttaggtgctaatcatttaaccacaagcatgagtggattaagtctacaaccagagggtctaagagttgtcaatcttcttcaagaaagaaacatgcttccgtcaacacctttgaagcctccagttccaaatttgcatgaagacatccagaaactcaactgtaacccagagtaaggcttcagatgtgacattatgcatgtccgaaaagttttctagctttttgcagggggcacatcaggtgttatgaataagctgtacaaattattaatttatgaaagttctggatacagatgatagaactcttttacttgtttacttaatagagatttgaaaagtcctacgtcaagaaatagggatgtaactcctgaagtgattttgttcttatcagctctaatgagattatgatattcattatcattatggtggttactttctttcttcaaaatccaaagtacagggatttgtttctacataatcctttatttgctctcatttaaaattaatttcataacaaacataatacctttttttcctaaaaacttaccataagcttaaatgtatatgatcaataatttctgataaattaaatttggtacctttaaattgtatttagaatcttcagcaaaactgaacttttaaataatagactttgcaatttgggccatcacctaagtttaatttaattccagtgtcaactagacttacaaaacaaaaaataagtcatttgatagtttagactgttttacacacaagccaaaaagagactatattttagttataggataaccatccactctatttctgcataggacttagatttaaatatttaaatgggataaaattttgagactctattgaaatatttcatctgtaatctgatccagtattaaaatgtataccttttaaatctttgttgttgttttcttcaaaaataatcatagcagcaactgatacatactttttactttgatataggttatttcgatgcacgctgactagcattcctcagacgcaggccttattgaataaagccaaacttcctttggggctgctgcttcatcctttcaaagacttagtggtatgtttcttttcttttctttttttttttttgagacggagtctccctctgtcgcccaggctggagtgcagtgacgcagtctcagcttattgcaacctctgccctccatgttcaagtgattttcctgcctcagcctccctagtagctgggattacaggtgcctgccaccgtgcctggctaatttttgtatttttagtagagagggggtttcaccatcttggccaggctggtcttgaactcctgacctcgtgatccacctgccttggcctcccaaagtgctggaattacaggcgtgagcctctgcgcccggctctttttttttttttttttttttttctgagactgggtctcactgtcgcccaggctggagtgtagtggcgagatctcggctcaccgcaatctccgcctcccaggttcgggcaattctcttgcctcagcttcctaagtagctggcattataggcatctgccaccacacccagctaatttttttatttttagtagagatggtgtttcaccatgttggccagactggtctcgaactgacctcaagtgatctgcccacctcccaaagtgctgggatttataggcctgagccactacacccggcctctttagtgaaggtaaatgtcttttgtgcaaaattatcttggtgatgaaaattttctgcaatgatgcaagaattacatatagaatttgtttgatctgtctttaggaagtcgatgattgacagattacttacaattcaaccaaaaattttattactaaacactttcaaatactaggtaaagtaagtatattgctggaaaattcaaaaagtactgaatagaatagaggtactgagagaaactaaataaatgaatcatactattttaataggttgtgaattatttacccattaaagtactttaccctagtctccccgttctgccatccttgcagtaaaatttgttattttaaaaagttgttttaagccagacatggtggctcatggcctgtaatcccagcacttttggaggccaaggtgggagaattgcttgggtctatgagttcaagaccagcttagtcctggctactcgggaggctaaggtgggaggatcacttgagcccaggaggttgaggctgcagtgagacatgattgtactactgcactccagcctgggtggcagagtgagaccctgtatccaaaaagaaaagttatttcagaagaaaaaagaaactgatctacctttgtcctaaagctctgtggccacatactcttgaggattgctgactttcccaaaacacactacttttggtgataggatttttttggtggtgatataattttattgcctgtattgatttttttttttttttttaagaagcagagtcttaactgcattgcccaggattgggtatgagatccttatcttaaaaaaaaaaaataaaggccaggtgcagtggctcacacctgtaatcctagcactttgggaggctgaggcgggcagatcacctgaggtcaggaattcaagaccagcctggccaacgtggtgaaactcgtctctaccagaaatagaaaatttagccaagcatggtgatgcacacctataatcccagctactggggaggctgaggcaagggaatcgcttgaacccgggaggtggaggttgcagtgagccaagatcccacactgtactccagtctgggcaatagagtgagactgtctcaaaaaaaaaaaaaaagataaataaaacctttctttaaagatgagatgctatgtcactttgttgtccaaggcactggctctcagttaagttgatcagtgttcacctgtctcagggtttctggtaaatcaaaacaaatctccccaaatctgatagtcttacaaagacccttcccacgtatttactgttatttatttatttatttattagagaccgggtctctcgttgtcacccaggttagagtgcagttccatgatcatagctcactgcagccttgaactcttgggctcaagcagtcctcctgcctcagcctccagacagagtaagtggtactgtaggcattggccactatacccagctaagactttagaacttttaatatgtaggataaactttaactaggagtgtaattccaaagtttaactggttatttaaattaacctcaccttactttattatagttgagaactaagtaagcttcttaatgtaacatcaacaaactttgtaatagtttcattggtcatatattttagaatgttgatttttttttctttgccatttatgccaaaagtacattgtaaatttaccatcttggttttatttttttaacttattatttatttatttaaaaactctttttttttggtagagatgggctgttgctgtgttgctcaggttggtctctacctcccagcctcaagtgatcctcctgctttggccttccaaagcactgggatatatatatatatatttttttaatttatttccaagatggagtcttgctctgttgcccaggctggagtacagtggtgtaatcttggctcactgcaacctctgcctcccagggttgaagcaattctcctgcctcagcctcctgagtagctgggattataggcacctgccactacgcctagctaatttttgtatttttagtatagacgaggtttcaccacgttggccaggctggtcttgaactcctgacctcgcgttccacccgccttggcctcccaaagtgctgggattacaggcatgagccaccacgcccagcctatttttatttttaaaatagagacagggtcttactttcttgcccaggttggtctcaaactcctggcctcaagtaatcttcctgccttggcctcccaccagagtgctgggattttagacataggtgttagccactgtgcctggcctgctattttggttttgcaatatgagtgtttaatgaggaaaaaaatggtttttacatttttattttattttattttttgagactgggtcttgctctgttgcccatgttggagtgcagtggctcagtcatggctcactgcagccttgacctcccaggctcaagtgatgctcccacttcaacccagctcaccacactgggctaattttttaaatcttttgagagggtcatgtttcactatgttgcccaggccggtctcaaactcctggcctcaagcaatccttccgccttggctcccaaagtgctggagttacacatgtgagccactgtccccagccaataatttttttttttaagacaacttttaatgagaatggtcttggagcaaaatagtagggtttaaaattaatacatttcaactacatggtttttgtgtatggcagtttagatacatcttgtactctaagttttctctaaaatgataatatcccaacagttatttagacaggatggattcatgcttatgttttcaacatgatgatttttgcctttaaaaatttaattctgtttttttttttccagcaattgcctgtggttacctccagtacaattgtgagatgccgttcatgcaggacgtacatcaatcctttcgtcagctttcttgatcaaaggagatggaagtgtaacttatgttatcgagtcaatgatggtatgggatgcttttttgaaacatttaaacgtttctacttgcattgtagggaaatcagatgatacaaatgcacagttaaaaaaaaaaaacccttttatttacctctagtcaatccttccactcagagaaaactacaggtaacttttttctgtgcgtttatatttataaataaatttaattatttattttttaagcaaaaaataatgatagtattacatggatatcccatttttacattgtattgggtatataataagtggtatatttcatggtattacttaagccaggaatttaagaaacatttttatttagaaattgtcccacgccttttctctagggtgaaagaaaataagtccacagaatagctgcccaattcattcactgctgaatgaagggaagtaggcagtgctagaaggttagttgaatgtagttttctcagtaattgaggaggaggagatttctctcaataactatgtcacagtttttatttgaggactataatgtaatcaacagggttctgttagtattagagaaggaagtgggtatgccagtatccacagtgtctatttgaaagatttgagaaatagaggaatataagagttttgtttttgtttttgtttttgagatggagtctcactctgttgcccaggcttgagtgcagtggcacgatcttggctcactgcaacctccgcctcccaggttcaagcgattctcctgcctcagcctcctgagtagctggaattacaggcatccaccaccacggccggctaatttttatatttttagtaggggtggagtttcaccgttttggccaggctggtctagaactcctgacctcaagtgatctgcccacctcaggctcccaaagtgctgggattaacaggcatgagccactgcacccggccaagagtttgtttttgtttgtttgtttttgagacagagtctggctctgtcgccaggctggagtgtagtggcatgatctcagctcactgaaacctctctgcctcccaggttcaagcaattctcctgcctcagcctcccgagaacacacccagccctggccaagagtttttaaaaaccagttttattggatgggcacggtggcttacgcctctaatctcagcactttgggaggccgaggcggtggatcacctgaggtcaggagttcgagatcagtgtggccaacacagtgaaaccccatctttactaaaaatacaataattagccgggtgtggtggcgggcacctataatcccagctactcgggaggctgaggcaggagaatcgcttgaacccaggaagcaaaggtttcagtgagccgaaatcgagtcattgcactccagcctgggcgacagagcgagactctgtctcaaaaacaaacaaaacagagccaggtgcagtggctcatgcctgtaatcccaacactttgggaggctgaggtgggtggatcacctaaggtcaggagtttgagaccagcctggccaatgtagtgaaaccccatctttactaaaaatataaaaaaattagctgggtgtggtggcgggcacctgtaatcccagctactcgggaggctgaggcaggagaatcgcttgaacccgggaggcggaggttgcagtgaaccgagattgcaccattgcactccagccttggcaacaagagcaaaactccatctcaaacaaacaaataaaacaaaacaaaaaaacagttttattgtttgtgtgtgtgtgtgtgtgtgtgtgtgtgtgtgtgtgttttgagtatagaaaagtaaggataggctaagaactttctcttgcactgtaacaattctgaaaatgtacatgaagtatttagttacctttaaaatttttatgtgtaggtgctttaatatacaaaatgaaattataataaaagttgaagcccctttcatctgcaaaccaggctatttcctgaactatagcttaacctttagagtgcatagggatttgaatttctaaacaattagtaggaagacagatacaatgataattaatttagaaaatactctttgaccactagtgtattataagtggtaggtatgatgttaggttaagtgatgttccataaagttctcattaattaatgaaacttactaaaccttatgaccttgacctctgaaattgtcttaccatagcttctagtgccagctagtgtctgtacatttcatatgtgaaatgttaatatccttgtataattgggaagtttaagaaaataggccgggtgtggtggctcacatctgtaatcccagcactttgggaggccaaggcgggcggatcacctgaggttgggagttcgagaccagcctgaccaacatggagaaaccccgtctgtactaaaaatacaaaaaattagccgggcgtggtggcgcatgcctgtaatcctagctactcgggaggctgaggcaggagaatcgcttgaacctaggaggtggaggttgcagtgagctgacattgcaccactgcactccagcctgggcaacagagtgaaactctgtctcaaaaaaaaaaaagaaaataattgacatttaatgaatgtttgtcatcttttcaaggaagaaagtggccaaatgcaaaatacattaaattcttttcagttttttcaatatgtgtattgttaactttatatagttcctgaagaattcttgtacaaccctttgaccagagtttatggagaacctcacagaagaccagaagttcaaaatgctactattgagtttatggctccttcagaatacatggtaaacttttattttttgatacagtatacccattttttattaccaggttttaagtaaaacaatacagcatcctgtaacaaaattttattttattttattttgagacagagtttcactctcattgcccatgctggagtgcagtggtgcagtggcaggttcaaggctcactgcagcctcgacctcccgtgctcaagtgatcctcccacctcagcctcctgagtagctggggctataggcacgcaccaccacacctggcttatttttattagagacagagttttgctatgttgcccaggctggtctcgaattcctgggctcgagtgatctgcccaccttggcctcccaaagtgctgggattacaggtgtgagccgctgtgcccagccaaaattttatgtttttaaatgtgtaaaagtgtaatacttgtttattactaaagtaattaatatataagggtatatttgaaaggtaaaagtttatgtaaagtcccatttaagtgtcttatgtgacattcagaaatttccaatatgatattgggctcgtatttactttttttttttgagacggagtctcactctgtcacccaggctggagtgcagtgctgtgatcttggctcactgcaacctccgcctcccgggttcaagcaattctcctgcctcagcctcctgagtagctgggattataggcgcgagccaacacctggctaatttttgagtttttaatagagacggggtttcaccatgttggtcaggctggtctcaaactcctgaccttgtgatcctcccacctcggcctcccagagtgctgggattacaggcatgagccaccgtgcccggccagctcatatttacttataagttacagtcagtttttttttccctattgcttcatttttccttcatacaaattttttttctattagaaataatgctgtgatgaagatcctcttgcaaatattgttcttttctacacccgtgagaatatctgaggtcttgcattttaaaactaattactatgcctaatttttttgtttaacgtttatttcttttagagaggagggtcttactttgttgctgaagctaaagtgcagtggcactatcatagctcactgtagcctcaacttcatgggctcaagcaattctcctgcctcagcctcccaagtagctgggactacagacatgcaccaccatgccctgctaattttttaaaagttttttagagacagagtctcactatgttgcttaggctgcttgtgaatgcctaatgtttaattagcactttacattttataaagcacgtacacttttgatcagcacaaacagtattctgaagcaagctagaaaaatgctgttaatcctcttttacagatatgaaaacagacttaggttaagtgacatgccaaatttcacttagtagtagaacttgcataataatttaggccttttgatttggttactctttcaccatgccataattatctcttgggaaaagggaatatgaagataactctcaacactaccttttaatattttagtgtattttggctgggcacagtgcctcctgcctgtaatcccagcactttgggatgccaagccagacggattatgaggtcaggagttcgagaccagcctggccaacatggtaaaaccccgtctctactaaaaatacaaaaattagccgggcctggtggtgagtgcctgtaatcccagctacttgggaggcttaggcaggaaaaatgcttgaaaccgaaagtcagaggttgcagtgagccaaggttgcgccaccacaccccagcctgggcaaaagagcgaaactccatctcaaaaaaaaaaaaaaaaaattaatatatttttgtgtctttatctgggcagttgggtccatttttctgtaaacttatgaggaaccagtctccttaccacagaaaagcttctatatagaaaacattttgttggccaggtgcagtggctcacacccgtaatcccagcaatttgggaggccaaggtgggcggatgactggaggtcaggagttcgacaccagccttaccaacatggtgaaaccccatctctattaaaaatacaaaagttagccagatgtggtgacatacgcctgtaatcccagctacttgggagactgaggcaggagaattgcttgaaccagggaggcagaggttgcagtgagccgagattgcgccactgcactccagcctgggcaaccgtgcgagactccatctcaaaaaacaaaaaagaaaaagaaaacattttgttgcacttaagtggttggtaatagccatctacagagtagatgttcctttattggattaaaacaaaaaaaaccagaagcacttgttcttttaaatttaccttcctagtttccctttatcacccacactttgcaaaaattgcttcctttaaatttagaaactttcctatagcagaaggtgtttgctcctttctatctcttgaggggcaggttgtgtggatttggcaagtgatacatgcaaaaatatataaaagtacagttgactctgtatccatgagttctgcatccgtggattcaactacccatggatcgaaaatgttcagaaaaacacagtaaaaaatattataggacagacatggtggctcacacctataatcccagcactttgggaagccgatgcaggaggattgcttgaagccaacagttcgagaccagcctgggcaatgtagcgagacccaagtctctgcaaaaaatttcaggaattgtggtgtgtgcttatagtcccaggtacttgggaggctgaggtggaaggatcgcttgagcccaggagttcaaggctgcagtgagctgtgattgcattgcatcactgcactccagcctgagtgacagagcaacaccttctctctaaaaaaaaaaaaataataatacaaattttaatatacagtatagcaactatttacatagcatttatgttgtattaggtattattttaaaaatctagagatgatttaaagtatacaaaaggatgtgcataggttatatgcaaataatacactattgtatgtaagggaattgagcatccttagattttggtattcgaggtgggagatcctggaactaatctcttgcagataccaagggaagattgtatactacatacccagttctgactgtggctatttgatgctttttactgaattgagaacaaatctttggatttggaagtttaaaatacagtcttggccaggtgcagtggctcacacctgtaatcccagcactttgggaggcagcgaaggcgggcggatcacatgagatcaggagttcaagaccagcctggccaaaatggtgaaaccctgtctctactaaaaaaatacaaaaattagccgggcgtggtggcgcgtgcctgtaatcccagctactcaggaggctgaggcaggagaatctcttgaacccaggaggcagaggttgcagtgagctgagatcacaccactgctctccagcatgggggacacagcgagactccatctcaaagtaaaaaaaaaaatacagtcttatgtttttatgagatttggctgtaatttgttgtttaaataaccagctgaagctaacttgtaactttcagagctataatttccctaaattgtgaaatccaacaaacatattgaaaaatcaataaaacacaaaatattcagattaccaaatcattataaactaaacacttttgttagtataacccaagccaagcagttgaaccttgctaatactcccagaatcccttctttttttttttttgagatggagtctcactttgtcgcccaggctagagtgcagtggcataatctcggctcactgcaacctccatctctcaggttcaagtgatcctcctgcctcagcctcccgagagtagctgggactacaagcgcctgccaccacatctgactaatttttgtatttttagtagagacggggtttcgccatgttggtcacgctggtctcgaactcctgacctcaggtgatctgcccgccttggcctcccaaagtgctgggattacaggcatgagccaccacgcccagccacaggcccttctgattacatctcttccccttcctgttctagagaaaacactcttctgaattacggcaatcacagactcatttttcctttaagtgtacatctataaacaatatagtatagctttgcctgtttattataatctctactcaatctgtaaataatgctttttaaattgttttgctgtatgtgtacccagcaaataagtttaaacttaatcctgttaaatgtacttaacaagatctttttttcttcagttacgaccacctcagcctccagtgtatctctttgtatttgatgtgtctcacaatgcagtcgaaactggatacttgaattcagtttgccagagtttgttagacaatctggatttgtaagtttctcaattcagcttaaatatgaaactaataatattttctaaatgaataagtagtttttgaaattaaaaaataaaagctgtataattatgttctaaaactccacccaaatcagttgttaatttaggcctcactttctcttcgaaacattatttttaaatctatagttggtaggaagaataatgtaatgaacttccagtcacctgtcacccagattcatcatcttcagcattttgctatttttgcttaatctcatccttcccctttcatgcacataccttttcccaccttgagtatttgaaagcaaatttcagccagcatactgttttacctatacgtacttcaagactaacttttatacctaactataatactaaagtattaaggaaaattagcagtaattccacatatgatctaatacctagtttattttttgttcctagttgtctcaaaaatgcctttttactgtcagtttattggagtaagaatttaaacagtatacacacattgcatttggttatcaagtgtcttaagtctcttaaaataactatttccagtggtgcttagagacctagtgtaacccatcaaagctaatgtgacctttctatgtaatgaagtatagtgcttgtgtgtggtgtggaggcatatagaaggccaaatttcatcacgagtggagtaactccttcactttggtgaaaagctcattcttgttcctgccagcatttgtatttttaatgttgtagattgtgaatggggattgtgaattgatgagattgtcactgactcacccatgcatgaacaagagtgaaaaacagtttgttcttccccttatataattgtagttccacatatttgtagttctttaaaatagatgcttttgcttttctttgttcttaaatattagagtttctgtatcataatattttgaagcatgctttataacttaaaatcatctgcaaaatttcattaatacttttcagtatttttaacatactgtttcctaagtgattatatgtagctttacatagctatacttggttttggattgttgtattattgctgttttttgtttattgtttggcttacatgtagtgttttccctttgagtcagatatgttttcatggtaaacgttgggtggtttaaacatttgtttgtgttgggccaatttctataatattgaattagatattttcatgtaactcttaggacatattttatgtgtatttgtatgtggttaaaacttgataaaatactcttctgaatttgtttttaggcttcctggcaacactagaacaaaaattggcttcataacatttgacagtacaatccatttctacggtcttcaggaaagtctctctcaacctcagatgctaatagtttcagatattgaaggtatagatttattgaactactttcataatttttcagttttagaaatatttcttgattacttgacaaattggatgtgtgttgtttgtagtatgtcaaggaaaatcttgagtataaaatcatgattgttggagttgtaagagtctttcagttcaatctctcattttatggaggaggaaatgggggttatggagacaacccgctgaacaagttaacaaaaacaagttaatgttagaactcagatcaaatttaggctttttttcccccttcttcccatttattcattcaaaaagtatttgaggatagacatatagagcaaggaaatagaattgagagctcagaataaagcctagcatatatagtcaattgattttatttatttatttatttatttatttattgagatggagtctcactctgtcgcccaggctgtagtgcagtggcacgatcttggcttactgcagcctatgcctcccggtttcaagcaattctcctgcctcagcctcccgagtagctgggacaacaggcatgcaacaccatgcccagctaatttttgtatttttagtagagatgaggtttcaccatgttggccaggctggtctcaaactcctgacctcaagtgatctgcctctcttggccccacaaagtactgggattacaggcatgagccaccacccacagccagttaagtgatttttgacaaaggtgcctagaacaatcagtgggagaagagacagttttttcaacaaatagttgtggcaatactgcctatgtaagagaatgaggttggacctttactttataccatgtaaagaaaattaacttgaaatggactaaagacctaaacttaagagctataagtataaaacaggggcaaatatttatgccactagatgtggaaacattagaaccctggtgcactgctggtcagaatgtaaaatggcataactgctgtggaaaataccttggcaattcctcaaagttaatggtgaattatcacattatgtagcaattccaccgttcaatatatactccaaaaaatcgaaagcagagactcaagcggatgcttgtacatcattgtttatagcaatagcaatcattcacaatagccaaaaggtggaaacaccccaagtagccatcaacagatgaatagataaataaaatgtggtataaacgtataatggggccgagtgcggtggctcacgcctgtaatcccagcacttcaggaggccgaggcgggtggatcacgaggtcaagagatcaagaccatcctggccaacatggtgaaaccccgtctctactaaaaatacaaaaattagttgggcgtggtggtgcgtacctgtagtcccagctactcgggaggctgaggcaggagaatggcgtgaactcgggaggaggcggagcttgcagcaagccgagatcgtgccaccgcactccagcctggacgacagagtgagactccatctcaagaaaaaaaaaaaaaacgtataatggaatatttattattcagccttaaaaaaacaatgaaattctcacacgtgctacaatgtggatgaacctggaaaacatgctaagtgaaataagcaagacacaaaccgacaaatattgtatggttccacttatatatagtacctagaataggcaaattcatagagacagaaaatggaatagaggttaccaggggctggggggggagggcgattaatagggagttgtcataattattacattttttttttgagatggagtttcacttttgttgcccaagctggagcgcaatggcgccatctcggctcgctgcaacctccacctcccaggttcaagtgattttcctacctcagcctcctgagtagctgggattataggtgcgtgccaccacgcccagctaattttttgtatttttagtagaaacaaggtcttaccgtgttagccaggctggtcttgaactcctgacctcaggtgatctgcccgcctctgcctcccaaagtgctgggattacaggtgtgagtcactgtgcctggctattactatttttttaaagacagagactcttgttgcccatgttgcagtgcaatggtgcaatcatagcttgctgcagccttgaagccctgggctcaagcgatccttccacctcggcttttcaagtagctggaaatacaggcacacgctaccacgcccagctaatttttaaaatttcttgtagaggcaaggtcttgctaagttgcacaggctggtctcaaactcctggccttaggcagtcctttcgcctcatcctcccaaagtgttgagagtataggcatgggccaccacacctggccaggccttatttttttgtaatcagaaacaaaatatagaaatctagaaagtgattatccttgtaatcctccaccactctcttcccagtttgctccctttctaaggaagaattcctaagcaattattgaataaatgtgaatcctgagaggctcatctgaagtggtcaggtagcataccttctgattcacttgattttgcagtcccattaattttgtttgttcgttttgttttgtgtttttggagacagagtcttgctttgttgcccaggctgcagtgcagtggcgcgatctcagctcactggctcactggctcactgcagtctctgcctcccaggttcaagcgattctcatgcctcagccttccgagtagctgggattacaggcatgtgccattatgcctagctaatttttgtggtttttagtaaataatggggtttcactatgttggccaatctggtctcaaactcctggcctcaagtgaactgcccacctcggcctcccaaagtgctgggattatagcaggcatgaaccaccatgcccggcctccatagtcccattctttttttttttttttttgagaaggagtcttgctctgtcacccaggctggagtgcagtggcgcgatcttggtggctcactgcaaactctgcctcctgggttcaagcaattctctgcctcagcctcccgagtagttgggcttacaggtgcccaccacgcctggctactttttatatttttagtagagacagggtttcaccatcttggccaggctggtcttgaactcctgacctcatgatccacctgcctcagcctcccaaagtgctgggattacaggcacgagccaccgcacccagcccatagtccctttttaaaggcactggtgtgggccttctttttttttttttttgagacgagtcttgattgatctgtcacccaggctggagtgcagtggcactatctcggctcactgcaacctccgcctcccgggttcaagtgattctcctgcctcagcctcccgagtagctgggactacaggtgcccaccaccacgcctggctaactttttgtatttttactagagacagggtttcaccacattgctcctgaccttgtgatccgcccgcgtcggcctcccaaagtactgggattacaggcatgagccaccgtgcccggccgaccttctttatgagaaagcatctgctttgtgaatgacagagctattggtgagctgtattgcttccttatgaagacagcattcttgtgtgtcatgttagtcaaaaaaatttcttaatgccaagagtgtatctttggctggcttccagggccagccatttaaaaaaaaaaaaaaaggtcaaagcagaattgtaaattattatctttagcctaagaagcatagcacttacacaaattcagtgagtacagatcaatattttattttttttctttccttttttttttttttttttggagacagggtctcaacctccccactagcctgggagtgcagtggtgcaatcttggctcactgcagcctcagcctcccgggctcaaggaatcctcccacatagctgggactataggcatgtaccaccatgcctggctcatttttgtactttttgtaaagacagggttttactgtgttgcccaggctggtctcaaactcctgagttcaagtcattcacttacctcagcctctcaaagtgctgggattacaggcgtgtactactgcacctggcccagataaatattttctaattgggaggctgtaccttttacaaggtagcagacaagaagcagaaaatttgcagtagatacctgtatcattgtggtggttttttggtggttctttggacacatgtaaacagtgctataatagtggaggaggtggcttatttttaaggaagggggtggttaattgcattagtgttatatatttggcacacttttaattattacattttgtttaaaataaatatgtatttcttctttcagatgtttttatacctatgccagagaacttattagtaaacttaaatgaaagtaaagaggtaaggcacattttcctacctgacatgtttaattgaaatattgaaggaatatgtttttgaaatgaactttaagtaaaattttgattatttctgtgacatttctaagatgtgtagcattttatatttgctcttataattagatgaacagctcttgagttcaaccttgagctgatcatttttaagtctaatgaagcaagttatttgtagtagggtagaaaataagcatattccataaaggaggaacacttgaaggaaatctgtcttgtcagccatttgggaagttgggagggttgctgagataaagcttctggtcactacatagaagcacattaggtaggctgctttcagtgccctttgcttttctgattcacagagtgtcattggggtcagttcagaagaaactcttattacctgcctggaaattgccatgagataatacagtgagaggtgaacagaatgtgtctgaaggggggatgttgtctaccctgtacatgcatatatgccgtaggggtaacattttaactagcaagtctatggtctctgctgttggcaatggtgactgtgccatagtgcgaagtatttttttccccattaactctatttgtacaacctaacctgtaaaggtagttgtttttcttttgtagtgatattactagttggcaaagttactggatatcttagatttgcaacagggaagagctaaactcgctttggaacttacaagaataaagtatgtagaggtgatggagaaggccatatttcatggcattaaaatacatcaaatctctaaactgtgatggttcttttggatacattttggacttatagtcttgctggactactgcatgtgcaagaactgtaaggcccaactttgatttgtcttgcttgccaatttataatgttgacttaaaatggctttcttgtcatttgaccaacttcattgtttagtgtctgtagattctctgaccatcatcatgactcaatgtcttgtctattgtatgagatactgacttaatgtgaaataaaattttaattatgacacttgagttttcttgctttgttttacaagctcgtgcaagatttactgaaaactttgccacaaatgtttaccaagactctggagacccagagtgccttgggtcctgcactgcaggctgcctttaagctgatgtctccaactggtggtcgaatgtctgtctttcaaacacaactcccaactcttggagtgggagccctgaaaccacgagaggaaccaaaccacaggtcatctgctaaggttagagagtcatgaaatgtctgataaggtttatgctggtgttccatccctgtgaccatagaacttgttttttctttaaatttatttgtcaattgttgggaggagggactataaggaagttaacttttatgtagacatttttattttgttacatttttctctacctgattcacccttccttaatttttagtatctttagcaggccactagcaattcagcctgccttcagagagatagtctgggagactaacagaatatgcttgatagggacaaagagaacctgattgaccagttaagaatagtcttatttggctgggcgtggtagctcacacctgtaatcccaacatcttgggaggccgagttgggcagttcatctgaggttgggagtttgagaccagcctgaccaacatggagaaaccccatctctactaaaaatacaaaattggctgggcgcggtggctcacgcttgtaatcccagcactttgggaggctgaggcgggcggatcacgaggtcaggagatcgagaccacggtgaaaccccatctctactaaaaatataaaaaattagccgggtgtggtggcgggcgctgtaatcccagctacttggagaggctgaggcaggagaatggcgtgaacccgggaggcggagcttgcagtgagctgagattgcggcactgcactccagcactccagcctgggtgacagagcgagactccgtctcaaaaaaaaaaaaaaattagctgggtgtggtggcacatgcttgtaatcccagctactcaggaggctgaggcaggagaattgcttgaacctgggaggcggaggttgcagtgagccaagatcgcaccattgcactccagcctgtgcaacaagagcaaaactccgtctcaaaaaaaaaaaaaaaagaaaagaaaaagagtagttgtatttggtacattgatggccaaggtgcttatgtgcaccttgtgtgcataaactttaaggtttttgagacccgtatttcccaaaagattatgaaagagagacctgtgtactatactgggtatggtatcattcctggagtcagactgcctagtctcactgtttattacacttgggaacttgaaaaattaatttctttgcccctttgtttctttatatataaggtgaaaataaagggtcaagtgtggtggcttgtgcctataatcccagccctttgggaggctgagatggaagcatcggttgagctcaggagtttgagaccaatctgggcaacatagtgagaccctgtccctacaaaaatacaaaaaaaattagccaggtgtgatgctgagagcctatagtcctagctactctggaggctgaggtgagaggatcacttgagcccaggaggctgcagtgagatcgtgccactacactccaacttgggaaacaacaacaacaacaacaacaaaaaagatggctgggtgtggtggttcatgcctgtaagaccagtgctttgggaggctgaggcaggcggataacctgaggtcaggagttcgagaccagcctggccaacacgacgaaaccccatctctattaaaaatacaaaaattggccgggcatggtggctcacgcctgtaattccagcactttgggaggccaaggtgggtggatcacgagttcaggtgttcgagactagcctgaccaacatggtgaaaccctgtctctactaaaaatacaaaaattaaccgggcgtggtggcacacacctgtaatcccagctactcaggaggctgaggcaggagaattgcttgaacctgggaggttgcagtgagctgagattgtgccactgcactccagcctgagcgacagagtgagactccgtctcaaaacaacaacaacaaaaaacaaaaattagctgggggtggcggtgtgcacctgtagtcccagctacttgggaggctgaggcatgagaattgcttgaacccgggaggcagtgagctgagatcacgccactgcactccagcctgggtgacagagtgagactctgtctcaaaaaaaaaaaaaaaaagaaagaaagaaaataatgatagtggccaggtgtggtggctcacacctgtaatcccagcactttgggaggccgaggcaggcggatcatctaactttgggaattcgagaccagcctgaacaacatgatgaaatcccgtctctactaaaaatacaaaaaacattagctgggcatggtggtgcatgcctgtaatcccagctactcgggaggctgaggcaggagaatcgctagaaaccgggaggcagaggttgcggtgagctgagatcatgccattgcacaccagcctgggcaactacagcaaaactcccatctcaaaaaaaaagaaaaagaaaaaaagaaaatgatagcacttacctcttagggtagttgaaaggactaagtaagtattacatatgaattgtttagaacagtttccagcatactgaacatttaatatattttagttacaataaaaaaatctttaccaactatgaaattattatagtagatatatttctttttaaaaataaagggaaaaaaacctacagaaaatttttaaaaaacatatatatattttttcagacggagtctcgctctgttgcccaggctggagtgcagtggtgcgatctcagctcactgcaagctccgcctcctgggttcatgccattctcctgcctcagcctcccgagtagctgggactacaggcacctgcaaccatgcctggctaattttttgtatttttagtagagacggggtttcaccatgttagccaggatggtctcgatctccggccctcgtgatccacccacctcggcctcccaaagtgctgggattacaggcgtgagccaccgcacccggccatttttttttttttttaaataaataaagtcatgttgcccaggatggtctcaaactcctgggctcaagcagtccacccgccttggcttcccaaagtgctaggattacaggtgtgagccaccacacctggctggaacttacagaaaattcctaagcagtacttgcttcttaatgaaaaatcaagtagtaccacaaaggaaaaggactttgtagaatgcccagaaataattgcaattgttgttaacatcatgatgtatgtagatgtgtatttagattttatgacaatgtaatgattttttaaaatgtctctttataatttattataaataggatatacacatgacaccatccactgacttctataagaaattagccttggactgttctggtcagcaagttgctgttgacttattccttctcagtggacagtattctgatttggcttctctgggtaagttcttcgtaatgattttttttttccgttaaatgaatatcaaaatggtccttatatgatagtgttctaaatatagaacaaagttaaagaatatgtatgcccttgggaaagttaatcagtcagtttagtctattaaaaaccttatagtcttctactctaaacatttagtaatagagaaatttctattctactatttaaaggaatgcaggccgggtatgatggctcatgcctgtaatcctaacaatttgtgaggcctgtgcaggaggattgcttgagcccaggagtttgagaccaacctgggcaacataggaagaccctgtatttgcaaataatatgtatatttttttaaataaaaaactagccagacatggtggcgcacacctgtggtcccagctgcctggaaggctgaggtgggaagagtgcttgaggtggagaggtcaaggctgcagtgagccccatggtatcactactgcactccagcctgggtgacagaatgggactctgtctcaaaaaaagggaataaaatctcctttctgacagtagtttaccttggaaagttaaagaaagattgattccaatgtctttagttactttggtgtagtagaaatagttaacggcacagtttaaaacagtgtgtgttctcttccaggttgtatttctcggtattcagcaggtagtgtctattactatccctcttaccatcatcagcacaacccagtccaagtacagaaattacagaaggaactacagagataccttactcggaagattggctttgaggcagtcatgaggattcggtgcaccaaaggtaggaatattttttttttgcgtaggactgaataatatttttggtttcagtaaatgtacatgtttttatctggtcttataagattgcccttctgagatactttgcctactctggaatatgcaattaagaggagagaagaaacactgtaaccaaaaaaagggggcctattgagaatatactcaaaagcactgacttatatatttttaaatagagaattttatggtgtgtgaattatctcagttttttaaaaaagaccttatctccggctgggcacagtggctcatgcctgtaattccagcactttgggaggccaaggctggtggatcgcttgagcccaggaattagagacgagcctggacaacattgcaaaatgatgtctctacgaaaaatacaaaaacttagctgagcgtggtggtgcacgtctgtagtcccagcttcttaggaggctgaggtgggaggattgttggggcctggcctgggagtcaggttgcagtgagcagagatcacaccactgcactccggcctgggcaacactgtctccaaaaaaaaaaaaaagaagaagatagagtcttgtttttttttttttttttttgagatggtatattgctctgttgcccaggctggtgtgcagtgacacaatcttggctaactgcaacctccacctctcgagttcaagtgattctccctgcttcagcctcccgagtagctgggattataggtgcgtgccaccatgcccggctaatttttgtatttttagtagagacagggttacaccatgttggccaggctggtctcaaactcctgacctcagatgatctgcccacctcagcctcccaaggcactgggattacaggtgtgagtgaccgcacacagcctagacccttttttgacagagtctcattctgtcgcccaggctggagtgcagtggtgcaatcacagctcactggagtctccacctccctgactcaagtgatcctcccacctcagctttcctagtagctgagactgcaggtgtgagccaccacacctggctaattttttattttttattttgtagagactgggtctccctatgttgcccaggctggttgcaagctcgtgggctcacgtgatcttcctgccttagcctcccaaagtgttaggattacaggcatgagccaccacacccagccacagatcttgcttttaaacttttttttttttacttgtaaaatatatataacataagctttaccattttatcctttttttttttttgagacggactgtctcgctctgtcgtccaggctggagtgcagtggcacgatctcagctcactgcaagctccgcctcctgggttcatgccattctcctgcctcagcctcccaagtagctgggactacaggcgcctgccaccatgcccagctaattttttgtattttttagtagagacggggtttcaccatgttagccaggatggtctcgatctcctgatctggtgatccgtccgcctcggcctcccaaagtgctgggattacaggcatgagctaccgcacctggcccattttatccattttttaattgtacagtggcatcaagtatgttttcactgtgcaactatttatttccaaaagtgggggatctcttagtttgtactctctttttttttttttttttttttgagccagagtttcactctctcgcccaggctggagtataatggtgtgatctaggctcactgcaacctccatctcccaggttcaagcaattctgcctgcctcagcctcctgagtaactgggattacaggtgcctgacactacgcctgactaatttttgtatttttagtagaaacggggttttgccatgttggccaggctggtctcaaactcctgacctcaggtgatccgcctaccttggcctccctaaatgctgggattacaggtatgagccaccgcacccagcctgtactcttatttttagtttttcatttctccacattatcaacctggtgggttttttttttaaggtgggtttttttttccattgctgctgcacaaattgagtttttatttaaataaatattattgctctgtaagggggtgtggagcacagattgagtttttatttaaataaatattgctctgtaatggggtgtagagtggtaattttctttcttcttctctctcttttttctttttttggagacagagtgttgctctgtccccctggctggagtgcagtggcatgatcatagctcactgcagcctcaactcctgggctcaagcaatcctcttagctcagcctcccgaataactgggaccacaggcgcatgccaccacgcctagctaatttttaatttttctgtagagacagggtcttactttgttacacaggctggtttcaaactcctggacttaagcaatcctacacctcagcctcccaaagtgctgggattacaggtgtgaatcaccacgcccagtataataatattcttttcaatggaaaaattatttatatgaaatctataacaaaaaaaaaaagataaagatccactaacctgttccattacacattgaaatctgttggtcaaaccatgagcaagatgaaggtctctcttatctatccttcactataattagaatttattaattctaatagtttttatttatttattttttttactttatttttttttttctgagaccacatcttgctcttttgtccaggctggagttcagtggcacgatctccgctcactgcaagctccgcctcctgggttcacgccattctcctgcctcaccctcccaagtagctggaactacaggcgcctgctaccactcccagctaattttttgtatttttggtagagacagggtttcaccatgttagccaggatggtcttgatctcctgacctcgtgatccatccgcctcggcctcccaaagtgctgggattacaggcgtgagccaccgcgcctggactgtatttttagtagaggtggtgtttcgccatgttggccaggctggtctcgaactcctgatgtcaagtgatccacccgcctcggcctcccaaagtgctgggattacaggcatgagctaccatgcctggcctagtttttattttataatttttaattaaaatatggaacacttcacgaatttacgtgtcatccttgcactggggccatgctaatcttctctgtatggttctaattttagtatacatgctgtcgaagtgagtacctaatagttttttagtgtttatgttttaaagggtatatttgttggatcccattcattggagactgacagacctcaaaaatgtttatttctgcagatacctgttataaattaagggaagtgtacatcctaatgtgcttttaagaccttttctacttgtcaagacagaggctatttttatatgtaccttattttgcataaacagctttgggatatgccaggcaactcctttgccctctttttttttttttttgagacggagtctcggtctgtcgtccaggctggagtgtaatggcgcagtctcggctcactgcaaccttcgcctcccggggtccagtgattctcctgcctcagccttcctagtagctgggattacaggcacgtgctaccatgcccagctaatttttgtatttttagtagagacggagtttcaccatgtcggtgaggctggtctcgaactcctgacctcatgatctgcctgccttgtcctcccaaagtgctgggattacaggtgtgagccactgcagcccaccaccctctttctagagtgcttaatttaataaagctttgtggttagcttgcttaggtttctctttttattttattatgataaattcactacagatcaaatacatactctagaaaagttaacacagaaaagataatgtacaaaaagatataaaatgagaactcaagcataacttctgttccactctacagttaatcatatacccttcagaaactttcccatggcatttataaacatatattttggccttaacttcaaataaaagcagtgaggaattatacctggcttttttatttttatcacaatatcttgaaaacctttctatttttatacgtacagacacacattctcctttttctttctttctttattaatgttgtatatttctttttaagagacagggtctcactatgttgcccaggcttgctttcaactcttgggcttaagcaatcttcctgcttcagcctcctgaatacctgggattacaggcacatgccaccatgcccagcattctttttcatcctgattactgtttttaagttggtttttatttcacaagcaacatgtgcatctgtttttcttgtaaaaaataaaaacattattgataaagctaaagtcttcctgtatcagcttgcatgtgtatgcgacacatacactttcacttcatttttatgtagttaaaaatggtatgtatcagaatttcttattaaaaatggtatatatcacttggtatataccgaatttcctatacatttgcatacttaggtacatctccatggaaaatgtatcttatggtcgatttacataagtgacatattgtatgtatttttattcaataaaccttgaagattcattaattttagatcatataaatccatcacattaatttaaacttctgcctattctacctagtattcagcagactgaacaaatcacagtttagtttttgtttgtttgttgttgttgttgttgttttttgagacagagtctcactctgtcacctaggctggagtgcagtggcgcgatcttggctcactgcaacctctgcctctcaggttcaagcgattctcctgcctcaacctcccgagtagctgggactacaggcgtgtgccaccatgcccggctaatttttgtatttttagtagagacaggatttcaccatgttgccaaggctggtctcgaactcctgacctcaagtgatctgcctgcaccagcctccgaaagtgttgggattacaggcatgagccattgtgcctggcctagtttttctactgatacccattgaaggtatttctaaattttttttgctgtgacacaccagtctacttgaaatttttctgcatgtgtgaatttggcacttaaatgagtatatctgtaggacacattctttgatatgggattgctaaagtcaaaataagtatctagaattttgatagatactgccaaattatcgtccaaaaatgttttttgtgtttctttttgagacagagtcttgctctgtcgcccaggctggagtgcagtggcgcaatcttagctcactgcaacctctgcctcccgggttcaagcaattctcctgcctcaacctcctgagtagctgggattgcaggcgcctgccaccatgttcggctaatttttgtgtttttggtagagacagggtttcaccatgttattggccaggctgatctcaaactgacctcaggcgatccacccaccttggcctcccaaagtgctgggattacaggcgtgagctaccgcacctgacccaaaaatgttttttgaaaattagtatccccaccttcatttcaaaagccatctgttattccttaacctcactaagtactgtgtattatctagatttctttactttttgccaatctgataagtaactaggataaaatgtaaatatcagtatgtaggtatataaaaataattttgttacctttttctcttctaggtctttccattcatactttccatggaaacttctttgttaggtcaaccgacttactgtctttgcctaacgtcaacccagacgctgggtatgcagtacagatgtcagtggaagagagtcttactgacactcagttggtttcttttcagtcagcactcttgtatacatccagcaaaggtaaattgtttgtttttttttggatttcaaatgttcaaatattgtctggatttcaaatgtcaaaatgggctataaaatacatgtagcatatcttatgtgtgctaacttaaaattgctgtttttatttatttatttatttatttatttatttatgtagagacagagtctcactctgtcaccaggctggagtgcagtggcgcagtctctgctcactgcaacctctgcctcctgggttcaagtgattctcctgcctcagccacccgagtaattgggagtacaggtgtgcgccaccacatccagctaatttttgtaattttagtagagatggagttttgccatgctggccaggatggtgtgaatctcttgacctcgtgatctgcccgcctctgcctcccaacgtgctgggattacaggcatgagccactgcgcccagcccttaaaattttcattaccaaaagcagtaaaccaactaaaaagttcaaaaaagagatttttaaaaatttagcatattgtcatttgaatgcgatccctgttcatttagtaataacctgaatgaaaagaattttatagttaaaacaattaaaagaagtagggtcaggtgtggtggtctgtaaacctagcactttggaaggctgactagggaggatcacttgaggccaggagttcaagaccagcctggacaacatagtgagacactgtctctaaaaaaatatttttttaattagccaggtatagtggcacacactggtagtcctacctacttgggaggctgagtagggaggattgtttgagcccaggagtttgaggctgcagtgagttatgattgtgccactgcagtcctgcctgggcaacagaatgagaccttgtttctaaaaaaaaaaaaaaaggatgaaatttttaatatttatgtacttatttatttttaatagagatagggtcttactatgttgttcagccctgtcttgaactcctggcctcaggtaatcctcccaccttagcctcccaaagtgctgggtgctgggattacaggtgtgagccactgtgtctggccagtataaaacgtttgatactgtctctgcttactatgtaactatactacctggttctaaatcgaaaagaagttatttatatttatatttatatatatatatatatatatttttttttttttaattaatttatttttttttaagagatggagtctcactgtattgcccaggctgcacttaaactcctgagctcaagggatcctcctgtctctgcctctggagtaggtgggactacagggatgcaccactgcacccagctaagaagtgatttttccaagtgactttaacataatcttttgttttatatagttgcccctcactgttgtttgtgtattttccccaaaggcgaaagaagaattcgtgttcatactttgtgtttgccagtagtttcgactctgaatgatgtctttcttggagctgatgttcaagcaatttcagggttattggccaatatgggtaagagttgttatctgttataaatatcttacaagtaataacattaggcacatccaaacagttttgttttcctttaaatagttagctttatagtttgaatgttttagatcccctgggtgcctgctaagtaactatttgaaaagatctgctgcagataatcttatcttttttgtttgtttatttaaacaaatttattgagatataattacataccataccacttcacccagtttaattgataattcatttgtttttagtgtttttacagagttgtacagctatcaccacaatctaattttataacatttctattgtctcaagaggaacctcatgctcattagcagttactgcccacttcttcctccctcccttactggccttaagtaaccactaaactactttctgtctctatatatttatatatttgtctacactgaacttagctatatctttttttttttttttttgagatggagtctcgctcttattgcccaggctggagtgtaatggcgcaatcttggcttaccacaacctctatctcctgggttcaagcgattctcctgcctcagcgtcccgagtagctgggattacaggcatgcgccaccatgcccagctaatttttgtatttttagtagagacagggtttcttcatgtggtcgggctggtcttgaactcccgacctcatgtaatccacccgctttggcctcccaaagtgttgggattacaggcgtgagccaccgtgcctggccaactatatcttatgtaatggttaatattagtgctgtttaatactctttttatgagaagcagtgtaccataaagatcattagacttagagtcatggaatttgggattgaaaaccagtttaccaccatacatttgtttgcagccaaatcatgtgagccaataggaaacttactgatatcttcacgtatttatttccatctcagatacaattgtcctcttgatttttttggttccttttcaaatacatacagcttaataacatcattttgattcttgtggtctttctacttgagggaagacttcagtcggtccattttctttcttttgtttttgaaaacagtgtcttgctctgtcacccagggtggagtgcaatggtgtggttctagctcactgcagcctttacctcctgggctcaagggatcctcccacctcagcctcctgaatagctgggattacaggcccacaccaccacacccagctaactaacattcattcattcactcattcatttatttagttatttagagatggagtctcattcaccctcccaggatggagtgcagtggcacagtctcagctcactgcaacctctgaccccaaagttcaagtgattctcctgcctcagcctcccaagtagctgggactacaggcgcacgacaccacacccagctaatttttgtatttttagtagagacggggtttcaccatgttggccaggatggtctcaatctcttgacctcgtgatccacccacctcggcctcccaaagtgctgggattacaggcatgagccaccacgcctggccctcaaccagctaactttaaaaaaaatttttttagagacagagtctcaccatgttgcccaggctgatcttgaatcctgggctcaagcaatcctcctgctttggcctaccaaactgttgagattacagctgtgagtcaccacacccggcctcagtaggtccatttgcttcaaacttaattctgtctgtatcaggaatagttacccactttcttgaatttcctattgggaaaaatgttttacgtggagcctggtaaaggatttacccacactttagtcttttatgttgttagatgttcaagattgtgacctatgaaatttgaagatcactgcctttattttatttatttattttttttttttgaggtggagtctcactctatcgcccagggtggagtgcagtggcgtgatctcggctcactgcaacctccacctccagggttcacgccattcgcctgcctcagcctccccagtagctgggactacaggcgcccgccatcacacccggctaattttttgtatttttagtagagacggggtttcaccatgttagccagggtggtctcgatctcctgacctcgtgatccacccgcctcggcctgccaaagtgctgggattacaggcgtgagccaccgcgcctggcctatttttttgtttaagttacttttttttgtaactatgattattattattattgacagcagtaactattagatgggttttgtggatttttgataaactgtcacaactttgtaagtattggttctgctaccatattgaatgtatttttagtgccacatggatggagtttagttatttgagaagtcttcaattatgctttttttttaagtattgaaagaatgtttttatgcagaaatgcgtataaacagagtgtcatggcaaatgatgaaaatctgtctaaataagaggccaacttggtgaaaccctatttctactaaaaatacaaaaaaacaaaacaaaacaaaacaaaaaaattagtcaggtatagtggcacatgtctgtagtcccagctactcaggaggctgaggcaggataattgcttgaacctgggaggcggaggatgcagtgagccaagaccacaccaccgcactccagcctgggcgacagagcgaaactctgtctctaaataaattaataaataactctaagagctctttctgtaaatgtaaaataaaaactctgggctgggcatggtggtttgtgcctataatcccaacactttgggaggctgaggcaggaggactgcttgaggccaggagtttgagatcagcctgggcaacatagggagacttggtacaaaaaaattgttttaattaattaaaattaaaatttcaaaagaactctgtttcgaaacattgtgcatttcaggaaacacaggaaagcattgtgtgtttaattgcaatgtttttctttctcaatggtatataaagtgttggattacaatcagtagcataactgaggctcaggaaggttaagttacttgccaaatcattatacagctaggaaatagcagagcagcatttcaacagaggttggctcagttctccagaccatgcttttagctgctgtgttttgtctcatttgtgtatgtagtaaattggagagatacttggtatagtttttaaaaattatctcttctatccttaacagtggactagctaaacttctatcatatttcttttttgtccttaccctcaccttgcttagctgttgacagatctatgactgccagtctgagtgacgctcgggatgctctagtgaatgcagtcattgactccctttcagcttaccgttcttcagtcttaagtaaccagcagcctggactcatggttcctttttctttgcggcttttcccactttttgtgttggctctccttaaacaggtaagaaaaacagatatagaaactaacacaatgatggccaggcactgtggcctacacctgcaatcccagcactttgggtggctgacgtgggtggattgcttgagtccaggcatttgagaccagcctgggcaatatggtgaaacctggtctctgcaaaaaatacaaaaaaactagccaggtgtggtggtgcacacctgtagtcagtcccagctacttgggatgctgaggtgggaggatggttgagtccaggaggcggaggttgtagtgagcccatatcgtgccactgtactccagcttgggtgacagagccagactctgtctcaaaataaacaaaaagaaagaaacgaacacgatggaaacatcaaaaggcaaaatttttatcctatgaatccctaaacattgtatatgtaactttatgctggttaaatttttgacgacaggtaccttacctcttatttgaactttgaaaagtttaataaccaaagaaacttagagaaaactgattcagagcaagttccttgttcataagatgcttctctaagcaaagtattcagtgacattataaaaaattcaactgataatcagttttccagaacaagaattgtatattatattgctgatgcaagaaggcacacatgcactgtgtgttctcacttatatgtgaaagctaaaaaatcaaacacacggaagcagaaagcagaatggtggttactagaggctgggtggtggggcaggaatggggagatattgaacaaaaggtacagtgttttagttaggaggaataagtgataactatttgaggttatggatatgttacctagcttcattaaatcattccacattgtatactatatcatagcatccctttatacctcataaatatatataattagaatttttcaccaacaaaaaatttaacttttttttaaaaagaagagaccatacatgttattttattttattttattttattggctctttcctgtccctacagaatttcagcaacattacacttctcttttcttttttgagacagagtcttgctctgtcacccaggctggagtgcagtagcacgatcttggctcactgcaacctccgcctaccgggttcaagcgattctcctgcctcagcctcctgagtagctgggattacaagtgtgtgccactatatccgactaattttgtatttttagtagagacaaggtttcaccatgttggtcaggcttgtctcaaactcctgatctcgggtgattcgcccgccttggcctcccaaattgctaggattacaggcatgagctaccacattacacttcttaatcttcttctttttttttttttgtctgagacagggtctccctctgttgcccaggctggagcgcagtggcacgatctcggctcaccacaacctccgcctcctgggttcaacctcctcctcctgcgttcaggcaattctctcgcctcagcctcctgagtagctgcgattataggcatgcaccaccacaccccagctaatttttgtatttttagtagagacagggtttcaccatattggttaggctggtttctaacgcccaacctcaggtgatcctcccacctcatcctcctaaagtgcagggattacagccgtgagccaccatgcctggtccttaatcttctttagatacactttcttatacctgtatacttgcatacctgtttccatgatctggattggacttccatatccttgtctttgagtttaaatgtttgtagggtttttctttgtttcgttttgtttgtagggtttttcatttgctacttattatttatatgtctcccctgcctgctctttgccttcctcccagaaaagaaggaaaactctggtctggtggagtaggcttatttatccagtgtccaaaattgaatgtccaaacttattgcctcaggataaacttcccttataaaattttatttaaaagctcgtgttggccggccatggtggctcatgcctgtaatcccaacactttgggaggccaaggcgggcggatcacttaagttcaggagtttgagaccagcctggccaaagtggtgaaaccctgtctctacaaaaaatacaaaaattagcagggcatggtggcacatacctgtagtcacagctacttgggaggctgaggcaggagaatcgcctgaacccaggaggcagaggttgcagtgagctgagattgcaccactgccctccagcctgggtgacaaagcgagactccttctcttaaaagaaaaattaaataaaaaataaataaataaaagctcatgttggccagatgccatggttcacacctataacccaatactttgagaggccaaggtagaaggattgcttaaagctaggggtttgagaccagcctgggcaagaaagcaagaatctgtctctactaaaaaatttaatttttttaattaaaaaagaaacaactcatgttaataaagcacctgaagcagcactgcagattccagaactgttcaaggactgctggctgggcacagtggctcatgcctgtaatcccagcaccttgggaggcaaaggcgggaggattgattgcttgagtctgggagtttgagaccagcctggacaacatagtgagattctacccctacaaaaaaaagttttttaataagaaaaataaaggactgctctgcatcttttttttttttttttttttttaacagtctcgctatgtcgcccaggctggagtggcagtggcgatctcggctcactacgacctcagcctcctgagtagctgcgattacaggtgttcaccaccacgcctggctaatttttgtatttttagtagagacggggtttcaccatgttggccaggctggttttgaactctttttttttgagatggagtctcgctgtgtcgcccaggctggagtgcagtggcgcaatcttggctcactgcaagctccacctcccaggttcacgccattctcctgcctcagcctcccaagtagctgggactacaggcgcccactaccacgcccggctaattttttgtatttttagtagagacggggtttcacggtgttagccaggatggtctcgatctcctgacctcgtgatccacccgcctcggcctcccaaagtgctgggattacaggcgtgagccaccgcgcctggccggttttgaactcctgacctcaatgatccactggcctcggcctcctaaattgctgggattataggcgtgagctaccacaccaggccttcatcttgtatttttcctgaactctgggatctacttgtctgttatgtgtagttttttccaggtgagaagagcaactcattactttctagtaggagtggcttttgaatctacagttctcatttctttttttttttgtgagatggagtctcacactgtcatccgggctggagtgtagtgacgtgatcttggctcactgcaacctccacctcccgggttcaagtgattctcctgtctcagcctccagagtagctgggattacaggcacccgccaccatgcccagctaattttttgtatttttagtagagacagggtttcactatgttggccattctggtctcgaactcctgaccttgtgatccgtcctccatggcctcccaaagtactgggattacagacatgagccaccgtgcccggtctctagttctcacttctttaactcaaattatttatttctatttctgaatataagtacacagattacataaatatttaattttttttttgagactagtctggctcttgttgcccaggctggagtgcagtggcacaatcttggctcactgcaacctccgcctccggggttcaagtgattcttctgcctcagcctcccaagtagctgggattacaggtgtgtgccaccatgcctggctaattttttgtatttttagtagagacggggtttcaccgtgttaaccaggatggcctcaatttcctgaccttgtgatccgcccacctcagcctcccaaattgttgggattacagccatgagccaccgtgcctggaaatatttaaatttttttttttttttttttttttgagacagagtctcgctctgtcgcctaggctggagtgcagtggcgcagtctcggctcactgcaagctccgcctcccgggttcacgccattctcctgcctcagcctcccgagtagctgggactacaggcgcccaccacaatgcccggctaattttttgtatttttagtagagacggggtttcaccgtgttagccaggatggtctcgatctcctgaccttgtgatccacccgcctcggcctcccaaagtgctgggattataggcgtgagccaccgcgcccggccgaaatatttaaattttgacgtttaaaaatctgagctcttctttcttcttcaggcctttcttgaaatacttttttctaaagcctacattctctgatcttcccgatttaatatgcagtaccccaatcccaccccatccctcaccatcctgacacccctaatcacccttacctcctgtatttttcctatagcatttatcactgacataccacatattttgcttatttttattcttcccttaataggatgtaagctccatgaggacaaggatttttatctttttcattcatttttttgtcctagcagttagaacagttcctagtatataatagacaatcaggaaatattttttgaatgaatagatggaactttccttcttccattaaaatcttaagagcttttattatcttcctttaatatagtcagtgtacttgttttaatacgtaatttcattattcttttctctctgcctgttttactcctttccatcaattggaatacttaaaaccttacccataactggctgggtgcggtggctcacgcctgtaatcccagcactttgggaggccgaggcgggcggatcatgaggtcaggagttcaagaccagcctgaccaacatgctgaaacctgctctctactaaaaatacaaaaaaaaaaaaaaaaaattagccgggtgtggtgtcgcgcacctgtaatcccacctactgaggaggctgaggcaggagaatcgcttgaacctgggaggcagaggttgcagtgagcagagatcaaaccactacactccagccttggcgacagagggaggctccgtcacaaaaaaaaaaccttacccataacttttttcttctccatttttatctgtgtaaagaaaataataacagttaaatatcatagttacttattaactcattttactaagaagctttcctcatttgtagtagtattattttttcttgtttattagtattctttgttacattgtttgtatggtgggagaatcaatgacagctgccattagtcatcacccagcactcatgggccacttagtgcagtattctaagtgcactaccccccagccacataccggtaccagtgggtggcctgttaggaactgagccacacagcaggaggtgaccagtgggcgagggagcattactgcctgagctctgcctcctgtcagataagtggcagcatcagattctcataggagcgccaaccatattgtgaactgcgcatgcgagagatctaggttgcatactctttatgagaatctaatgtctgatgatatgaggtggaacagtttcatcccaaaatcatcctccaccatgtccccaccagtctgtggaaaaattatcttctgcgaaaccagtccctggtacgaagaaggaccactgacgtaatggatatctttttggtccttcatgtatgcctttactttgtcatctgcaatataacttcatccttcctatggtgttgcttggattgttacatcattatcactatcattatatggtagatagagtgtttagatctattttatcaactaggaaacagacaccatggagatcagataactttgccatggtcagttagttaatttcaaaagacttttaggtggggctatagctacagtttaatagatgtgtgtgacttcttaaaaaagatactttaaaaaaattaacagtaaatttgtgaattctctctgaaaatattcttttaacaactggcattttaaaagttctggatgtatttttaaaatatattcttttgtggggaatgggggttttctgttacagaaatcattccagactgggacaaatgcacgtctagatgaacgcatttttgctatgtgtcaagtgaaaaaccagcccttggtttaccttatgctcacaactcatcccagtttgtatagagttgacaatctctcagatgaggtaagatggattgcttttttgtggttttacttgaagattagtaagcctaatcatagtccagtacagaaatgaggaagggtttgtttattatttaaggctttagcttttattttatttatttatttttttggctaagtctgagtaaataaattttagtatagggaagctcttaaaaatagtgcctttaagtttcctaaaataccatctgtagagcagatctaagaaatggaaagattgtcaaattgaccagagcaacttactaatttattcaaacaaatcgatcttttaacaactgacattttaaaagttctgggtgcatttttgctcgcttcagcagcaaatatactaaaattggaatgatacagagaagattagcatgccccttgtacaaggatgacacacaaattcgtgaagcatttttaggaacagaaaaccgaacactgcatgttctcactcataagtgggagttgaacaatgagaacacatgggcacagggagggaaatatcatacactgggtcctgtcagggggtggggacaaggagacagagatcattagcacaaatacctaatgcatgtggggcttaaaacccagatgacaggttgatgggtgcagcaaaacaccatggcacatgtatgcctatatatcaaacctgcacgttctgcacatgtgtcccagaacttaaagtattaaaaaaaaaaaaaaaaaagttctgggtgtatttttaaaatatattttttctggggaatgggggttttttgttacagaaatcattccagaatggaacaagtgcacgtctagatctgagagtgaaattacatctgaacacccagttcaatgtaacagtgtccttgaattaaagaaaaaatacttctctaagttgtaacattgttttcctttggtagaaatttaccagaattaaagtcacaagaatgaaaatgtcaaatcataatctttctaaaattgtgatcaagttaagatatatattttggaagtgatgttttggttaaaaacttttcaggccaggtatggtggctcacacctgtaatcccagcactttgggaggctgaggcgggtggatcaggaggtccagagttcaagactagcctggccaagatggtgataccctgcctctaataaaaatacgaaaaacaaaaaaattggccagctctggtggcgggtgcctgtaatcccagctactcgggaggctgaggcagagaattgcttgaacccgggaggcggaggttgcagtgagccaagattatgccactacactccagcctgggtgacaaagtgagactttgtctaaaaaaaaaaaaaaaaaaacctttgaaaatttaaagaatttaatatgtgggccaggcgcagtggctcatgcctgtaatccagcactgtgggaggccaaggcaagtggatcacctgaggtcaggagttcgagaccagcctggccaacatggcgaaaccccatctctactaaaaatacaaaaattaactggtcgtggtgatgcacgcctgtaatcctgggtactcgggaggctgaggcaggagaatcacttgaatccaggaggcaaaggtcgcagtgagctgagatcatgccattgcactccagcctgagtgacaatagagcaagattccatctcaaaaaaaaaaaaaaaaagaatttaagatactttacatatgtaaaagaaaattgcctatgaaatttgaggtaacttttttactttttttttttttttgagacagggttttgcacttgttgcccaggctggagtgcaatggactgatctcggctcaccgcagcctccgcctcccaggttcaaagaattctcctgcctcagcctcccgagtagctgggattacaggcgtgcaccaccacatcttgctaattttgtatttttagtaaagacggtgtttcaccatgttcttaaggctggtttcaaattcctaacctcaagtgatccacccgcctcagcctcccaaagtgctggaattacaggcgtgagccactgtggtggcctattgcattcttttttgaagcaaaggttaagatcagaagttaatggccaggcacggtaaatcacacctgtaatcccagcactttgggaggccgaggcaggtggatcacctgaagtttgaggagtttgagaccagcctggccaacatggtgaaaccccttctctactaaaaatacaaaaaattagccgggcatggtggcgcatgcctgtaatcccagctactcgggaggctgaggcaggagaatcacttgaatctgggaggcggaggttgcggtgagccaagatggtgccattgcactccagccttggcaacaagagtgaaactctgtctcaaaaagaaaaagaaaaagaaaaaggaaacaagatcagaagttaatttggctttattgggagtcacagtagcttagttagataagtgataactatttcgtcatcttctttatatgtaaatatgaataattggccgggtgcggtagctcacgcctgtaacagcactttgggaggccgaggcgggtggatcaactgaggttgggagttcgtgaccagcctgaccaacatggagaaactccgtctctactaaaaatacaaaattagctgggtgttgtggtgcatgcctgtaatcccagctactcgggaggctgaggcaggagaatcgcttgaacccaggaggtagaggttgtggtgagctgagattgtgccattacatttcagcttgggcaacaagagcgaaactccgtctcaaataaataaataaataaataagaataattgtgatttacctaagcaaggcccagacttgtagaggtaacattcatttaattttttgttgttgtttaactgtgactccatatttcctatatttaaaacctttactcttttacttaattcctcagggagcactcaacatcagtgatagaaccatacctcagccccccattcttcagctttcagtggagaagctgagcagagatggagctttcctcatggatgcaggctctgtaagtaatttgacttatcctgaccctcactgcaaactactatactgttttaatttagcatttggtttcattccctttaatatctctcttcctgaacagatttcatattttaacctatatacagtcgtacactgattaatgatgtgtaagtcatggcttatatgatggtggtcccataagatttataatggagctgaagaattcgtatcatttagtatttactatgctatttttttttattattgctttggaatgtactcctacttaattttttaaaaagttaaccttaggcgggtccttgaggaggtattctaaaagaagatcttattatcataggagatgacatctctatgcatgttactgcccctggagaccttctaatgagacaagatgtggaggtggaagacagtgagattgatgatcttgacgctgtataggcctgggctaatgtgtgtttgtgtttcagtatttaacaaaacaatttaaaaagtaaaagataaaaaattttaaaaatagggccgggcacggtggctcatgcctataatcccagcactttgggaggccgaggcaggtagatcatttgaggtcaggagttcaagacccgcctgaccaacatggtgaaaatctctactaaaaatacaaagaaattaaccgagcgtggtggggcatgcctgtaatcctaactacttgggaagccgaggcaggagaatcgcttgaacccaggaggcagaggttgcagtgagccaagattgcaccactgcactctagcctgggcaacagagcaagactgtctcaaaaaaaaaaaaaaaatttaaaatagaaaaatgcttatagaataatgatataaagaatatttttgtacaactgtacaatgtgtgttttaagctaagtgttattacaaaagagtcaaaaaattaaaataatttgtccgggcatggtggcttatgcctgtaattgcagcgctttaggatgccaaggcaggcggattgcttgaggtcaggaattcgagaccagccggggcaacatggtgaaaccctgtctctactcaaaatgcaaatgttagccagacatagtggctccaggctgtagtcccagcaactcagaaggctgaggtgtgagaatcatctgagctggggaggctgaggcttcagtaagctgagatcacaccactgcactccagcctgggcaacaaactgatacctagtctcaaaaaaaaaaaaaaaaaaagaagaagttggctgggcccagtagctcacatctgtaatcccaaccttttgggaggccgaggatggcagattcctttagcccaggaattcgagaacagcctgggcaatatagcaaaaccctgtctctactcaaaataccaaatccaggcgtggtcacgtgcacctgtaataccagctacttgggaggctgatgtgggaagatcacctgaacccaggaggttgaggctgcagtgagctgagatcataccactgcactccagcctgggcagcagaacaaggccctgtctcaaaaacaaaattaagagactgggcgcagtagcccacacctgtaatcccagcacttagagatgccaaggcgggcggatcaccttaggtcgggagttcaagaccagcctgaccaacgtggagaaaccacgtctctactaaaaatacaaaattagccaggcgtggtggcacatgcctgtaatcccagctacttgggaggctgaggcaggagaatcacttgaacctgggaggtggaggttgtggtgagccaagatcgtgccattgcactccagcctgggcaacaagagcaaaactacgtctcaaaaaaaaaaattaaaagaagtttataaagttatagtaaactacgattaattattgaagaaagaaatttttttatatatctctagtgtagcctaaatgtacagtgtttgtaaagtttatagcagtgtccagtaatgtcctaggcctttacattcactcatcactcactgactcacccagagcaactttcagtcttgtgcactccattcgtggttaagtgccctatacaggtgtactgtttatcccttctgccatatttttactatacctttcctatgtttagatacacaaatacttagcattgttttacagttgcctacagtattcagtacagtaacatgctatagacgtttgtagcctaggtacagtaggctataccattaaggcttgtgtaaatccactctatgatgttcatacagagaaatcacttaacaacacgtttctcagcatgtatccacattgttcagtggattcatggcagtacatttgtctgccacctttcccctccatatcttccttgtttcatgccaagcataaaatgtctcatcaggtaaatactaattattattaattcagttaaaggctgtacaatctcactaaatatacttacctttttgaccttttaaaatatactcaagctgggtgtggtggctcacacctgtaatcccagcactttgggaggctgaggcaggcagatctcttgaggtcaggagttcaagactagcctggccaatatggtgaaaccccatctctactaaaaatacaaaaattagctgggcatggtggcacacgcctgtagtcccagctactctggaggctgaggtgggaaatcgcttgaacccaggagtcggaggttgcagtgagccgagattacaccactgcactccagcctgggtgacagagtgagaccctatctcacaaatatatatataaaataaaaataaaatgtactcactcaacagactcacctttatgtatgctgcatctcaaaataattttattcctgtccctaggtactgatgctttgggttggaaaaaattgtacacagaattttctcagccaagttctaggagttcaaaactatgcatcaattccacagcctatggtaagactcttttattatagtgattataaagggcatttcaaagttggcaaaaacatgaatatcccctattttgatatcagaaaataataacaaaatcataccaaaaatttttattgatgggttttcatgttgatggattctatgactccactcatagaatcattagggaatttatatatttaaaaggcagatatgccagccacagcggctcacactgtaatcccagcactttgggaggccagggcgggctgatcacgaggtcaagagatcgagaccatcctggccaacatggtgaacccccttctctactaaaaatacaaaaattagttgggcgtggtggcgcacacctgtagtcccagctactcaggagattgaggcaggagaatcgcttgaacccaggaggtggacattgcagtgagccaagattgtaccactgcactccagcctggcaacagagtgagactccatctcaaaaaaaaaaaaaaaaaaaagatagatatgccaggcgtggtggctcacactggtagtcccagcaccttgggaggctgaggtgggaggatcacttgagccctggagtttgagaccaccctaagcaacatagtgagaccccataactacagaacatttttaaaatagctgggcatggtggcacacaactgtggtcttagctacttacgaggctgaaatgggaggagtgctaggacctgggaggttgaggctgaagtgagcagtgattatgctgctgcactcccgcctgggcaacagagcaagaacctgtctcaaaaaataaataaataaaagactgctgtgtcaggattatagctaggataagcactggctttcaggccttaaacagaactactgggctggatgactaagcgttttaggtaatgagtaagaaattgttatatttttaataataactgaacgaatcaattaattcttgacgtcatgctaaaatgaagggaagaactaagaggtttttttagatgagggcttagaaactatgcccaaggggtacctgctacttgtttttgtaaataaggttttattggaacatccatgcctgttcacttatgtattgtttatggctactttggtgtaacaatggcaaggttgcccgggcgtggtggctcacacctgtaatctcagcgctttgggaggccgaggctggcgaatcacctgaggtcgggagttcaagaccagcctgcccaacatggagaaacccccgtctcaaggcgaggtgggcgaatgacctgaggtcaggagttcgagaccagcctggccaacatggagaaacccccatctctactaaaaatacaaaattagccgggtgtggtggcgcacacctgtaatcccaactactctcccagctactctggaggctgaggcaggagaatctctggcaggcgaatcgcttgaatctgggaggcagaggttgcagtgagccaatatcacgccattgcactccagcctgggcaacaagagcgaaactctgtctcaaaaaataaaaaacaatggcaaagttaagtagttgcagcagagaccaaatgatctgcaagcctaaagtacttactatatgggcctttaagaagtttgcctactcctgttctagaatattcgtagaaaattgtgttcccaagtcaagttgcactggcatcactgcaggaattttttaggaaagcaaaatctcaggaccacaaccctgccccagacctcctaaatcattatctgtagttcaagaagatgatcaggtgattcatatacatgttaaaattcaagaccaggcatggtggctcacacctgttatcccagaactttgggaggccgaggtgggcagattgcttaagcccaggagttcaagaccagcctgagcaacgtggtgagatactcgtctctactaaaaatacaaaaattacctggcaggtggcacacgcctcttattccagctacttggtggggctgaggtgagagaatcacttgagcctcaggaggcagtggaggttacagtgagccatgatcacaccagtgcacttcagcctgggcaacagagcaagaccttgtctcaaaaaataagttaaatttgagaagtagaccgggcactgtggctcactcctgtaatcccagcacttcgggaggccgaggcaggtgtatcgcctgagcccaggagttcgaaatcagcctgggcaacatggcaaaacccatctctacaagaaatataaaaattagccaggcatggtggcacgcatctgtagtcccaactattcagaaggctatggtgggaggatcaccggagcctggaggttgagactgcagtgagccatgattatgccactgcactccagcctgtcaacagaggccttgtctcaaaaaagaaaaaaaatgtaattaaaaaaataaaaatttgaaaagtaccatagaccatacattagatatgtaattaaagtaattggatattgttggttttggttaacagacagaccttccagaacttgatacaccagaatctgccagaataatagctttcatctcttggcttagagagcagagaccatttttcccaatactttatgtaataaggtaagttgaattttccatttgctagtagtaaaacaatttgtttggccttgccaggacctgacaagagtatagcaaaaaaaaagaagaaagaaaaagagttcttctcaataaatagcagtaaatcataccttatatccaatgattggaaatacagaacttttttcatttttaattgactaataataagtgtatatatttatggggtacactaatttattgatacatgtatacattgtggaatgatcaaattcggctaattaacatattcatcttctcagccaattattgtttccttgtggtgagaacatttaaaatccattattttgcctattttaaaatatacaatacatcattattaaccatagtcatcatactgtgtaatagatcaccagaatccattcatcctaactgaaattttgtaccctttgactaacatttcttctttccttctccatagccacttcctgcctcctagcctctaataaccataattctactttctacttatatgagttcaacttttttaggttccacacataagtaagatcgtgtggtgtttgtctctctgtgcctggtttatttcactcagcataatgtcacaaatgacagaatttcctgttttttaaaggctgaagtcgccgggcgcggtggctcatgcctgtaatcccagcactttgagaggtcgaggcgggcagatcacctgaggttgggagttcgagaccagcctgaccaacatggagaaaccccgtctctactaaaaatacaaaattagcctggcatggtggcacatgcctgtaatcccagctactcgggaggctgaggcaggagaatagcttgaacccaggaggtggaggttgtggtgagccaggatcgtgccattgcactccagcctgggcaacaagagtaaaactccatctcaaaaaaaaaaaaaaggctcggtagaattccattgtatatatataccacatttgaaaaatccattcagttatttccatatcgtggctattgtgattaatgctgcagtgatcatggaagtgcagacatctctttgatatactgatttcaattcctttggatatatattcagaaatggaatttctggatcaactatttctcttaattccaccataagcttttcccttaaacaacttgaaatttacataatcaaccaagtattctcagagaaagcctctagaagtaactgtttatatagtaaatgttattagggttatgaggaaatcaaaagccttctgacaagtctattttactgctacattttatctaaatttttttgccttttattcctaagggatgagagtccaatgaaagcaaacttccttcaaaacatgatagaagacagaacagaatctgcattatcatattatgaattcctgttgcatatacagcaacaagtgaataaatgaatgaatgaagaaatttgacttatttttaaggaatgtcacgatagtgcagaatacctggaaatgtgtaataccttctttttctattatgtttgtggactaatgtgatgattgagatgttctcactgtgatttcaacaacctatagcaaataaaagaccacagcagagaatcaaacatgcaactctgaaatactgtatttttcaaatcagaatatagctacgtatgattggatacttttttcttgccaattatgtttgagttgttatggattaaaataagaatattgcagaggcaaagtacattttgtaaaataaagatttctgtgttctacatgtatatttctcatttttaatttttctgaatctttggctgctacatttaaaacctcacaaacctaagtgttgcagggaagttacaaattgattggtagtgatgtttttaaaataaaaacaatggaaagtaaatataatgtaggaaaactagaattcattccccacacgtgtcttttttttttctttgttaagggaaaggatcatgttgactaaaactaaactaattctagtatagcttgagaaaaatatgaagaaacacattcaagctttaaaatctgtcagtattctttatgcttgaagaacaaagtcactttgatttgaagtgagaactatcattaggtggttttctgatttcctgatgaagagttggacatactgtcttaatctatagtgaaaagaatttgagctgtcttcataaacactgggactagcaatgataatagggagataagaaactttaattatcttgatcctttaagtggattttatttggtgcatttctgctctgggtatataataaaagtgggggtttttggtgaaatgagtgaagaaatgaaaggtttctaaagtgctatccaaatacatcagtaacatttttctaaggagtttaattgttaaattggaagtcattcataagaaatatttatgcttgaatatgaaaatctatgaaagcataaatgctgctgtttgatttggtggatattaagattatacacatccaacatattaaagttatgaaagaaacttgacttctgaaaatccttaagagactgctttcttgattcagctagagaaatattatagtcaaaactattgagtgaattttgtttacaaataggtaaattatacatttgtatatttaaagtgctgtgacatagtatctttaagagtttggctcagttttcacagattcattttgtcttaagaatttcttaaatatgttcatgtataatacttgatcaaaatatttttgggttttttgttttgttttaatgggttagaaaatgtttacaatcttggtcttatatgatcaccaatggaatagtaacttccaggtttatatcaatatgagctgactttaactgagttgtttgggatagggaagaagcagtccctctacagtatacaactactgcttgccagctggatcaaaataatcatgttttatgaaaatatctcccttaagcagtgttaaggttggtttgcagtgtgtaagtggcacattgaactggaagttttcttgaaagctgcttcatctattaagaagcaattttcaaattgtagcgaattatattatcccctcttttaaagaaacagtcgttatatgctgatgtttcttaaaataactaaaatgttcctcttaatgtgattttaaatggagttatttgtaggtcctttcttagtagtaaagaatcttctagagggaaacatttgtgcttttagggataatcttccttgtgcctcactacatccctaagtgggtatgactcttgttattaccacatgcttttttagtatatttcacaaatttacttttaaatattattttagatacggtgtaacatgtgcaattcagaataattttataacaggtcatgaaaaacataactttagttaggattcacaatatttgttctccacataatgagagaatgaatgagcctttggagatactgatataaggcaattattttttgcaatgttgaatgtgttttttagtttgattctttttttttcccccaatagggcactacctgccatatcatcttgtattactttttgatgtaaagcgactaatatttacactatgccatattttttttaattatagttgtaaattatgaaagatccttgaattttctacagatctacaactactaatgtaacagacaagggcaatcttggtatttaaatctgagcatggcagttctaccataaaaagtactctatttttctaatttctaggatttttaaaataacatttctgtaagtctgacatactaatagtcactcaagcagtaccatttattttagtttgcatatattttcactgtttttaatttaatgtattgagtctaatagactgttttgcaataattagaataaagatttatttcttctaatcaaagatgcataacagctattatctaggggaccaccaaatgtgatttcaaaattttgttaactattacaaatgtaatccttatatagaaattttaattttgtaaagtagtgtataatattgtaatattaaattcttgttcttaaattcaaatatgtattgatcttcaatgtgctgtgttaaatcttgcttctctgaaaagttggagacaagatttgtcttcctttttacagtttgtaattttcactgttttattcctgtt

SEQ ID NO: 37818 - DNA, 21758 bp, Homo sapiens
ccagccccagcatcgcgcgccgcagccgcggccccgcagctccgcccccggcccggcccggccccgggcccgctcgcccgccgccccgcatggagctgtcagccatcggcgagcaggtgttcgccgtggagagcatccggaagaagcgcgtgcggaaggtgaggctgcccgggggcggctcccaggaccccagtggggtccctcccgtccccagcaccgctccctccacgctggggctgaaggggaaagcggggcgcgggggccccggcagccctgcgctgctgggcccgtctccccagcccgtgcctcagtttccctgccaccgtgtagggcgagtagaacaaaagttgtcgctccaggatgctagtggcggccgagcctgcctgagctggagattaggatcggacgtagggatcctcagcgccatcccacctcgctccccttttattgtaaatatggggagactgaggcccaagttgaaaggacttgcctagcgcgttatggtcagagctgggttttgaactcgggactctggacgcttggcaccaaatcctttcaagttgtaagtggagctttggaaaagtctcctccggcctctgaagtttttcctgctggactttggccttttccgatcctgccccctctacgccacccgagcacatccctattccccgcccccacccccacctcaactcctagcccaggccagggctctgaagcccgccccctgcgctggggcatcccctagtctcctaccccatctgccttcttcaaaacatacaccctgcaatttaaggaggtgtctgttctgctggtttcagaaccccacactttggggctagactttgtccgggcctggcgtctacacctcccgtgcacttgtttggcgagggggctcgcctaaggctggggaaatccttggggagaagttcctttcctggtacgcactactgtccttcctttgtctcctcctccctgcagccctttgggaggctccaggccgactgggaggggccttagggggtcacctcctcccatttaacagagacaaaaactgaggcccaggcagaggaagtgacctgctcaaggtcaccgagcaagttagatagggaggtagagcaggagctcaactgggctgattggcagcccatcttctttctccatagagaaaactcagtcctggcatctcgggccaagggtgaaggtcaaggtggtcaggagcatcttttcttcctccagctgtgcttggggttttactcttctgattgaggcagctgttcctcctccttctcctttttcctagggttttctccacttaaaagagaattgatttattccacaaagctcagtgcttttcgtgctgtgtagcctgaagcaggcacagcactaactccctctacgatggagcccgcagggtagcacaagagggcgagatcatcattccttcggccagtcactcaaaatatttattgagggttggtcaggtaccaggcaccagtctaagccccagggatccaccccttccctcagggagctggcattctgcagaggcggcacacagtgaatgaggagatacagacagatgccttcagatggagctgtgtgctctgcagaaatagaactgcaaggtgccagtggagacagcatgggagagggtcaccagggaaagcctctgtgaggaggtatcatattttggtcttaaagttctggcgtgcaggggcttcactcacaatggggttggactgtaaacttttttttttcttggcaccaagatctcactctgtcacccaggctgcagtgcaggggcatgaacatggctcactgcagcctcaacctccccggctcaaacgatcctcctgcctcagcctcctgtgtagctgggaccacagacaagtgccaccatgcccaactaatttccttttttcagagacaggggtctcaccgtgttgcccaggcttgtctcaaactccttcctgggctcaagcgatcttccagcctcagccttccaaagtgttgggatgacaggcttgagccaccgtaactgtaaacttttaaagcctgtgaggaagggaggggcctggctctactttctaacaaccacagggctgaccaccccttctgaaggtggagactttgccagtcttccatggggtcctgccagggtcttttgagttgagagtcctcaagtcactggcccattacctctgagccagaggcagccactcacagactgaaaggggactcagcagatgggggaggagcgtggggactaccccagagaggaatgttttcgtatttggagactcttccaatctaaaaaagaaagtaagcgttcccacctgtgcactggggctctagacactgtgggtctttggccacgcatgcacacctccatgcagtctcagctcccagtgtgtgacatgagccctgggcttgggcctcaggagcctcagaggtggctggagccagacgcactcctgtgctgtcctagggagggcagtatggggcgggcatgcagcagtcgcggttatatgggttggcgaggatctggtggacagtccccggattgtgtttgtgtgttggggagacacctgtctgcagatgggatttggagctgggctcctttgggccttaactgtccttccgagtggctgtaggggcaaccacgagactcactgtgtctgcttctctctcttctcagggtaaagtcgagtatctggtgaagtggaaaggatggcccccaaagtaagctccttcatgtgtgtgtgtctgtctgtctgcctaccgacccatgcattcctccacctgccttttgccccctcccctgcctagcttttagctccagctactcttgtaactggacagctgaccttgatttaatcatcatcttctctgggcctcagtttccccctggaccacaggagggtcaaggtgggtctccagcttctcttctcaccctgccctcctgagtgttgagctcctctgctagttggagcttctgctctccctcctcccctccctgtggcttttcttggcaactgggaggtgaaggcccagcatccgggctactggagatggctgctggacaggaggaggggaccccagctgctttaagcacagtgctgcatgagtcctcagtgctgtgtggccaggggcagagcctgaatccccctcacctctagacggcactttccagtctatagagcaggttcccatacagctttgtaaggtaggtgtgatcaggcgctctcaaggtgaggaaacaggctcagagagggtaagcagcttgccttaggtcacacagcaagtggaggcagagttgggacttgaactaggccttctccttttcaggtgtctcctctgtgccttcccagcctcccatctcggagttgggaggcagggagctgtatctgagacctcccagcttctccacctctcctgctgaggccccatcaggaacccaccaatgccctccagcagggagttgttgggagggaatgagctagtcgtggggcctccccattggtctgtgggtgccccaccccctgccccgcctcccggagactgagtcctggaaaccccctctgcccagagctgctgctgtcgggcagggactttttgctgtgctggtgggggctgacctggtatggggtcctgtgggcattctggggtgatggtggggagagacagcagagaggaagacagcccacagtgcctcagcttccctctctgcaaaatgggttcagaaacccaggccctgcactcatctcacaggcttggtggccctatcggatgaaaggcctgggcacatgttctgggtgacctgtggatatcctgatgacaggggttgggagctggcaggccgagaatacactccacccctcacaccaacccccacttcagttctcccttcccgaatattctgagggctgaaggagaatccctcccccgccacacccagctgctagaaggtgggcttccagcctgagtgaagggggcagtaaagggagtgacgatgcccagagtgggcagcaggagcaccgcctccctgggcgcgcacacccctgcctctctcgcttcgcaccaggaagctgtggccaccagctgttagccttcaggacactattggctatttttcctcctctggagactccactctttggaagattctcttctgtaaacagaggccgttatgaatgaaaagttccttcccccactttgattgatcctggatgtgaatccatctgcccactgcagctcgtcaggagggaaggaacgaggctcccagagcagaggccctcgatgcttctgttgcgctgtgcccctagcctggggacccatttgtttcttaacatgctgaggccaccagatgggccctcatggctgcctcttctcacccccctccactttggtcctgggttctaggcctggctgcccacccgacaggcatgagccctgggacagggccccaccatggctgggtctctgcttcctcatcttcgagttgagatggtgaagcctcctttgcaggctactgtgagggtgagagggtggatgtaattgagcgaatgcatgttcagcccagtccaagtgctttagtaaacatttggttttaagattaagttagatagatagcctagctgttctttttgttttccccagtcaggaaagggacctaagggattccattcttctcaggagtgcaaagtatccttagaaatcatttaggccagtcctctgatttttcagatggggaaactgaggcccagagagggttggtccttaaaaaaatataactgccaaccccatgcactgtggtgcccacttcatgccatccacagtgccaccacggtctgggagtgaggcaggtatggctgctaaccatccccacctcacttgggggaaacagaggttcactctgggggagaagcaggggagccagctctgtcttcccctcctcgggggccctgcttggagaaaaagctgagaaagagggtggggggtggggagttaggcaggctgtgtcctccaggcctgggagccttggctgggcagtgccggcctgggtggggtagtgattctcctgctcagcatctgccctgtaggtggggagacttacattcttctcagtaacagtaacaggaaccatgatttaaatggacactctaggatgggcatggtggttcatgcccgtaatcccagcattttgggagactgaggtgggcggatcacttgaggtcaggagttccagaccagcctggccaacatggcaaaaaccccgtctctaccaaaagcataaaaaattagccaggcatggtgatgtgcgcctgtaatcccagctacttgggaggctgagacaggagaatcgtgccactgcactccagcctgggcaacacagtgagacgccgtcccccacaaaaaaaaaaaaaaaaaaaaaaaaaaaaaaagtggacactttgtgccaggcctaggctaaaccactacatgccttgcctgttttatctccccagcaaacaagtgtggcagaggggctctcttgcttcttctggaaagcacagcaaatggcacagggaggggctcggggcccgggacagggaatgtgacattatcaggtacaggtgccagctgtgcctgaggcctccagataacatttcagcctgtccagggccctgctgttcccccttccagaatgacttcctctcttccccacttgtgaatggttctccatcgttttggaaggagtggccctatggagttttaggaatgatgtcagtggtcacagccatggccaggctgtcaataagcccctattatgaatcaggcattgactctttgaaccactcatagcaacccattttacagatggagagacagaagcctacagcaaatgaggccttgcccagggtcatagagctgggcagatgtgaactacgggctgcctgatacacaggcaactccactagagatgactaggactcttgcctgctggccttttggccagttcagtgagaagtgctgaggctttccacctctgaaggtttacagctgtgtgacccagggcaaagccctcaacctctctgtgcctcactttccccacctataaaaatgaggccctaacctcacagggccctgctgaagattgcctgagacaagacaagattcattaacaccctgccaggggcagagtgggagctgtctccacccaggctggggagactggagttaggagccgcagacttttacgctccctgggcttttcattgatttaactcaggcttatttgccttcactgtgtaccacactgatcgaaatgctttccgtggcttaacacatctaatcttcactacagccctatacgactggggttactggtgggcccactttaggatgaggccccagagcggtggcgtctcctgaacgaggccgcaccccgcagtctggaccagagcccgtgctgtgtcttctgtgcagcagctttaaatcggagtggggactggggcttgggggttggcctggctctgcggggttccgggtggttccacctgccccaaggccgcctgcgtcacagctcagcagcgcctccaaaccccgcttcccccgaccccccgggaaaggccggcgggggtcctgcacccgctgcgccccttcccactgcgtgccctcaccgcagcagggcgagccctgcgcggcggggctttggctgggcggccggggcttgtttacccggccgtggggcggggcggggaggtcacgtggccgtgtttatctcggagccggcgcgcgccgtccctgtccccgcccccgcccccgccccctcggtttgccggtaatcccggcgcgcgcccctccccgtgcgtgcgtgcgcgcggccggcgggggcggggcctggcgctccgccccctcccacggggtgatcggttcccgccccgccggcgccgcgagcccagtgcagacccccgcagtcccccggtgtccacgccgcggtccgcgcagcccaggcaacgagcgtgtccccagagccctggctcctttccactctccctcccctggtgtgggaagggtgtcctgggacttgcgggagcccgctttcctccaggcacccgagggtctccgatggtcgtggggtctaatcccttcgatccgcggcgcccacgctagtggcgcgctcctgggttgccagcgcccggctcttcggaagcgcgttccccttggcgcctctgggctcctgcactgcggagggcgcggcgcggtgcggcgcggcgtcctccttaccggctgggtccaaacaattaagatgctggtgccgcccctgccccccacttggggctgcactcggcagccaagtgcgaccctgttatctcagacccagctgcccgggccggcaaccaccccttctgcatccagccgagcctttcggggcgctcactgtgcgccgcgccctgcggtcggacactgaggactggagagggggcgacgccccctcccgcgggctgcacagtcgggggtcccagacgcggtggcctgggaggagcctgaaggcggagtgtggccgagagccaacacgggccggccactgactggctcagtgacgctgggctggctgcccaacctccgtgtctcagtttctccatctgtaaaatgggggtaagaactaagcacctacctcgccagcgccttttgaggatgggtgcggtcctggcggtcccggccgcacacctgctgttactgtagtggtcattattcttgagatgaggaaactgaagttcagagaagggttgggacctgccaggatccacacagcagggacatcagcaagcaatgggcagggcggtgtggaggagcacgctgtggagagaggagcacgaaattccccttcctaccagttagagtgaggagattcagccttttccggggggaggaagggttagagtgtctgccagcctctcgtggcttctgctgtagtttcgctttcggcattctgcaggggctccccagcccttcccagagccccgggcgggcctgagcgggccactttgcggtggctctgcgcgccagggtgtttcctggtccattagtgattatggccaaggctaggtatagctgtaaggagggtggaggaggggcaggctcgtcctgctggcagtgggacagcctgggagggatgtcagggaaggctacaaatacctgactcttaagggtcggctaggagttgactggagggatggggcacccaaagggagggagggccggctggcagggggcacatgggaaggggcagcccaggctcagggcttcactgcgagcccatagaggcccgacaccaagtgggtgtgccagagtgttagaggaagcaaggaggcgagcattctgtcgttgggcagcattttgggactgaactagcgttaggtagttcccgggatactgtaaggtagaggcctcagctctagggattgggaggcggcagggcaggggctctcccaggctctttctgccttttaacccctcgctaacgcccattgccttccgtcttacctagcagagcctctggccaggaccatagggcatcgctttgcttttgtctgtatgttttatacacagtcacacgtcggttaatgacaaggatacattttgagaaatgcattgttaggtgatttcattgtacgaacatcagagtgaccttaggcacacctagatggtacaacccactgcacgcctgggctgtgtaatagagtctgctgctcccaggctacaagcatgcacagcgtgtgactactgaatacatccaaacgtagaaaaggtgcagtaagaatacagtgtaaaagataaaacctgggacaccttctagagcacttcccaggcacagagattgcggggctggaagttgctctgtcacccagacacatgtcactcactgtcgatgagtggaatatgaagacctggtctattgtcaacattgtacacttacgctacactaacttatgcagaaatatttttcacattgaacacttaggctacactaatttatacagaaatatttttcttcagtaataaattaacctgagcttatagtaactttcttactttataaacttaactttttaaacctttttgtctctttttgtagtaacacttagcttaaaacataaacatgtatggctgtacaaaatatttgttttatattctataagctttcttctatttaaaaaagtttaatttattttacttttaaagttttttttaattttaaaataaaatttatatttttattttcattgtttttgagctggagtcttgctctgccatccaggatggagtgcagtggtacgatctcggctcactgcaacctctgcctcccaggttcaagcgattctcccacctcagcctcccgagtagctgggattacaggcgcccgccagcatgtctggctaatttttgtatttttagtagagatggggtttctccacgttggccaggcttgtctcaaactcctgacctcaagtgatctggccacccaaagtgctggaattacaggcgtgagccactgtgcccagccttaaagctttgtttttaaaacctaagacactggccttaaagctttgtttttgaaacctaagacacaaacacacacattggcctaggcctacacagggtcaggatcatcaagacgtcactagatgacaggaatttttcagttccgttgtaattttatgggtccaccattacatgcgcaggccgtcacggacagaaatgttattcggcacttgactgtacatatattgtttttaatggaaaagtttttatgtttgcgtcgatggtgagtgatactggtttttccatttatggaagtcatagtttgcttttaaaataatttaaaccaaaaaagctcctctaaaggcagatacgaagtaaacaggagtgctagtggaacgagggtgtggtgggtgtcaccacggtggttccacagataggtgagctctggagccgctgcgctgacatcacagggtctgccccagcaggagggtgctccctggctgggtggcgagggtagaagatcccctgtagcattacccgggggcctgcgctaggcctgctgaaccattcagccactagacatttaccaaatacctgctgtgtaccaggcccagagacaagggaacttcagacctggctgtggcctgggtggggtgcactgaagagggagactatgctggggatggggatggggtttggagggcggggaggaacagcaacagcagcaaacacagtgcgctgacgacacatcaggcacgctgttactcttgtaacaccctctaaacacttggaatacacatctcatcagcacaagagtcctttacagagggggacattgaggcacagagctgttcaggaagttgctcaaggtcgcacagctagctaggggcagagatggacttgaacccaggccgtgagcctgtccccagagccctggctccttttcatcctctcttgcctggtgtggggcttacaggcgccctctctcctcctggcacccgagggtctctagtgattgtggagtctaacaaggagttggacccagtcacattgtagagtgatatgaaccaggacaactctggtgttgctggagccctcaggaggcccaggctgggtctgtccttgaagtaggtgacaatgacaccttaccaggacagggtgaaggcacacttgcagtgggcactgggtcagcagcagtggcctctgctggtgcacctgcccagtagaagcgatggctctgaccttttttttttttttttagagtcttactctgtcacccaggctggagtgcaatggtgtcatcttggctcactgcaacgtctgcctcttgggttcaagcaattctcctgtctcagcctcctgagtagctgggattacaggcatgcaccaccacgcccggctaatttttgtatttttagtagagatggggttttgccatgttggccaggctggtcttgaactcctgacctcaggtgatttgcccgcctcggcctcccaaagtgctgggattacaggcatgagccaccgcgcccagccccaactctgacctttcattcctctccccaggtacagcacgtgggagccagaagagcacatcttggacccccgcctcgtcatggcctacgaggagaagtacggtgtcctcggcaccgccgggtggggcttagggccggctcagaggcttcccaggagcctgctgctggcttggcaggggttgttggggcagggcaggggtgtccgatggggcaggccagcccagcctgcagctgggtgaaaatggtgggcactgagtcccagggcagctgaggaccctggggccctttcctgttgttgggtgatctcggtcacttcctttacccacccgggcctcagtctctctgctgtcaaatgggccaccctgaagagtacacccatttcccagggtgaaacctcagaggggccgtaagaggtttctgttccagtgaagaatgttaaaatgcttcacaaagatgccctgtgtgctaggaggcggcactgccagttgtgcgggggtgacagatcagagacggtgtctctagaggacctcttagggcaggaaggagtgtctgacgaagctcaaggaaggctgggcaggagcgtgggctttggggctgggatttctgagttctggcctgtccccctgccacctcctgtccaagtggcccaggcacagtctcccacctctgccagggcccctcagggaagctgggcacaccctaacagttctgtgtgccctctctggccgccccccccaccagcaggcagcccaggtcccctgcctctcccagcccgcctgccttgtgcggcttgggaccatttcacaaaatcatttgtatttggcccctatggcaacctcctgaggcaggaatgagggttttgtttgacagagaaggaaactgaggctcttacctggagcccagagcaaggacctggccagggctgccacctccaggtgggggcttttccactgcccctcgctgctgggttcttctggctccttctccaggagatttcctgccatggattcaaaagacaaattttattgttctttccttttaaaatcagggtgtccccatcccagggtttctttctgcctcccaggtgtgtggtggggccttggtccaacagggtgcgacacttgggaatcccatggagcgtggtaaggagagcagtggacaggtatcaaaggcccggattctagtcctccaccagggacactttccctttggtccgttggtgtcctgctggggatggatgctcagtggatggtcagacatttgcaataggtgccgtggggttcattggtatgtgctaagctcagagtaagagcctggcccaaggtcacacgaggcctccacattctttctgttgtccacgtgacctctgtactgggggctgcagagagtgtggatggaaagaactgaagtgggaggcaggatgaaatgactgaatctcctcattacttttggcagttgtttggagtctctggttgtgttgtcttatgtgtcatgtgtagcttcgtggcattgtcaagttgtgcttttttttgttttttgagacagggtctcaccctgtctcccaggctggagtgcagtggtgcgatcttggctcactacaacctctgcctcccaggctcaagcaattctcctgcctcagcctcctgaatagttgggactacaggtgtatgccaccgtgcctggctaatttttgtatttttggtaaatggggttttttgtttgtttttttttctttttctttctttctttttttttttttttttttgagatggagtctcgctctgttgcccaggctggagtgcagtggcgcgatctcggctcactgcaagctccgcctcccaggttcacaccattctcctgcctcagcctcccgagtagctgggactacaggtgcccgccaccatgcccggctaatttttttgtatttttagtagagacagggtttcactgtgttagcctggatggtctcgatctcctgaccttgtaatctgcccgcctcagcctcccaaagtgctgggattacgggcgtgagccaccgtgcctggctggtaaatggggttttgccatgtcacccaggctggtctcaaactcctgagcttaagtgatccacccacctcagcctcccaaactgctgggattacaggcgtgagccaccgcacccggcctgagttgtgctttgtgtttttgatacatgggaaggcatctgctgggcactcagaacaggctggttttcatcctgtcccccgacaagatgggacagacagggtaggagccggtccgctctcccaggttcacagagatcccaaattcgggggagtctgtgcagagctttacttgcagagggactagccattcccatcagctctcctgggacattcaaggtaaattggattgacaggcttctgtatcactcccctaggaggaaaaactgagccacgtttttagggggtccttaggagcacgtagagcagagcccgcacatggccctggagccccttaaggacccactgtttttggagatgctgcaagtcccccctcagcagttgccctccacgtttgtcagatgggaagaccttggccctgggagttgaacatctgaccccgttgttatggccccagccaggcaatggggaggattggtgggcaggcctgtggggagtgtcccctccctgacagacagcagagggcgggcgaagcggatgccttcccttcccttagatgtcaccagtgtttccttttcttctgccacctgcttcacaccccagggaggagagagaccgagcatcggggtataggaagagaggtccgaaacccaagcggcttctgctgcaggtaaccagcctgcctttgtgcctcctttctccccctgcccaaccccaagtccccctctgccccttggtgcatttgcactggctgattgagctgatctgtgtcccctcgcctgtaccacccagggcactgtggggtggggcacttgggtaagttttgatgggaggaattgggaaaagcctgcgtgtggggctggtgcccggggaagacagcctgggtgggcggtgccacctgggagggggagtaggcatatggccagtggaatcctagaattctcaaagcttagaatcttgctgtaaggaagccctgaaagctttgagcctttcgatgctcagaatccctaaacacaaaattatcactgagaatctcagaaacataaacttgagaattgaggaaacatgagaggctggagtttcagaatctaagaaacagaatcttttttttttttttttttttgagacggagtctcgctctgtcgctcaggctggagtgcagtggcgcgcgatcttggctcactgcaagctccacctcccgggttcacgccattctcctgcctcagcctccccagtagctgggactacaggcgcccgccaccacgcctggctaaatttttgtatttttagcagagacggggtttcaccgtgttggccaggatggtctcgatctcctgacctcatgatccgcccggcttggcctcccaaagtgctgggattacaggcgtgagccaccgcgcccagccagaaacagaatcttagaattgtagaactacagccttggaatgtcagacccctagaagtgtgtcatttttgagtgggcctcctgttccagccttcagtcagttggggacccaagtctctgcagcatcccggagtacccacgtcgtaggtcttgggggcctttcctgacctcagtgctttgcagtgacagggacgtggatcttggagcagtgcagtcacaggttgagtctccctgatccaaaatccaaaatgctgccatgtgcggtggctcatgcctgtaatcccaacactttgggaggccgaggcgggtggatcacctgaggtcagaagttcaaaaccagcctggccaacatggtgaaaacctgtctctactaaaaatacaaaaattagctggggatggtggcgggcacctgtaatcccagctactcagggggctgagacaggacagtcacttgagcccgggaggtggaggttgcagggagccaagatcataccattgcactccagcctgggtgataagagtgaaactccgtcccctgccgccccgcccccccaccccaacaagaaaaacaagatctgaaatgctccagaatccaaaacattttgagcaccaaaatgatgttcaaaggaagtgttcattggagcagtctaaatttcagatttttggattggggatgctcagctagtatatataatgcaaatattccaaaatcctaaaaaaattcgaagtctgaaacacttctggttccaagcatttcggataaggaatgctctgcctgtgtgtggttgtaggtaagcctcttcacctgtaaaatgggtatgaagagaatacccgctctccttaatgtaataagacccaccaggcaggatattggaagccagaaagtcaggattcttggtccacttgtatgtggtccatgtcaagcgtccttggccactcctgattaaaacccatggaggctttcgccagagggggtgggcctcccttcatgcagtgggcatgttccattgggtttggcatgaattgagcctaggaagggaagtaacatctcctggacgtctgtgtgccaggctgtctgcccagtgtgcctcacagatgaatatactccatccacatactaagcctacagggcaggtgtgttcgttatctcttcccctctaacatggcaactcaaagcaataaacattgattatttcacatggcttctgggggtcaggaatttggaattgtgctagctggttcttcagtggttctagtctgggctgcagtcaaggtgttggctgggctgcagtcatctgcaggctcgaccagggctgcgggatctgcctccgagggggctgctcacgtgccatcgagtcagggctggacgttgacagggactggtcctcaccatgtggacctctccagagggttgcttgagtgtccttacagtgcagccaccagcttcccagagtgggtgacctgagagagagagcagggaagaagccacagtgtcttttatgccctagcctgggaagtcacacaacacagcactgggtgtgggaatggacggcgcataggtgtgaattccaggaggtgggtgtggttggggccctcctcggaggctggctcctacagtctcttcattgtttcgctgagaaagaaactgaggcccagggaggccggtagcttacccaggacctgactgttggcacccgcgtccctttagtagctgtagttctctcgtgatgaggttgccaaggacgtagaagaccctgccttgcagaatggtagaatgtactgggcttctttttttttttttttttttttcccagacagagtctcgctctgtcgcccaggctggaatacagtggtgcgatctctgctcactgcaagctctgccttctgggttcaaatgattgtcctgccttagcctcccaagtagctgggattacaggcacctgccaccacacccggctaatttttgtatttttagtagagatggggtttcgccatgttggccaggctggccttgaactcctgacctctggtgatccagctgcctcggcctcctaaagtgttgggattacaggcgtgagccactgtgcctggcccatactaggcttctgatggcctgtgagcccgctgggaggagtgggttttgagtcagctgcctaccagatgtgcctcccaggcactgcagtattttcccagtcccctcccagtttagccctcctcccatcactgcagcagccggcacctggggacatgtgatgccgttaacaggcacgactgtgagtgggacctgcgtgtgtcatcccttccctcagcttggaggtgtttgacctcacaggtcccatctgatggctgcactatcttcctgggagctcctgacctctggtagcaggtggcaggagaaggtactgtcccagtgatccagagtctcccaacatcttggcaccatgaatcttttgtagattcatgtaaattctccccaagtaaataagataaatcccgacattacaaactccaggggtggacagacttgccctccagctccagatgtgtcgcgggcaatcagcagagcgggctgcaatcacagagcccaggagccccctggaggggtcggggtgcatctgcaggccaggtggagccctgtccctttggctggatagcatgggcatccggggctgtgtgtgctgctggcctggctttgccccaagcaactccaagagcacaccttggccctctgcctgcaccatctcccgggtgagctggcagtgtcagttttggaggtgctctggcaagcaaagatgcctttcctaaaacgaaggctaactccttaatgcatccagatttgtttctcttggccagttttcagtttgtccttcttgtatgcttctctgctgggtatcaaaggagtaaacgctgggacgcgagtgctctgtggggcccagaggcagggctgagctggccgaccctggggttgcccggggcgcactctctgggctggggtggggtggggtgatggccagccgtggcatgggaaggagttgagtgggtagacatggcatgggaagggcattccgggtgggaggaacagcatgagcaaaggtgtggcgggtgggagggtggggctgacccgcgctgccctggcttgcccccgcagcggctgtacagcatggacctgcggagctcccacaaggccaagggcaaggagaagctctgcttctccctgacgtgcccactcggcagcgggagccctgagggggtggtcaaggcgggggcacctgagctggtggacaagggccccttggtgcccaccctgcccttcccgctccgcaagccccgaaaggcccacaagtacctgcggctctcgcgcaagaagttcccgccccgcgggcccaacctggagagccacagccatcgacgggagctcttcctgcaggagccaccggccccagacgtcctgcaggcggctggcgagtgggagcctgctgcgcagccccctgaagaggagggtaaggcggccccagcccagagaccctcagagctggaaagggccctatgggtcataaggtccagctggttcaatgtccaaagagggcctgtagtgctttgtggggccagtcgggtctgggctcagggcccaacactagcccagggctcctcctgtcgtcccgctctggctgagctcttgtctaggtggggaggatgcacccagtgccctcctcccaagtgtccagccctgtgtgaggccctgagctgactgaagacacagagaggaggagctggagttggggtcgggttgggtggtctgcatggcttcccaccttgtcaacgctgcccccatctgtgtgtctgacgctgcagcagatgccgacctggccgaggggccccctccctggacacctgcgctcccctcaagtgaggtgaccgtgaccgacatcaccgccaactccatcaccgtcaccttccgcgaggcccaggcagctgagggcttcttccgagaccgcagtgggaagttctgaatcaccgtttttactcttcttaaactgttttcttttgggcttggggtgggacttccagagatagggatgggttgggggcggggtaattattttatttaaaaaaataccgagcagcaaaaggggagaagatcccactactctcccaccacctgccctttctctgagggacgtttaccacgaggcctcaggctggggatggagagagttgctctgggagttggggtaccacccccagggcaggatggggacaggatcacctgcccgggacaccaccattatcattctcctctagtgacgcagcagctggttctgggagttaaaggagcattggaaggcccaaaccctctcccttgagtggccaccccagcctggttggctggttttccccttttctcttgtttcaattgggtctttaccttgaactctcctctctggctttgcggtgggctgtggaggctggttttgaccaaaagtgagtggggcgggaggaaggggcaggaggaagggttgaggttacttggggcgagtcccttccccttcagagaggcttctatccttcccagggaggaggcgccgctgagacccttctgctgagagctctgccctcccctcatcacctggcctgtgcagaaacgctcatgcacacctggctgcacaggtgtgcacgcattacccttcgcgtgtacgttcccatgtgccccgtgaaagcatgtgtggctgcagacgtgtccacatgggccttgcgaacctgggttagaaaccctggccaggcgaacgtggggtgattcacagcacaaaagacctcaccaccacacctgcactcaccccaccttgcatgcaccttgctacctgcttgcggctttcagtggagggcaggggtctggcacaggtgcgatggcaccccatgctccaggcatacagatgtggtttctcggctgcaccgggccaggctgcgggtgtgcaggcgtctgctaagttgtgtgatgtatcagcacaggctttgagacgtctggaccctgtccttcctcccgtgaggggttcttgttctttctgactcaggtgacttttcagcccttccaattcccctctttttctgccctcccctccaactcagccaacccaggtgtgggcagtcagggagggagggagtgtcccaccacgttctcagggcagcccttgactcctaagccccttcctccttccattctgcatcccctccccatccaacctaaatgccacagctggggctgagctgtattcctgtggagggacctctgccgtgcctctctgaggtcaggctgtgctgtgtgatgggcaggctttgccccagcccacccctggcaaggtgcacttgttttctggtttgtacaaggtgtcctgggggcccgtggcttccctgccagtgaggagtgacttctccctctcttccagtcctgtaggggagacaaaaccagattggggggcccaaggggagcatggaaaaggccggctcccctgtctttccttggctgtcagagtcagggtaacacacaccaagagtggagtgcggccagcaagtttgagacctgcccgccctcctcgcagctctgctctgtgtcctcaggaagtcacagagtctactgaggcaaggagagggtgattctttccccaaatcccttcttccctggttcccaaaccaaagacagcctgcagccctttctgcatggggtgctctgttgacaggcttcccagatccctgagtctctctttccttcctcctcgatctttagttgtccacggtcaattcagtgcttccattgggggacagtcccctccgggatgacctgattcacctccagcccagggaatggaatctagaggaatacgtggggtgggtctggacaaggagcggcaggaatcaccacccatctccagctgtggagccctgtggaggggaaggggaagcttggggttcagaggggactcttccaggagaggggtgcccagcggaggtaaagatgatagagggttgtggggggtctctagttgaatgttttggcccatgactttggaacatggctggcagcttccagcagaagtcacgctccccatcccccaggggacataggacctttttcctgcttcctggtcactttcaaagaactatttgcgcaatctgtgggtctgtggattcacggggctttctgtgtgggtgctgcagttgcttttgtctgcagcagcaggacacatctttcctcttactcagccctttatggcccatggggaactccgtggctcagggagagctgaactccaggggtgtgacctgggacgggtgggcctgaggtgcccagctcagggcagccaggtggctcatgggctgtagtgagccagctccctgggggaaaaggctgtgggccgttaggaccatcctccaggacaggtgacctctatgaggtcacctacggctgtggccgtgcaggcctccttccagcccagagtggcccagtagagcaaggcagacagtgacctccacccccgcagccctcttaaaaggccagtactcttgggggtggggggagggtttagaaagcatttgcccatctgcctttctttcccccagcccccacccgctttgaatgtagagacccgtgggcacttttccttttgtggtggggggtgcggaggaggtacccccacccctggcacagccgcctggaatgcaggactgtcactgctgttcgggtgatgacctcgttgccaagctcctcctgtccccttgttctgggggcaggcgctgtgcttctgtgaggtggtttagcttttgctttcgaagtggccagctgcggccaccaggtctcagcacaagagcgcttcctttgcacagaatgagcttcgagctttgttcagactaaatgaatgtatctgggaggggtcgggggcacgagttgattccaagcacatgcctttgctgagtgtgtgtgtgctgggagagtcagagtggatgtagagcgcggttttatttttgtactgacattggtaagagactgtatagcatctatttatttagatgatttatctggtaaatgaggcaaaaaaattattaaaaatacattaaagatgatttaaaaaaaag

SEQ ID NO: 37819 - DNA, 242421 bp, Homo sapiens
gcgcgcgggcggcgtagccggcctgtctgggccgcctcgtggggagggagggggcgcccggccgcccggcggcgaccccggggcctggccgccaccatgggcttcgagctggaccgcttcgacggcgacgtggacccggacctgaagtgcgcgctgtgccacaaggtcctggaggacccgctgaccacgccgtgcggccacgtcttctgcgccggctgcgtgctgccctgggtggtgcaggagggcagctgcccggcgcgctgccgcggtcgcctgtcggccaaagagctcaaccacgtcctgccgctcaagcgccttatcctcaagctggacatcaagtgcgcgtacgcgacgcgcggctgcggccgggtggtcaagctgcagcagctgccggagcacctcgagcgctgcgacttcgcgcccgcgcgctgtcgccacgcgggttgcggccaggtgctgctgcggcgcgacgtggaggcgcacatgcgcgacgcctgcgacgcgcggccagtgggccgctgccaggagggctgcgggctacccttgacgcacggcgagcagcgcgcgggcggccactgctgcgcgcgagcgctgcgggcgcacaacggcgcgctccaggcccgcctgggcgcgctgcacaaggcgctcaagaaggaggcgctgcgcgctgggaagcgcgagaagtcgctggtggcccagctggccgcggcgcagcttgagctgcagatgaccgcgctgcgctaccagaagaaattcaccgaatacagcgcgcgcctcgactcgctcagccgctgcgtggccgcgccgcccggcggcaaggtaggcgcctgctgcccgccccgacctccagccaggatccctggggacccagggccccgccccatccctttgggtacagggatgccccgagcttcccgggaacatccttgcttcctccctcttcttccactgcttaccagctgtatcactacttgcaggtcgctgaacctgcctgaggtggaacactgtggtcctttatagtctagacgtaaccggtaaagtatagctgtacagcttcagggattctggaaggacgaaaaagaattcacaagcaagtgtaggataagaatgaagaatgcagctccagagtcaaaactgcgttcaaaggctttgctgctcagaccagctaggggatctcgggcaagttgcttaccctctagaggtcagaaacctatagactgacacttaggagaggagagatggacacattgggtgaattgtatccgtgcatcctctaggattccagaaaaaaaaataaagggaacccacagccagtgtagattaagttaagaaggatatcagaagagaggcctctggggtaaaagctggatgcaagcgtgggctttgcagccaactagctggctgaccttgagcaagctgcttaacctctctaaagttggaaactatggtccctagagacgtggtatacagagtaaaaacacagccaggcacccctgaggtattcatccagggatttcagaaagaattaaaggagcactctgcccccaacaagtataaagtaataattaagtgtgagtcctctggagttaaaactgttttcaaatctgggctttttgctgaccagctgggtgagcttctggcttaattcccagatccctcagtttccctcagtgcgaaaggtttttgtcaggcttcagggagagagtttagtagaagggcctcgtactgtgcctggcagagagtaaataaatgctcaacaagtgttacctagaattatttttaacatctccacctgagcggtccccttgagcgagggtttactttgctccaggctgggtgctgcattcttcccagtcatttcctttttaatcaagtgaggttggtgtgacccttcccacttagtagatgaaaaaactgaggctcattaaggggcagtttcatgcctgggtcacagcttttgggtgcaaagctgcatgttgaacctttgcgtgcccatctttccagcccacgttctataaactatcatgttgctcctcagtgcaaccacaaggaccatttattgagtgtttattaagtgccaccaacaataggaagtactttacatgcattacctatgttgtcctttgagatgagggaacagactcagagaagttatataacttgtccaaaattaagtagtgactcagggagcagagccggactcagattctacctcagagttctcagttttggggcatattggcattttgggccccataactcttagttgggaggggaggtactgtgctgtgcattgtaggatgtttagcagcattcttggcctccctcccaagtcgtgacaatccaaatattgtcaagtgtcctctggaggggcaaagtcgcccaggttgagaaccactggtttccctgattgcagaagccacattttcaacagctgggtacttctgccttcctggggaggggcctgggcctgctgccaccgctctggttgcctgctccagatggtgtggcagaaaggggaaaatatttgcccgaggctcccccaagggcctgtgtctgctttgcctctctctgccctctcccagccccctttccttacgtgcacaccaggcctgcaagttttccgacctggccccccttcctggcccctggcctgtctgtcagctgcagtctcagcagctggccagctctgggcgaagggcaaatatttacagctccacagcttgcccaggacctcacaggcacacaaaagactggtgtgagccttcgaatcaccaaaacagagggcaaagcttggtcttcaatcaggcgccagatttagggtgaaggagttcccgagtttctgctgtttatgctgtcatctggacttccttcgtcgttttaagtgacgcttatttataaataagccattcactgccccagagtttatgcatcatttattgttgagctagtttattatttcttcttaactttctgttttctttctggagtgtttgggtaaaatctccctcagagtcaaaaatatgatacttgaatcaaaactgtggatgtttttgaggctctgttgagttagtgggtagcataaagaaggatgttaagcttagagacaagatgttgattttgaacttacggagaaaggtttgttccggtgttggagccctgcttggaacttttaccaacctcagtgccagccttgagaacagcaaaggatggtctggcccagaagctgccctagatagtttccctggcctcagacccagcctggcctcagctgaggccttagggaagcttgctgtctctccttgccccgaaattaaccctcagtggcccttactgaacgcttttgctgttcctgggtcaaccataaaactcctcccattggaagctgtttaagaacttgtttatttcattgggccggctctctgctcctgctgggtactgtttattctcttctaaaaggcagaaggatttatatgtcctggaaactctcatgtgcaacatttttattttctttttaaaataagccctaatgtttgcttctctgttataagctgaaggagattagaaacactcagattttcagtaccagctcttcagcagcctagaacttgcacaaatgatgtggcattctttaaattatcttaggtttcagtttttttgacacctgctgaacgcttagggtttgttagtgctgtaccagcatagacgttgtctcttctgttctaccatgtgagctatattaaggattctcaagccttagcgtgattggagtcactggagagcttaacacagattcctcagtctcacccctagagattctgatccattagggctggccaggggcctgatattctgcatttccaatgagctcccagatgatgctggtcctttaagtagccgctaagctagacgaagagcttacgctcaggtagatatagaccaaacatgtattggtcttcacacagttatggtttcactggtcattgtctaaacaccttcctaaatttcttaagaccaggataaaattttaaaacccagactgcctaggccgggctcagtggctcacgcctgtaatcccagcactttgggaggccgaggcaggcggatcacgagatcaggagatcgagaccatcctggctaacacggtgaaaccccgtctctactaaaaatacaaaaaattagctgggcgcggtggcgggcacctgtagtcccagctactcgggaggctgaggcaggagaatggcgtgaacctgggaagcggagcttgcagtaagcggagatagtgccactgcactccggcctgggtgaaagagcaagactccgtctcaaaaaaaaaaaaacaaaaaaaacccagactgcctagcagttaaatgacaggtaatcatagcctagacaggcatctctgatctcactgaggccacatctgagctgcagcagacttgggattgctacacttgagtgagttaaagagttctgctcccagcctcagtttcccatcctgacttaccccctgattcttagagcaaaagcactccagagcaaacatcttttttgcttttctttctgggaaaggaacaattctggacataactttccttggattgattgaaaaacttgagatacatcctcgataccttttgttctttaacctcccatccggtctgtctttgaatcctgcggattttacctcctaaatacattttgaatctattcacagctctccagctcactcaaatgaccaccgtggtccaaaccagagtttctgaatcagcactgccaacattttggaatggataattcttgggtgtgggtgtgttgttggtggtggtggtagtggtgatgggggtgggaggctgacctgtgcattgtaggatgtttagcaacatcccgggcatctacctacctacctactagaggctagtagcgctttccaagtagtatcaacagtatttgtggacattgccaaacgtcccttgaggggcaaaattggcctttgtctcagacactcttgcctggaccataactctttcctctacaaatcttcttgctcctcttcaattccttctttacctagcatcaggaattaatctcttataaatgtgtatcttttatcactctccctcaagcctcctatgctgtcccatttctcttggttggctataaggtccaacatgctctggatcctaccggcttccacctgcctggattcttctccccttcatcctcttctttcagcttctcatgtctctgagagtcgatgcatgtgcccctgagctcctctctgcctccaggcctttgcacttgctcttctgtctacctggaacaatcttaccaagtactctgcactaaataacctgcaaaatttccacttctctcctcttgcccacagcctttctgtctgcacttaggatttgcttatcactagacaatggttctttctattctcatctcagctgaagcatcactacctctaggaagccaggcctctcggacctcgcagactacatctggtgccctgagactcttactttggttatcctcctgcatggcatttatcatagctgtaactaaataagtggaagagtctgtcttgtccagtaccatgtctgtggcactaatccattgccatgtgcactgtaagctcttgatatgtattcatttggtgatgagttcaagattgaaaggcctgtcttggcagtcatcaaaacttttcaggttgctaaccaaaagtgggctcgtgtttaaaaagaatgagtttctccgtgatgacccagttaacaaaattgttttcaggtttaggggaggcattatttttgttccactagatccacccagatcaagttttataaagccccaaatcctagaaactattttgtccttttcagaactggaaataagtaaatctgatagacaattgtatcaaaaggtgttccagatgtccaaacactttgaaatgtatctgttagagtattcaccatgaagtatattttgtttctgaaaagctcctgcacagggccattccatagtatatctaacaaaacagcgcacttctgctaaaaaaaagttacagattgtcacttctatttcatttctgtgatttataaggaaaattaggatttgttttacaaatatgttacccagctacactggattaaatgagtataaccagacaatttgaattggcaattctgttgagatttgtctgtaagtggctctttctgtgttcagaaatggtgcttgcctcgctataaaaatatttgatgagtaagaatctatttataaggcaattatgcattggaccgtagaccaaggagcttaaaagaaaagaaaataatattcattgagttccactgggtgccatacacttaaggtgctttctgtatgtgcatacattatcttctccatgttcttcattagatagacctctttttttaatgggagtagcagattatgaaagattaaggctagaagttagattctaaatgtagagctgggatttgaacccagtgtggcccatctccgagctcacactgttaccaaaataagaaaagaattttttcctggggcggtgcccttctctgaagtctcacacaggctttcaaagcaccattattatgtatgccaagtactgtttggattggaggtgtacatgcattattttatttcatcctcagaaagaccctgcaaggtcggtgctcttacccatgactctttccttccattttacagatgaaaaaacagaagctcagaaagttaaataacttgccaagtgtcctccactggctcatgttagtttgcctgttggcttctggtccatgaaatgttttcatcccataccatgttcccatttacataggtccagtgtagagcacatggagtacaaaacaaaacagatcctggctgtgaaagagatttaggctgggcatggtggctcacgcctgtaatctcagcagtttgggaggcctagccggaaagatcacttgaggtcaggagtttgagatcagtctggccaacatggtgaaacccagtctctgctaaaaatacaaaaattagccaggtgtgctggtgcacacctgtagtcccagctactggggaggctgaggcaggagaattgcttgaactctggaggcagaggttgctgcgagccaagaccagatcgtgccagtgcactccagcctgggcaacagagtgagaccctgttaaaaaaaaaaatagatttagacaaaaaagagatgatgtcctggatggaatatgagaacagctctttaatttttatcctggtaattttaagagtggttaacagtaggaatgaagtgaagttcttccaaatgtattctgcagtttagctcctcacattctcatacccctagtgccaggccctgtggtaggcaccattggatagaaaggtaaaactgagcagctttaacccaggggatcaatcagacacccacatatgcctttgaaagcacaagtcttactattctttgctcacccaagcttttatgccatgggttagcctctgtctccccttgactaatagtgtcctaataagcctgttacaataagaaagggaagtggtataacataatgattactcttgtaaagaaaataactaccagatggacctgagcagccatctttctcactcattccatccatatatttacagggaatttaaagagcagaggcaccgcgtaatctttgtatgttgcaggccttgcagccaccccatccccaggaagggcagtgatgagcttttcccctggcatcagcagtgtgtgtgcagagaagagtcctgggcaggagatcacccctagtattttgctaaaagctgtttttaggtgccccgtgtctttgctgtgtttggataggtgagggatgaagtcccatcagatcgtgggtgaaggttagatgcaggcgttgggtccacaggctgactccaaggtgccctgaatagagctagtgtattgcgtgtggttagtatccatatcctgggatcagcaatattcgggttcatgtgttctctttgccctgttgttgagggcccctgggaggctcttctaaccttcaagccttaattgcctcacctctaaaatgggatcataatatgcctgttgttagggttgttattaagatgaaatgagatgatgtacataagggcacagtaagtcttatcaagcatttcttgactgtctattaagtgctggacacctgtaggattttaacattttttcaaataaatcactgaagaaagtttaggaatttaaagcagttgttatctagaagaaaagagattgttactcaataatttggtttcattgtaagcctcctgctgcccctgagtaacccattctctggatttctatcctctgtctgttttgcagtggtggaaatgtgtgaaagagggatattcaagttcatttgggctaagatgtaaaggtggagggctaaagcttatgaataacatatgggttacagagttgtttatgtttttcccacccaaattaacaaagctatggagagactggccagaaaaacctcctaccttcatgtaagcaagtgcacttatggttttttagatgagtagccttgctttctatcttagtctatttgtgttgacatgaagaaatacctgaggctgggtgatttgtaaagaaagaggtttgtttggctcatggtcctgcaggttgcacaagaaacatggcaccggcgtctgctcagtttctgatgagggcctcaggctgcttccgatcatggcagaaggcaaagactagcctgcatgtgcagagattacatggagagaaaggaggcaatggagagagagaggagagaagttccaggctcttttaacaaccagctcttgcaagaactaatagagcagagctcactctctgcccaccaccaccctgggacagcattaatctcttcatgaggtgtccacccccataacccaaacacctcccattagaccccacctccaatgttggaattagatatcaacagagatttggggggacagtcatccaaactatagcacttttttctttatttagggaagaaaatgcttctggttggtaattggatgtatacatttgaaaaccactctgtcttaggccatttaggctgctgtaacagaaataccagaaaccactctgtcttagtgcatttaggctgctgtaacaaaaataccagaaattggatagcttataaacaacagaaatttatttctcgtaattttggaggctaggaacccctagatcaaggtgctagcagattcagggtctggtgaggacccacttactggttcacagatggctgtctttctgttgttgtgctcacatagtagaaagggtgagggtttctctcttgggcccctttataagggcactaatccctaatcacgtcccaaaggccccacctgctaataccatcactttggggattaggatttcaacatatgaattttgagggcacataaacatttagatcgtagcacaccccataagtaagtggaagtgttaagatgctgtaacaccttaaaggtttgttggtgtcatttttggtgaagcattgcttgtggttgttcaccagaaaagcagatgagtcagtgacaaaaatgagagagaaaatttgaaatcaagctcgtggaaataagaaattagacatttatggattttttcaggttgtgtaaatatagtagcagacttttttaaacgaggaaagtactgaaacgtcttctcatattagttttcaaaaatatctcgtttggcttaggaccatgtgaactattgtgcagatattatgactctggaaaagctcttgtttttttttctacctgttcccccatgccctttgtctcccttcattctctctacacctttttctgatgacagaaacatcctattaatacttttgttgagtgtctcatccaatttcaacttaatttcaagcaccgtccttatgactaccttcagtcttaggctttggaacagtttcctcttatgttcttctgcaagaatcacttccttagagctgggttgaattacaaggcagggctggtccaaactgcttcaccattaagaattttaaagttttaactacaaagaggacaaaagcatctgagcatagggagtgaagacatcagcaattcttcagtaaagaatttctggcagccagctctacctcttggtcccctcaactcccatctctgcacatttttgcctggaaacagccaaatatacagtgctttcatgtcactagtcaacagacagagctgtttcccagctgtgtgaagactagtgagtctttgtgaactttgcataatctgaggctgcgaggtgttacatcacacagactagcggtcagtcagttacatttctcaaaacctactgggcagctttccagtctagccagttctctgctgtgagtcccacaacagacatcattagggaacacctgtccttaggcagaaaaggagtttttaaaaagagtccacattgacagtggcgtggatggaccctgtgaaccaccacactcattaggagatgtcttgtgtccaagcttttgaggctggatggtttggaggagaatggtgacagagtaatactaaagagaaaagggactttgccaatagatggttcacattcttggatgcttaaaaaaatgcagcctcataagatgtcattttgacattcaaattacattcaatttttgattttccactgtgacttttcttcccccaaccaattcttatccaattagaccttgagttgaaagctgagaagattatttggggtaattttaacattgatctaatagttacatgttcaaatatgatagcaaagcttcttttaaacaaaatcaactgtatcttcttgaaaagtgagcttgcatttctgcttgtgacttggcttaggcactttggatggttcatgtcagtgttaaggtctggatacccacaaccccttctccaaggttaatatgtccctgctttttcttaatcctaaagacctaagcttctcccagggagatcctgtgttgcattaggggcccagctaacctcttgaattgggtttgggtgggggctggggtcctaagtatctgatagagcttcctgccaagcccaaggaaacagatgtcactgggctccagaatatgaccagaactgcccttctgcaccctgcatcccaggttctgttgagaactcctcagtcttcagggtcggggttactgaagggaagagacacttgccctctgggaagagttactgaatagaaggcaactctgtgaaagctgccaagaaggtgccactccatttccatttgttgtttttcctctgttcttcaccttcttttcgtaccaatccatcgagacccactgatatggtagaacttggagcagtctgtagtgtgtagcaatccccaagtaccctgtactcccagactccccagctcgtttctgtctccaccgttcctaagttcaccgtttcttagtcttgatgtttctcctatcctgttgtgagccaaaatctgtttcccttcccctttgctcctgtggccatccccttccaggtgtgaccatgttatgtatgtgatttccccttctcctggcccacagcccacttggtcagtatcatctccctgtcatatctgtgctctactgaaagtccaagcggagctgctcccctcgtcttccttcccatggctcctcccaccaccttcagaataaaaattgtctacctggtggtcactccactggtcccctaaaatgtgccactctttttccagtcatggagaaagatagatacagttaggaatatataatgatatttatttacttagctttcaggccccagctcttccaaacttgctttagcctaagttaaagtgagattaggcattctccattgcctagattttgtagaagagtaatgtatgtgggaaaagagcatcatgacctcggtgttgaactatgtgaatgtccagcttaacactgtgccttgtgttttgggtgctaattattggccagatgccatactgaggcagtctttgggtatctgtctatctcagtcatgcatcctagtaacctggtgacatgagaactggtgacatgagaaggaaccattatcattccctttctgtggatgaggaaacatcacaggttctgactctgatgttgcgccaatctgagattcctgaagacatcttaagtccagccctgaactcagagaatctctctcaagggacaattaagacaatgcccaaaacacatttctcagccagacagcatcttgcaaagaatgtttttgaacaaccaagttcaccttctctgcttccttgccagatgcaatggacataatggtcccagaacttaaccattatgctgctcctgtcatggcataatagtcttattatacttttcagggtataatagacattcttaatctttgcaattattattgcatagtccaaagaagccttacttaaaactctaattgccagatgaattaattgtctgatccttcatgccaggctcagtctttggaggcagaaggatttagaacagggtgcaaacatttaccagcacagtacaaagatcgtaggcaccagagtcacatgtggacctgggttccaatcgtgaccttcccactttgccactatgtgatcatgagcaagtgtctgattttccctgagcctcagtttgtccaggtttagagcattgatacaatgtctgcttcggaaggcaagtgtgtttgttggcttatcagtttctatgaagttaggctcatttctctctttgttttactatgttttgagaccattgcaaatcatgggttatgataaactacccaaacagaccaatattggttaaattttcctgtaaatgaaagatgctgctgcctatcacagttaccatgtctgtgaacagtcgggaaagcagcttcgataagagcctttgcccttatcccatttacacctcttttcaattggtgggatgtaactgaatgataattatttaagtaccctctatcctgaagcattttgaccctaggaacaggttaaatgggtaagcagaggttaatgttaacatgttaaatgttttatatgaagactatctgtttacaatctcaattaatacttcttgtgaaaaattagaagttaaactaaagtagttaaggttgtttgtggagaaaggagtgaaaaggaaaaaccagaatcacgttgtcaaagaatagcaattaacctttggtaattagttggagaaatgaaaggaattcagcccagactgaacattttcttttatccctccctgcatcctgtgtcgaatcttctacatgttgctttactactgtaaatcaactctaaaataggcaatgcagcctaaagccaatgtctgacacttgtggacagtagactagatcaagatgcttatagaaaataagaacacccttgtttctccccagcattgcatctggcaagaaagcatagaaggtcagcttagttgttcagaaacattctttgcaagatgctgtttggttgaggaatgttgtatttcagacagtgtcttaattgtcccttgggagagatctctgaggtcagggctggacttagatgtcttcacacatctcagattggttcctttggagataaatagttcagtaaacagtttggaattttgttctgatactggcctcctgggtaagccttcctttgataagttcttttttggaatttcaacaataaaaccatcttgaacaggacctaagatgttgctaacccatgtggaattattttttatattctacacagaaagagagtagtatagaagtgtaatgaagatgtaggattgggaagtatgggtctgaatcccagctcaacattttactagctccttagcatgggacaactttcttaatcactctacctcagtcttcccacctatatcatgaggatggtaatagtgcaatttttaagattggttggattaaaaaatgaaataaagcattttattgtcagtatagtttctggcacatagtttgcagccagtaaatgttagctgttatcattgtcaatgcaatgtaataagattattttcttcttctttttttcttgaataagtggttatcacacagtagattgaagaccaatcttttaaatcatatgattgtgcattattctttgtgcatcacttgagattgtcaaactaaagccatctgccttggattactgtgtaactgtgcagtttctatcattgattaattatgaaagccagacatgtaagatatgtaagataacttgccaaattcccatgtatttctaacttttcacccctttaagatagcaaagtaagaaatggacttagtgagattttcagcgtcctaagtagaaagacataaactgtttcaatttgaaaatcatgtttatatctcaaaactattaggttgattctggattttcttttagagcagtgaaagttattgcctattaacttgttacagttcaaattggttataaagagggatagtgttgatagatgcttttgatggtggtgctgtttgtcagaacattttttaaaaaccaatagcctgtcattaaagaggctctgctgttttttgttgggtacagtaacttgatagagactagcttcttttttatatataattctgtattttatatattgagtaagtgactcttaagaaatgaatgctgtgttgtccttataggacacctagttctttcatcagaaacagagtatctttttctcagaataaattgtcatttttgtttttacagtgtatttctaattgatgttgaggctcacaagaaagttctgaaaatgtctttaatttggttgtataataactactcgtgagaaaggggttgtggttattaagactttaagcatggagataattctacatggtgaagcccattgatctttcgtaatatttttttagctctactgggcacagttctcctggcaaaatgtgaaaccagagttgcacattgacagccatagcaataaatgaagcggtgctccagaaaactcacagggcactgcaggtagaaacagtactttcctttgccagtgtggttgagtcagagagttgcattcatgcctttccaatgtggccatttatttccccagaaaaggtagaagacaaaagtttgaacagaaagcaaaaatgtcagagtaaaatctctcttgtcataagctgtcagtgttatgtttaaaacagcttattaaatattttatatttaaaagaaataccacatttgaatactaccatgtttaaatagaaaacgttaagtgaagcaaatgccgatttataggcagtacacaggctgtgatgttttgcatatcatccatataattgaaaactgtcaaaggtgtatcagcgagttgaatgtttatgtcaaagaatattacgtgacagttttcacataaggttaaatctatttttatctgtctgctgtcacttgagagtgttagttgagaacactctccctggcatctctgttgcctttgactgtcgaacactatgctctgtgacctgcctgggtcacttctacttttttgatttaaaggtcacattgaccagccttaaacagagtgctttctgttaaacagctctgcgtctcgtgtggattggacagtaattactttgtgaaaatgccccctcccccttttcagtaagattcaggattttttgttttctgtgtgtgtttgcatctcacttttcatgcactatttttccccaagtctcccaaacagagatggctattgatgggccatgcatgcactcacacttccgaaagaattgctatttgaacctttcatgacatgacatgaatgctgctgttgagaatggttgagaaacaaacagaaagtagccgtctagacagcctgcgtacgatgggccggtcaaaagaaagatgcatttgcagaccaaggtgtcattcatagaaaatgttcattgggcatgtctggacatctccagacattcttaggtggtcattccagggttagatggtatctagaaatgtttataagcccttaaacacaagacagaatttcagattgggttccagaagtttccttggttaaacttcccaagagataacaggatttgtaatgattagctgagtagtccttgagtacacttagatagaaggaaaattcctaccatctattccctgttggtaaataaaagtttgatctcatttgttacctgcagggcgaagaaaccaaaagtctgactcttgtcctgcatcgggactccggctccctgggattcaatattattggtggccggccgagtgtggtatgttaattactaaaatgtgtttttccttttcctggtgtagctggaaagagaggtcaaggtttgaaggggacagtgaggagcaggaaactttgctcacttcattctgctctctgtcattagagggttcattggctgtctaacatcttcacacttagggatttttattgcgtagtctcctaaaacagcattggcctagtaatataacagctaatttaaactgtttggttttgggggtgcatttctttttttgttagggggtacatttctgtttgtatagcagttgggctgaatgaagttgcgtgagatgtgtgcagttggaactgggtaaccagccaccgtcctagaccgagctggagtgtggtgctccagactggaagcctgatcttgagttctgctctgtcagctgttcattagtcagagacaattctctaatttgtgggtgactgcatccctttgctttctcttcccactgcagctctttgaccaccacattcatcagcagaccctcctctagaaagaagaggccgaattcaaatctgccagtttaattatggggaaaatgttcaaagaacgggctccagagagtagcagtggatgtgtttcagaatctcacacttcaagggggattatctgaatatgtcccatcctttacccttttcttttcctgaccatctccttgtttattagcttaaaaggaaagtagttaaaggaaaagaaaacaaaaatctttcattcaacaaataagtattgaacataggctgtttgctaagggccaggagatacaatggaggccagaaagactgaggccctgtggtcattgagtcctggtggggatgtcagacaagaaacaagtgaatacaataattagagattggattggaagaagtatgatgaaggaaaaaaaaatgggaggatggcacatggcagataccagccaagaagcaaagggtatcattagcttgggttatcaggaaagacaagaggagatagtagtaaacagaaacctaaaggacgagaagatgccagccatccagataggaatagtgtgtgccctgccctcatggagctcacctccagatggagagactgatgagttgggagagcatagcactgctctcattgatgtactctgtgcctgcccacagctaatgatgccctgggatgagttaaccctgcgggaggaggtgtcctggggaggggccgttggagctgagttcagaaggttgaacaggaatttgctagatcagaggaccatattttatttgtatatataatgtgtacacagtaccaaacgaatacattatgtgccttataaaaagttacgtacaaaagggagtattttaaataatgaaattaaaatatgactatgaagaaaatgtgaagtatgttctcctgccattccaatgcattgtgttacacgcattcacctgtgaagacccctgagctagaagaaagcggttggacgctggggttttgcaggggtggggattggcgctcatacaaggcctggagcaggaacagagttgggaactgggggagctgcaagtaagcagagtgtggaaagagttgagggatgggcagggaagtggccagaaagaggcctggtgaagaaaacaagggcttgaccccaaagggcctaagtcttgagtctgggatttaaattacctagggcgggagtggccaacacatggcttcagttgaagggaatgacacaaagagatttatgattaaattccctttgcttttagcccattccacagtttcaaaaagaaacaaacaatggcttattataagaaacaacaacttaattatgtgtttgcagttgttaaaatgatgaacattatctgtcttatcaaacatacatataaaaaagaacattttaaatggtgagactaaattgtaaatatgaaggtagatggggacagggataattcccactttattgagccccagggatgtcatcacatggttgtatttcttgcattcgctctgtggaattcttaaaaaactatagaaccgcgtgaggttggtatatttttattttttccttttaccagttgtctgagatcccaggctgcatgtcatcatgtgctgttctgatttagtccttgctgccaggggtcctccgtactctccagccttcggagggactgagggagcaaactgcactcaaatatctagacatttggctccaggaagcagcagggtcagacttgagcccgtggttcagaacatgagcccatgttctacaacttaccatcaagaacatgttttgccatttagcacagatgagttggctgttccttgtttacattcataattattcctccaccctttgttaccagttttgagaaacaactttaataaattaagattcacttcacaattaggtgtttcacaagctatagcaaacaaaagaacccaaaccaagaagacctattccctgccccaggtctaaaccacaccaaagcctactgttggaaattgctcaaaatggagaggcctgtggccaagtgattgttgggaaacctactgtgttaaagccagtgaagatggtgttcagtttccacactcaccaggtgcaaaatgacattccaaccccactggaatacagttcttccctgtgcttatcaaagagcatgtctaagttattttctttttcttttttacaaaaggtgctttaagtacaagccagacctgattttgtagcttgcattagtattttcaatttatgtggtctttttgcaagaactgcctgcatggtccccagaggaaaatttaattccatgtgcatgtgtttgccatagtgtttttcaaaatttgccctgattagcagaaatagcatcatgaaacctgaatgtattctgcactgttgcctggaaaatctggcaggtcattgagtacatgctaaaaagccaagatgagcaacaatgcacacacgttgttagttactagaagaatacagtacaaatgatgtctgtgtttcccaaggaattcctgtgttagatgcttggttgggttgtgaaatagcccagccatagctctgacataaggcttttcattgcatgatcagtatgcaatactcttagcaaaatcatatcattcatttgttagtcctcataaccctaaagaaacagcagctagtctgttgtatcaaacctctcacttaagcctttgggaagtgtactttatcgttaggtacccttgctatgaaaacaatcccctttcatttctctcttactcaaggcagcaaaacaaaataaattccaagtcatattagttcaccttgataaatagctgtaactaactctcttaggagaggagccaaacaaactaagaataaagagatgccttttaagagagaaatctagctttttttttttttttgagacgggggtctcactctgtcacccaggttggagtgcaacggcacaatcttggctcactgcaacctctgcctcccaggctcaagccatcctcccacctcagcctcccaagtagctgggaccataaatgctcggctaaatttttgtattgctagagatggggtttcaccatgttgttcaggctggtcttgaattcctgagctcaggcgatccaccagcctcggcctcccaaagtgctgggattgcaggtgtgagctgccatgcctggcctgctttatgtgctttttgcatccttccccacccctcaccactgtctcagtttaatctcactgctggtgtttgttcttgcttcttcctctctgatttttgcttgaactttctagtactccttaagagttattacttatgtgcaatgtggtattttgcaaaacaaacgaaagccaaaatcctatcccctatctccctctttctctccagccaagaaatgcaaagtggttaaatcagagtaaacacagatctcttttcatttgatatattgacatcacctcttagggaactcaagcttgttcataaatcttttgtggtccattgagactcttcaagttcatctagtggaatattccatagcctgaaatgttggacttctgaattcctgtgtgttttgagttttctcagtgggagacaatattgcacacagagcatgtaatgtgcaagaggatccgcttcgcctcagtttgaaactgagccataccactttttagctgtgtgaccttggatgagtttccgaacctctctcagtctcaggtttttcacctgtggaatgggtaataatagtacttaccacttgtggttattgtgaggattaaacagtgcacatagagcactcactatgtacctggtacctagtttgtgctcagtaaaggaagctgctttgcagctttatacatatatttcaggtgtgcatgtagggagctacacggatgtgttcagactagtgcctcagtaaggctgccgtgagagaggaaggaggcacagaggtattcagatggtaaagggttagtgtgcaggaggtctgtgcagagcactgtgatgctaggcagggatgccttttgaggatagatgatcctacacagcacccacaggctccctgacccttctcttggaagagcgttgatggaatccagatgccagttagagacatatctttgtcatgtggggataaatgtcaggaaaaacacttaatgctcattttaggttgtgattttggtttcttttggtgaatcatataacattttactctgtgtgtgtgtgtgtgtgtgtgtatgtgtgtgtgtgtgtttggggaagtgtgaagaaggaaggagagaaggactgagaaatgtacatttttccaagcttagttattgctgttgcatttgaaggggtagactgaatcacacttgaagtcgtttccttccccctttagaatatagggattgttttttggttttgttttttgctgtttaaagtggaaaatgttttatttgaagagttatttttaacaaatggaatttttatgtatttgtattcagagtaattgttattgaaataaatcttctaatgacatacggcaaggaatttaccatgactagattttggagtttttgtggaacattctgagcttacatttcaaatgattttgtttggaaatatcacatgcttgtgccatttaatttataaatccatctgttaatcactagaaatttaatccgtacacttggagagaattcattgcagtgctgtttgaaaagaagttcgtgaacaagctgtgagggttttttatgagcttgttggagccttttgattttaaggaaaggaaggagtttgaacagtgagctgtcttcgttcccagaaagttttagttctgacatttaattcaaagatctaaagagattcaaggaggtcagagatcagaatttattaggactagagtgatggtagtgcatcggaacaaaaacaaaatatctgttttcacagtcaaattattagatatttacaagtttaataacattctgtgcaaatgaggatgtgggaaaacactctgtctaatgaacaataagtataaactctctgaaaagccatttggcaatatctttgaaatgtacatatccttttacccaacagttccattgttagggatttgccctagaactataatagcaaagataatttaaaatacaagtaggagagtattatcacagcattgtttaatcacagcaaatgaaaacagtgtttattagcctcatgttggatactgttcagtcactttaagaagtaaggcagacacgaattggtagcagaagatcttcatgatttttagagttaaatgagagaggcaaggacataagagtcagactagcataatcacatttgtatgcaaaaaggaacaaatgcatatttaggaatatgatgtgttaaaatgttttcaaaaggatgcataaagtcaaatagctaccataggcgggggaagaaggacaatgggttggagatggcagggatgcatcattttatgtcctttggtgtggtttgaaatattttactgtgtgtgtattttagtttaaaacagaaattaggagaaacaaataccttttaccctattgccactcttgacacagcaagagtcaattactgttttaagagtgcaagctttactttcatgctcaacttaatgcctagcattcatgcatgtttttttttttaacccaaaggataaccacgatggatcatccagtgaaggaatctttgtatccaagatagttgacagtgggcctgcagccaaggaaggaggcctgcaaattcatgacaggattattgaggtatgtgaatactggccagtgtctttgaataggctgaatgccatcccatcttcgtctagctcaaagcaagatgtttgactggggagggaggcctaaagtggtagatggttgagcgggagtctcacttttcccattgtgtgggaccagattgagtgttgattgccttggtgttaaatttttgttaaatgtagaaaagccagattatgagtggaatgttcacaatttggcttttttcatgtggacctcaatctgtttcgtatgcatcagttacagtttcgcgcgaaaaccgttgaagagttggatgttagaaccagatgaacgaaccctgttgtacaaattgtgcaccctgttcatattgattaccagggtacaattgtgtcagctttggagtcattctaatgtcctcagagctcacacagcacacacttatttctacaaatgcattgttctctctgttagtttgtcgtctttgcctgttgttagttgtacaacctgattgcccagggatttgcaggcagaggttgatattagggttcacatatcatcacttactccattttcagttcgtcattcatcatttcaaacttttatacagcaggtttgtagactcatgtaggggaagtggatctctcagccccaccagacaacactttgtaacagggttgcagtgttctaggatgctctgagtcactaaaagggagagaatgatttgttgccttctcatatgggctcttgttgcaaagtttgatataaatgagtaattttttactggtgttttgaccattttcatagctctttggatggatacacatatgggctaaattgattggctttcctattaggcaaaaagtaaatttgagaatccacgatgatatgccagaccccacaagaaattcacccatgggccacagccgtaatatagtgcaaatagaagaaaccagaaaaacagcaccgataccagtgggtgtttgttttccacatgcatttttatcatgtctgtatttcctgagtattttcatggcctatttcaaaatttaggactgagtgggagctaggaccacgagctaagccataagtgaagttcacatcactcactggaatgtggccacaggcttctcctggggaaaggagcctcagcaagacagagaacaaagtcttgcatttccagtctcatctggacacattctgcaacgtgcagtatgcttcaggataatttgtaatcctcaggaaaatacacagttaaatctcacagggaaagcaaactgaactagttagggtgtaaggctccctcctcggagggagtgtgatgtgctaacttacatgctaaaatgatacttgattttgttttaaggacattattaatattgttgcatcccctttgaatgtttgaagggttcttaaacttggagctttttttgctgcatggtttagagtcagtctttgtacttcccaggtcaggagactggattttccctaacaggaatttgcttgggcaagagtgctttcttaagagctcaaatgcgttacttactgtcttttttgagagtgaatacattttctgagactattgttcaaaaagataagtacagcttccgttgccaagggtttggtggaacagccagtttctctaagtaatggaatttcattgctcttgtgttttgcaaatgagaaatctacagctgggcaggattttctcttggcaaaggatgatctgtatttgaaatgttgagtacggtttctggtaagtcacattcctattttggacagtatgtaaaatattaatcatgtagtgttgagatggaaagaaggatgaccacaatagagaaacgatatatgtataattgcaattgacaacactgtgccttttgcagtcaaattctaatctcttttgacatgatacagtgattcccatgactgaaaatatgttctctggtttacctcatctgcgtctgagtttattaccaggaggcataaatgtgattattttgagagagagagagagagagagagagagagtgtgtgtgtgtgtgtgtgtgtgtgtgtgtgtgtttcattactaagaagagtcaaagtctctagttttccaccagatgtcttctttttcaggggaatgggcaaaccaccaccagatcttcaccgtaagacccttaattcttgcaaaggggtattattaaatccagagatactaattgagtcttttctttgctgcagagttcctctgctcttaatggtatctgttctctgagaccagagcagcggctcttacccacatcggtgccagcccagctcctccctgtttttttataagaaatattttggaattccaccaatactgtggtgaaatgaaatttacaagtaacatttatatgcatacatacacaaataattgtaaaaatatataggctgttgcataaaagaaaatcaaaggaagataatttataataaaatatatcaatatgccagtgttctggcacagtgacattagataccatggcactgtcagatgctctcacatctgtgtagactcactgggatgcaccttatgtggctgcagatgctgccagatacaagaggcatctgctggtggcccaggcgccatgaatggccttgccgtacaggatgtgaatttccatggtagtgaacaggtcatggttaaattctgacacaggcaactacagtgttgctttgatttatacaagagttgcatttcttgaaatgtccgtgtgtgtatatgtatatatggcaagacatacatgtggcaaaatatacataacagaatttaccattttaaccattttaaatggttatgcagtggcataaactacattgatttatgttgcagaaccagtaccaccatccatctccagaactttttcatcttcctcgactgaaactctacactcactaaatactaactccctccccacctcaactcctagaaaccaccattccactttctgtctctaggaatttgatttataaacggaatcatgtagtatttgccttttgtgactggcttatttcagttagcataatgtcctcaaggttcgtacatgttgtagcatgttataattttcttcctctttaaggctaaataacattctgttgtctgtatttaccacattttgtccattcattcacccagtgatggacacttgggttgctttaaccttttggttgtcttgaataatgctgctgtggatgtgggtgtacaatgtgtgtatgtttaaactgccaaaaactctgttgtgtttatatgtaaaacagagctaggtctatgctcaggtaattataaaaagcttgttattttatcttcatgactgtctggtgggatatgtgatagttgtgctggaggcagaaccattcttcattgcaggagattcttcgtgtcatctctggcacatacccctattgttgtgatggtgaaaaatgcccctgcagattgctgaaactcccactggggagtgacagggacatcagggacaatcactgaggtagaggtttgacttattccaaaaccttgagataggaattgagttgctcagggacagagatgtcaacatccctttcttccagctagactgcctacatgatgtcccctatttgggttccctacatgagtgctcccaaggcctggtaagaaagcctgagctggcctgtcctggggctgtggctgggaatctggggcccccttagatgaagtgcccttccagcccacatggctgcagggcccatgctgtcccctggaatcctgtgtgtccatctgccctgggcttgttgggcagactttggtcatacctattccatctcacatttggtactaggattcagcaagttctgacttactcagtattggcttctgatttttttgtgtcttccctgcactcctcttacctgtgagctgtcctggtcctttttacaacttccgaccccacctttgattgcatatacttattgcagttagaaaactaaatttaatttctccctgatgtctttaatattcattcgaaactgtaaatatctcagtgccttttgtttttctgcctctgaacctactgtctgaactatattttaaagacaatgcaaggttcctatactttaatatcaccagatttcttaaaggaactatgctcatattctttcaaatagtttgagaactttggaaaaattttcccagtgcccaaagtgtgggttatccaactgaggcagatttcctcatccacaaacacaccacctttctctgtggactctggagtctactttaggccaatcttactctactgaaagttatttaggagaaggcaaaaatgtgaaaaatcacataagatcaatattaccctcaaaattctcttagggatgtgacacgtggagaacataccatctcttcgtaagtccagccagctggttttgcacagcattggatcacctcactgtttctcagttgactgtcatatggagtttttggattgttctgtgaatacctcatttgacaaaatgctcacactgagaaaacaccgagaaactgaggcctactaagaaaccagcaaattcactttgaggcatgtgctgttcaatatattatttctctcttcatcttttttttttttttttggtcatggcttgcctataagttaaacactcctctgatgcaactccactgaaattctttctcaaagacttgtagaggccatccacatctatatttcttgccagtcttcaagccatatggcttggagaaccaagctcatttttgtgttacaggaggcttgcctttggtgataaatgagtctgtgtagtgattgcgtgggttaaacgctgttctgctttgagctagcaatcttgattccctggatccaatgaaagtgggagacttaagccctctattcccaataaccattatttcgtacaatcttctgtaaatatgcattcatcttgcaagtgttatgatttgaagacccgaggatatgattacagaagctgtggaacctcaaaggcttttgtgtaaaccggtcattctctttttttgtttatttttggtttagttggactgtcattgctaacaaggtttgttacagggtcagctagaaaggattagcaatgctttccctcccagagccaggctacttggtggaacaaagtgagatttcactgcttgtgattattaggtgagaagatactgttctgagacccactaaagttgcaaaatggaatgtgaattaagctggagtatttatttaaaaataaagtaatagaagactcccctttaaaaaatgtttcatttcgacataatttcagacttgtagacatggatttctgtacaccgttaacccagattccccaaatattaacatctactacatttactttattcttttcttcctctactctttatcactaaattcatcagtgtgaactttttaggaataagacattctcatatgtaacagtatggtaatctaaactaggaaattcatgttggtacaaaactgttatctaatcttcagaatttattctgatcttgctaatggtccctatgatgccctttatagcaaaataaaaccactgtcatgggttgtattccattttcatatttatttagtttcctttactttataacaattgctcagtttttgtcttccataccattgatatttttaaagactccaaaccagatcttttctggactgtcccttaatttctgtttgaagtttcctcatggatggatccaggtcatacgttttgggcaagaataccacagaagtgatagcatgtccttctcagtacataatgacaggtctcacatgaggtgaagttgtccctttatgttaacttgaaccacttggttaaagtcgtatctctctgtctccactataaagttaccattttcttctttataatcaatagttatcctgtaggtagatgctttgaggctatgtaaatgtcttgctactcctcaaactgtcacacactggttttatcatccattgactgtgtttggttgaatctgttattgtgatgattgacaaatggtgatttttctaactccaatccttccacattagttgactttccgctataagaagtagtattcctttttcccctatttaatctgtttatctgtctgtctcttcctctgtcaatatggactcatgagtttttataatttggtggtcacattgtcccaagttttggcccaatggagctctttcaggcttttaacctgtgttattttgacatgttcccatcatgttttgagcactttcctacttcctggcacaagatactccaggttaatcttctgtccttgctccacttctgacatgtgcatttttttcaaggacctctagcttcatttagtggagaatagtgtttagaaaccaaaatatgggtgctagggtgctcattatgattgagatttcattgcttctaggcaccttcagcagatagagctagaaaatgtaaatatgtaatataaacacatgtacacatgtaccacgataataacatatacatctgtctttctgcattcatccatctgtatatcttggaaactatgcctatatcaatacctctaatttcagtccaagtcagtttgtaatccagtttgtaattcctagaggaatcctttttaaaatactgatccacgtgcttttttcctttgaattaaatctgtgatctttgcttagatgttatcagtgaattaaaaaattattggtgaaaattgtttaaagtgttttaatttttggtttggttttggagaaaaaatatgctgtaaaccaaatgattttgtaattatatattttttcattttctttcatttctttaagaaagacttgatatttcttgcttaactatacacaggaaacttattttgctaaacacacacagatatgcataatccatttttggttaatgttagaaataaacacatgaggctatactcctctccttcacagggactgatccccatttaccatattcagcagaggagtatgaaaagtttgatagcagttatccacttaagaagtaaaacctattcatgttatttgaaatctctgttttcttggttacccaaatattctgttttgattaaagaaacttgatataattcaagctgcgttgagaagattctttgttagctgcaaaagtaagcagattttagagatcagttattagtaatggactccaactctccgtttccaaaggtggaagctagagtttcttcttatatatcaatttcagtatacataacgacaatgacatcaccttggattatggtgtcaaaaaattctgaggacattcctggattgagtggagatgagcattgtgatcatttattgatgtttgtcatgggcacataaacaaggagaagggtgactttttgctgtgtatttgctatctctggatagactcacttaaatgatgtttttggaactattgcattgtcatttggtagtaatgactgtcttttcactagcatagctgcactctcaataagtcagtacatctccatctttttagtctccacttgtaaaataaagtgaatatcatattttcccctctcttatttcccgatttagccacttttatcacttttgctttaccttaatagtctttactacagcaacagaagactctaacacaggtaagacttctctgaaatgcagctgatctccttactattagaaggaacatgttgaaatggaaagaaccatttagatttaaatcaggagacccaggtttaagtctccacccaggtattcactctggtgttgggattctaaatgttgagtcttcatctctagaatgggaggagtatttactgcttgtctttcctacctgtcatgctatctgggtggaccaaggaaacaatgtaggtaaaggatttttgcaattaagtacaaaggtggagagttgttatttcaagttaaaatttttgtacaggatacgagaacttaaagccaaatatagaagttaacaaaaacttttctgagatctgttttcttcttgtttatgtatatcagcaagtatgtggagctgctatagaattattgagaaaatcttaacctatttcatggagacatactttccagaattaacaagatgaccaattaaaaacaaatagccctcctttagtccatggttgccttaaacaatatattatgtattaatttctttctaatgactgtgcatagcttattgtgtggtatatgggctttgttatatttattactgtcattattttccttattttcctatcaaaactagcctttcagtgaatatctttctaacatacatcactttatactagtcagataaatataaaactcaggtgaagagtggacagtatggagtgctacaactcttgcagaatttagctagcaggtttttcactttttactagaaaaaccagtagaaacaaaaaaataaaacatggtatgatgcaatttgtttatttttaaggcatttatattagtctttgcaggggaaaaatgctctgagctaatgaacagtttatagttattgtagttattttgtttgatgggattatggggaactttaagtaaagccacatttctgtaatgttggagttctccaaagtgtgtgtgtgtgtgtgtgtgtgtgtgtgtgtgtgtgtgtgtgtatatttatttcggtaaacagtaagaattaaaaacttggtaatttaaaagtgtcttttgattttaaatatcacaaagtggacacctgcttatgtatttccttttaaaagtcacttaacattctcatttctacaagctcatagcatatggcgccaggtatggaaacgcagaggcatctgtctcctgctgaaaccctgcagtcaggatattgggtgcttctctttggcagagtgtctctcccatcctctgtccgtgttagagtttactttgtattgacattatgtacttttttgggagttctgactccacagaagttttaaatctgtccctcaaagtcttcctttcataaaaagatttaattaggtaatccacaaagcattttaaaatgaagaataaattagaagtaaccaatgtccgcattaaattcttgagtgaagattaggtcaaaaaattaaatcttaggtaatttcctgaggaccataaaacaaaacaacaaattcttgacaataatacaggtcaaatatattttatattgtcatctttacatgtgatatctagacacttatctttaaatatgggggttttgagagcagtaaccttatctgttttttttttttaaggaagtttttgtcttttcatctgttgctgtaacacaaaaagagccagatgcatttttattcaatttggaaggtgtgttagggatgggctgacttaaatgctaatctgtgaagtatatgtaacatgagcgagcgctaggggaacgcttcaaagcagtaggcagacatcattgtggagctaaactaagcacagtgcctatagaccagggtgctatgaacaggcggaaagagtgttgacaatcagaaattgtcaatggtaattgcaaataggaagacgcaagggcagaatggcagctgcaagcactgatttgcaattatgccactttcactgggaactctgagtactccagggtgggtagctgctgcagcttgctttcttctaatgaggattaatgattactttgagcctcacggtggagagcagctggtatggaatgagtctgccatgccaagtgccacagtgctcagtggagacctctggctcttaccctgtttaaatctattttgatgaccacgtgaactgcatagaaactgggtctcaccccttttctcctgagagtggcactcccctctgccctttaggctcttctaattctctttatttccttctttcattgcttccttctttcctgctaaccctagtgggtcatttgacagctttcagggatcgggagaactcaaagcctaagagtgtttggtttcctaggcactcccacacccctcaaaaaaagaaaaaatgcaagtcagcattaaaacgaactaaatatgtttattttttatttttcaatatttggagacactctggggtggagcaaaattgacagtctaatttaaaaagacaggttttttttgttcttttcatagaatgattgttgctaggaaatggacatatgtttccagacatattgatttgaggatccgttagccagataaatgcaacgcacatccaaaaactggttagatgttgattttaaacattggataggggatgatttatatagcatgatctgtataattgttgtgacttgttaaaaaatcttcatgttgtgtgagttgttaggataagagaggataacaggggaagagaaaccattagtagacatatgttcacttgttgggtgtgcactgagttctgcctaatatgagataggtcaggatacccagagataaactccctggctctagggagtttacatgtgagacctatgtttataggaaaataacaccaagttaattagaagggcagccagtatatgcagaggttaagagctaaggactctggaatcagatcaacttttgaattctagttctatcatttgcgagcttcatgatcttggggaaacttcttatctctgagcattgctttcttctgtaaaatgtggataaagttgccataataaagaaaatattctttgtgtgtctgaatactgcaattttggccccggaataaatgctcaccaggtggttagctatgctgtgttgtttcctgtgggtctttagaggctgggctggaggaggtttccagcaagccaacactttgatgacggctatatgacacagtttcataaacctgaaattacagttgtgagtagaccattttaatttgttttttatttctttttgatattagtgagcctttgtatctgcattaagagctgccacttcctaaggccatataaatcagaataattgatcaatcaggaataattcttaatttacatcttagtgtgaacaacatggtaattcattgcatatgtgctgacataagtgttccaaaaataaagtcaaacaattgtgtgttcaatatcagctatttttaaagtgccaaaaacattaagatttctgtttttataatgactcatgagtaatattgggattttcttaaaattaggaacagttcatctttctttagcaaaaatgtcccttaaaattgaaatagtttagtttctttttagggtaactttttatgtcttgatatgaatgtaatacaccattgtagaaaaattgaaaaatacaataagacataaagatgaatatagaaacccttactgatactaagtattatcttgacaaaatatcagtttgatcattcaggaatgcatataatggcttctgtgttagaatctgatggggcatgggaattgcataaggatcactaatattttcattacttgttctaaactctagtttaaatgaagagggagaacttcacgtaaaatagaatcgattaagtatgattgtgttgcagcattattattggatttctgatgctttgtgtcattctttgaaatatctgaaaaagtcaatgtgcttgtaagaaacatgagtgagataatattaacatatgagggggacttggaatagaattgctggtgatacaggaatttgtagaagcaagagaatcaagcaagagaaaatatttcatcatttttattgaaagcttgaaactttttaatactctcaacagaacaacatcttaattttacaaggtaaatttgaaaactagaaaaaagaactactttctttttagatgatggtaccaaagttgttgacgtttattatttctccattcaaatgcccaagttagcatcttagtacctagagaactaattccctctggtatgtgaaccagtagagagagacctaaccagaggaagggcactaagtgccaagttagacggaattgttttctcagagaattgttacctaaaccttggtatttgcattttaatgaagttccagaaaacagtttaacttttattagctacagtcttttaatctgcgttttttcttttttcattctctttcttttttttttttttttttgagacagagtcttgctttgtcacccaggctggagtgcagtggtgcgatctcagctcaccataacctctgcttccccggttcaagcgattcttgtgcctcagccccccaagtagctgggattacaggtgcccgtcaccacactcaactaatttttgtatttttggtagagatggggtgtcgccatgttttccaggagggtcttgaacttttgacctcaagtgatccacctgccttggcctcccaaagtgttgggattacatgcgtgagccgctgagcccagctaatctgcgttttgacaaataatatttttcagattgcttagcattaaagagcttgtaaaatatatatgaatatatatgactctatatgaatatatatataaatctgaacatttatgcctgaacacaagcactttgttggcttcacgttagtaactcatgagattttgccttcattttgtgtaagtcacttgaagacccaagacaaattggatgaagttttaagctgttttgtatatagtctgtgtttaataatcttcatttatactttgtaagaaatgaaaggagaatcctttgggcagatggtattatgtaaagtggtgacaaggaaatctttattttgatgcagggacttaattacttgtgaagcctatttataggtaagtttaggttgatttgcttgatagacttagtaaatcttacaagtgaaattcagagattctcatctattaaacttaccagatttaacagaacatacagggagttacactgattcagagggaaaaggacaaggaaggaaattgctatttctatttaaataacatttttcttttctcctttagtttgtttgaaagttaagcccataacaagtgttcgttgctttttgtcatgatcagaatattaaaggattcagtaataagagccatttgtggccttttgtaataatccatcccagttctaggtgatcttttaaaacttaaaatagtagagatagatgagagaaattcaatgttcttcctttcattctgagtcagcttcttccagtcttgattaagcacgttgcttgtgacaaatacaaaccaaaagtgtcccagctacttgggaggctgaggcagaatggcgtgaacccaggaggcggagcttgcagtgagcagaggttgcaccactgcactccagcctgggggacagaacgagactctgtctcaaaaaaaaaaaaaaaatcatatcttctgggaggatggccattaaactgttttatgaatattcaagagaggaagtcagtccttctgatatatcacagggcagtggaaagagtcccccttcatcggagaaaaatcagagtgagggatagtcagtgaagcctgtttagcattttgcatcgatcatcaaacctaaacaagtgtttctcagacttgagtcagtcatacaccacctgctcagtctttgctatatatgtgccacctgttttgctaaatgctcaacattattcttaaagcaacattcttttaactttattttaaaaagaaactgtgtgtcatgactgtaaatggaaagtcattgtcatgtgttgtaaatagaagataagagtaaaaataaacactgaacatgtagaggtagtcaatttaagctagacagctgaaaactctggtctttgagccttgctttctctttgtctaagagcaaaactaattagtgggagtagaagtcaggacagtggtgggaaacaggactgaggagggcttttgagggtgctggtcccattctgctcccgatctgggcagtagttcaggagcatgttcacctgtgtaaatacaccaagatgtacacttaggatgagttcactttctttatgttacatttggataaactttatttttaaaagtggtgttacctgtttacaatagtaaagatgtggaaccaacccaaatgcccatcaacgatagcctggacaaagaaaatgtggtacataaacaccatggaatactatgcagccataaaaaggaatgagatcatgtcctttgcagggacgtggatgaagctggaagccatcatcctcagcaaactaacacaggaacagaaaaccaaatactgcacgttctcactcatgagtaggagttgaatattgagaacacatggacacagagaggaacagcacacaccagggcctgttgaggggtggagggtgaggggagggaacttagaggacaggtcaacaggtgccgcaaaccaccatggcacacatatacctattaaacaacctgcatgttctgcacatgtatccctgtttggtttcgtttttagaagaaataaatttttttaaaaaacaagtagtgttaacaaacatttttgcctcaaattgactctgtgctctagatgtaagcagatgggttagagattgacaatggagtgacttggataacttgggttagagattgacagtggaatgacatcatgtcattcaaggtcgttttaatggcagagcccagggtcacctaaaataaagtgaagtgctccctgacttcagcatgcccagggctgtcgtgtaccagtctgagctaaacttttcatgtgcctgctttggtttggttggttgaggaaagaaagagtccttggagattagaatccactatagagaggaagaattctttcactgctaaaacttcagaggcaggaagataaatattaatgttactgaccagaaattggggaatccctctttgataaacaaacttttgtttgtttttatacaattctgaaaaactatactatctttatacatttgtagctatttactgtatgtacatttgtccgtcgtgcggcctaagcatagatgtaagtatgactcaaacagcaactcattctacactgttctttgaaagagtattctgcaaacttttttggtactgacctacagtaagaaatacattttatatgtgacccagtgcagcactcacaaatgtaagtgagcctgggatgtatgtataaaaatggaaaaaaagtttcatgcgagatatttacccttactgcatacggtgtagtctggtattggtattttactctttttcttctaatgccatttgccactcactacattgatttcatggctcactaaagggcagtggcccacagtttgaaaacattctgctttggaggatagggctgtgccttcgtgttaacagcagatgtctttctgatattgtaccctggggtctgttggatctgctcatggcaaaactaaatcaaacctgttgcaaaaacaatggagtcaaatttgatattagactatatttgtaaaaataatctcctcttcctgtcacctttccacttatgaacttcttatttgaggcaaagttcatgggccctgcactccatcagcagttggatggcattaactggtggtcgtttgcatcatcatagacttaccacaaagggacatagctccagcctttggaggcataactcatttctaagtgtgtagctttggtgtgcagggtaatttcatctccagttgaggagatttgtatcagcttgatgtttgatggggatgctttgtgtggcatgtgtggtgattgcctgcactctggattctggtaggaaggtagtaagttacacctaaataggtctctgaatccagcatctctgagacccccccggtgaagtgtccctgtgaggtttgcagtttgttaggaaaagatcaaggaaggccctgcttgagtgtaagctcttgagagcagggacacattgattgtgctctgcacaccgcatattctcagtactagcaccatgcctggtacagagtattcaatcagtaaatgtgtgttgcctgactccgaaatagatgtacaagtcacacaatcaacttctgagggtaaaactgcaggcagtctaacattagaagtattcagggcaggtgacagtatgtcatgaggccttggggacatttgatacttcgacaacacctcctgcagacaggtggaatctgccagctgtccatacaggaatagcagcgggttaaaatagatatctctcccagtgccaggaggaatttaggagtaaagagttcctttctttagaagcaggggaatgaatggggttgccagagggaaatcgtgaggaatccctgattttgctctttttaaaaaatataaatataagggtatcataagaaaattaggagtttaatttttggtatgccacattgggttttgtaaaatctaaactttaaaaatctgcatttatgaattccagtatttgtatttcaagtaaacctttttcttagtcctgtttaacaataagacttaggaaattgtgttatttctggttaactggttccatgcaagacagtgtaagtttcctttagcagttgtgctttttgcttatgaaggtgccagctttgccaccatttttggaaaatatttaacattggtcacctttgtcctgtcttccttcaatgacttggatcttatctgcctgtcaaaacccgttttggcaacataaaatcagtagcaactaagttctggaagatgcctttgctgacacctattttgagtgtgccatttcttcgatggaagtttagtcactgttgttgtcacagaatttccatccatcttccaggaaataattgctttgccacagctgcttaattaaactgaattctcagtgaagcaataaaacacagtggaactttctgagggtttctgggggtgtgggggtgcggcaaaggggtggatgcaaatgagggcattaagcaaaggccttgagaaaggtcttcatggcttcctaccaccaggccacaaccttgctttgatgaacaagatgatgtttaaagcctattgtagtaaacagatttattttacctttttattgttagctatctgccaaaatgttcatttgtgttctgtgctgaactagtgagaaaatgtgacaagctgaaaatagaggaatattctcatagaatgacagttatgctgaacccaatgtaaatcttaatataaacgaagagaccaaatagaaacttcctaatagacatttctgatctgtttttctaatatcatttgctaagaaactttaaaacttgaattcctaaactttaaaatggtaaaactaagggcagctatcttagtttttgctttaaacactcagccaagaaaggaaactaaaattgtttagagttagtggggcatctgcttatgtgtttatatgccagccaatttaaagctgaaatgttatctcttcaaagtggaggcagcctggactcacattaaaatagtttattttgaaaaaaaatttttttaaagatttctaaaggagtaaaggagaagataaaaccagtgcagtttctttgtccttttggagtgttagatggcagaagtcattcaaatggatgtttttagtgggtgatatcccaattacaaaagttaaaaagatagtgataagctctctgcatacttagctgcttatgtcaaaatatattggtaattttgagtgcatttaatgtagcattttgcttagcttggtattctaacaagaatgaacatattaactatagaatgcaacgtagcttttgtatttagagagactgccatggaatgctgttaaggacataccatagtaatactagaatctaaatcagaacactagaggaatcaaaataactgttacaagtgactttaaaacaaacaaaaaactaggtagttttattaaatttaattaatattttctctgttttctaaatcagcttttattttcttatccacaacgcatatgcatacacacacacacacacacacacacacacacacacacacacacacacaccattaaatgaagcaccacttaacttgtgctggaaatgtagccacttagttggacaaaacttgtttttagcactcaagttcaactccaaagtgaaagggtctgtctgtcattatcctgtttcctggatggaagtggttattcttctctattgatcatttttttcctttccttcctaacttaacccctgtgccacctaaagttcagtagtaatcttgaaagatgctcctgtaacaaggatgccagattctgctcattaagagcattgaagtaaaagtcgcaagttataaatggcctgctttttttttcctcttttttttttttctcccctcatttaccacactagacagagggaatgtcctggccttgtcagagagagaagagaactgccctggcattggaagggaaagcacaaagctaattgttggtggcttcatgttacagaccacctaggagacaaagttagaacttgacatcatttagaccttatttaaggaaactaaaatgccattttcatttaatttagggaatactgaaagtggtggtagacaccttgctgaatgtctctggagattggaaataagccatttttgcttgatgttagggttgcctagtaggtttaataagctggtcatggcattcctgtgagcagagtctaaggtgggatcagtccttccatcatacgtttgtgagctatttgctatcataagttggccactttgagggtggactcctacagtgacagattgtgtgaggtactgtggttttaggtgagtacagaccagaggccatcctgtgctattttacttgcagagttttctcccttcctgttgttaaattttgttttgggtcctgaaggtgcttatggctgccatgtttccttggcagagtgtgaccagatggacacatagggagaatgggaggagggtgcagaatatcacagtgggctagtgttgggtatctagtggagttcatgcatatgttcccaggtgaaaaggtctggaaaccagtgctgagaatatcaactgctagcctgaggctattttcgccatatagttaatctgttactacatgatccacagaagtgcttatgtaggaagaatttacttccataaaattctacctcagtcgtagcattgagcagcagtatgtatagtggataagggtaagctagctgtgtgggtttgaatcccagctctgatatttttgctacgtagccttgggctagttccttaaattttctggaccttcatgttcttgcctgaaaaatgagcacgacagtttctatctcataaggtaggtgtgctgatttaaatgaattaataaatcttaagatgttaggggctgttagaagagttcttagtacgtagcaagtcctcagtgacattatcacattatgattattgatagtttccattgttgagtggctcctgtatgcagttgagtacatacacaatgagctcaggcagtgagttggtccaaaaaatgcaaaaaatgtaaggctatatcaatagaagtatcactgaataagctggggtcacatccatgtgatgaaatagtatgcatttattaaaacccgtgagttatatctgtgtctattggaggaatgggctgtttcctaatgtgctatttcatttcattgtccccacaacactgcaataatacatagtatcattctcattttacaagtgacaccactgagacgcggggtaagtgccttctcagaggtcacacagctgaccattgtggatgacaggatccaaatccatatctggctctgtgtgctttcctttatgccacatttctgtccagccagatcccatgccagtggatagttggagcctcattaagttgttggagcctcttcgagtgaacaagtatatacaaaactgtgtgtgtgtataaacaataatcatcataaaaacatttagccaactgtatatatatatataaaatatacattttgttttaaaatttatttttgttagtataggtataggaagtattgagaatttgtacacagcaagttgccagcagtggcctatcttggtgagtggagtggtttctgagatttttgtactataatgtatagttcattttctttaaaagaaatattttattcaatgcaccatcccccagattaaaatgttttgtggagttgccacaatcattgaaacaagacattttaaaataaaaaaagacaaatctacatgtgccttcctctccttttcttcttcccataccctgaggtaagcagtttgcagcccagcacaaagccttccgtagccttcttcatgattatacaaaatagaaacacatgtacacatatgagatgtcggtttttcttttcttttttgagacagggtctcattctgtcacccaggctggagtgcagtggtgtgatctcggttcagtgcagcctcaacctcctgggctcaagtgatcctctcacatcagcctcctgggtagctggtaccacaggcacgtgccaccacacacagctaatttcttgtatgttttgtagagatggggtttcaccatgttacccaggctgttcttgaactcctgagctcaagctatcttcttgccctggactcccaaagtgctgggattacagatgtgagccaccatgttcagctttttttttttttaatcattgtctttacacagaagcaaccctcctgtgctcattttccaacatgttttctgtaatagcatattgtgcccattccatcaatagatacaaatataacttactggttttaataaatgcatgatgttgcatcatatgagtgtgagtccactttattcagtgacagttccattgacagagccataaatagttctgcatttttttggacctacaagcagtactgtaataatgtccctctacccatttcctatagtcctgggactcggactccaagaagttgaatgtataacatacactcatacagtttttaaaattgtattttccacaataagcagatatttctttataatcagaaatcttaaataaaatagaaatgaaatcttaaaatataaataactaaatcatgcgttcacacccacacacagacatacccacacaaattccaaggctggttattgaaagatgtgtcttccaaaagtagagtcatgtttattcaaagacaaacataacatagttgagtgtgtatgttcacagcatggggagtgtttagtgtgttttaaaatatgaggaaaaataaaaaacatcataagcaaaccatcagttctctttgagagaaagctgctctcacacacaggtgattctttccatgaaaactccaaaaggaatgttgcttatgcttttgcataggtctgttcttcttatgtaggagtacatctgaactttagaaatttacatttgagtaaacctcaaactccaaaatgtatccctcctccccaaaaagggacattttactgaaataaaatctgttgctggttgcttctggtatgttatgtcaaagttgttaaccggatacagcaaaggcagctgcattgtatttcagaattagtttgaggtagattttattgttataaagcaagacgcaattgaagccacactctgggaaaatagcagtaacacaaaacatagtaatttaggcagaattactcagccacagatgtccagagaggtataggaaaaggtccatatgcactttttgtaggcaaacaagtcaaggttaaataaaagccctattttgagtcttaggctggatgtcaagaaattgcctcacaggtgaaacaggtccagccacagaagaggctctgttgttacttgagtcactaaaccatttggatggaggccagtgcagccttctcctctttatgtcaagttcccatctgtaggaaatagtgcctatagtgcctggtgacatcacaggatcactttgagtcagtggtgagtaaggcataatgcaaagagtaatgggaaacactctacacttgagagaattcagaagagcagggaagatgctggcgtgtttgcctctctggctaagccagcatggctgtgagagctggctgcacaacagacaagaggcctgcgttatctctcagctcagattctttgtggtttgggaaagacagaaccccataaggatctgaggaaagttatggatcttcatgccaaaaaatttacattctcagaggctctcatcctctctccctctcacttgtatacatacaatttcatgggacttgtggactccttgggaccattcgtgaacctctgttaagaattcttaagttctttgcagggtcctagacaaagctctgaaaattgatatttttcctcagtgaagatcaactcaatcctaaaatggattttcagtttttcagctgaataaatcaacacccataggagcactttacagaatatggagacttgggagtctgaggtaccaaataacatggaaatgataggtggagacttcttggggatgtgaaaggccttcctttcatgggttaagttcatcgggaatcattgctgcttcggtgagatttgaacttacacatttttctgtataggtctgaaggagcttagtctaaatattatgtaaatatgaccccatataaatatatatacacacacacacacacagagacactccatacataatgggatagatcccatggagcaaacctcaacagtggtgccgtgatttacaaaataacctctcagttgcacccttattacagtcagatcctcagtggcgggcttcttacttctctcagagtgaaattcactcttacacaggggcaacttgcagtgtgccacattcagaaaagctctttaaagtgtagtccctgtcatttacaaatgtgggctaattctcaatacctgtcgacctctatgttctcatccaaaatatggaaatcatagtagtacttttaaaataagtttgttggaatctgtaaataataaaacagtgtaaagtatttgtaagggccttggcatatctaacacgctaaataactggtaactcaaattgattactctttatgattatctagcagtagctgtttattggctttagaccccacagagtaggactaccttttatctatgtaggttgttataataaaatgccttaaactgggtaatttatacacaacagaaattcactgttcatagttctggaggctgggaagttcaaggtcaaggtgctgacatattcattgtttagtaaaggctgtctgcatcaaagatggtaccttcttgctttctcctcacatggtgaaaggggcaagggagctcccttgagcctcttttgaaagggcgctaatcctagtcccaagggtagaaccctcaagacttaaccacctccccaagaccccacctcttagtactatcacgttgggtattagagtccaacatatgaatttgatggggacaccaacattcagaccaaagcaaggaccttccaaaatcagtgcaccttggaaaatttttgtcttcagatattactgaggtaattttaaaagtctagggagtagggaccggctaagaggaactgtgtttaaccatgtaatactcttttagcaaaccaagtgcctgcgtaatttttcacacagttcaagaatggagaaataattctgtcctaaactctttccacttcattagctgaaatgttcacatttctcatatccaagcagaaaggggggcaggttcctcattggtccctaaagcaaacttggattaatggctcctattaatttatctttgaaataagaaagaaatcctgtggatccccagtgtattgacagatttttaacactttacccataaaatcaatcaatctctctctttctaccccttcttgccaggcttttactttttgtcactcattctccctttccttttcatcaaaacattttgtcctaaaggaatctttaatttccttttcccctatgtaacgggaacagttacagtaactaaaggtaccttgaaagaatggtcggctgggcgcggtggctcacacctgtaatcccagcactttgggaggccaaggctggcggatcacgaggtcaggagatcgagaccatcctggctaacacagtgaaaccccgtctctaataaaaaaatacaaaaaattagccaggcatggtggcaggcgcctgtagtcccagctactcggaggctgaggcaggagaatcgcgtggacctgggaggtggagcttgtagtgagctgagatcgtgccactgcactcgcactccagcctgggcaacagagcgagactccgtctcaaaaaaaaaaaaaaaaaaagaatggtcaaagaccatatcataaaggatcccagtagtaaacaaatggcacacttaagataggatccatcagagagtttagtaaaaggacgattttcaaggatatgagaagagtgtaggacagagatcggcaaacttctgtaaagggccggatggtaaatattttcagccttgcaggccatgtggcgtttgcttcaaccattcaactctgttgctctagagggaaagcaaccatggacagtacctaaacaaacaggtgtgtcttccagtaatatgattcacaaaaagaggctttgggctagatctggctccagggccatagtccattaaactctggggtacaggaagaagagcatagggcagtaactgggctagtagcaatgctgtgaccggcctttggcttgaagggcaggagtggaaggaggtaccagaacctagaagaaaggcagtctgtgaagagggctgtcaagacaggagctgtgcactctggagagagtgctatcaagagacatcccacaggaaggaactttggggcggggcacaaatctagggcgcatttctcctctctcccttggttttcctctgctgtgccccattgactggtcccagctagaagccagggagcgagggagaccagagaaccattctatacaaggtatcctccctggggacagagagcagggtggaaaaagggaagctctctggcaggaggaggaaatgagatatggcacacaatgcacttagcatggattccccaggtaccaaggactcttgttatttattaatccttgtcatcacaaacatctgcgtctctgattacgtgtggggttgcaatgtaaaacataagtgagtaaagggagcatgagtagaactttccacagagatccagtcacagcagaagctagtcatgtaagggtttctcatcccttgggtttatcaagctttcctttagattcatcgttctgaaaagttgcttttggaaagacattacaccaagctctcaatttgggtttgaaagctgggaaaaaccctctttgctagaatgaatgaatgaaaattgacctcttatagaatgattcatcaaccatgcatgagtgagcgactccatttagaaaagtattaatttagtcatgtcccaaaacatcacatcacattgcagattaaggtcagcaaaaatgaatgttttgacaaccctgtaatcagtgctaatagaagcattgaaaataagtgtcttgagaatgtgggttgtgcttgatttaatgtgttattttttttttacttattctaatttagtctcattgtttctccagaaatttcacttatctctaagactttgacttctttgtctataactctaaatgtatagtaacacacaccaacaagatgacagttctgtaaagtcccacttttttagcacacagggtagatattcatgtctatcaacaagtgtatttaggcagtgaattcaatcatgcaaaattgaaaaaggcaaaagttggatgatttcaccaggctctttaagaaacttgtgtttggtggtgatgcttgtcttgaaaagataaatttcctagtacttagggggacttagaattctacttgcatcaccctgaaaacttgtttctctaccttttatatagctgggatcactgattttttttatacagaaagaaaaagtacatgtaaagtccctgctaaagtcaggctatggcattcttctttggcacactggaacctagaaacactagcagttgtcttgactcgtagattgattatgggacacataggtcttgaggatgcagtttcactcggcctatatcacgtatatagatatcagctttatatcagctttagttttgaatggctttgggtaacacctctaatcatatatctaaactgtgttattttaatccatctcaatttagaccttattctcccatccttaacactggatagagctcatttcctcagtttggggtagtggagggtaaaggaaagaagttggcagaaaataggcagctccgtatgccactgtgcatatgtgtgtgtgtgagagagagtatgcatgcatgtgtgtaatttcttccaaaggacatataatgactccctgcagaatgatagcaatataacagaagatgacttcgcttgatttttctctctttttctcctgtcctcctttcctcatccccctgcccctctctgtctctctttctatgatatttctcctgaacttccaaattgtgtgactctaagttttggcagtcaaatatacatttgttaagaggcttactgcttaggtaatatgcaaaaattggttagatcaccataaagaatcataggaaaaatttaaaaactcagggatcagttaatttggtctcctgtttgtctaatgagaaaacagaggcatacagagctgaagaacctgttcccattccgtcatctgatggctgcagagttgggactagagccagtcttcatttgtcgtctctacaacacaatgcaggttctttctataatgcccttctctttcttcttctgaactttcttggataaagttcacatttgtctataagcattttttaagcacacctcacatttttgtcccaactgtaaagtaaacattatgaaatttggtagttaactttctattcaatttgactgctgtttctcgcgtttctacttgagaaggtcactgtgtttgatcaaattctgggagaaaaagatgagatgaggcttcttggagcaacttcttcttgtgtggtgcttcactgagcttgtggcacatgttagtttggaaaggagatttgccttgaaaatggggtctctgaaccttctgggagggataaggtagtacagtggagttggtcatgcaaggatggctcttccaggttccaggcaccgacgtgaactgcaaaaaacacacatactgtatttgctctatagttatttgtgaacttctcaagaagtacctgtgtaattataaacccctgttcttccttgtcagtacagtataatgctgcttacgttcattacttctttaggcgatcatgttgaattacagaaatactaatttttgtgataaacatgaagtcctttagagcttggggattttctgctgtattaacttactaacttttttatttttaaaaaacaaaacatcactttgctctcttgtacaacacttcaaaggaatgacaccttatcaagccctttggtgagctgagagatataaaactcggttatatttgacagcatgctccaataggactgtgctgtaaatgaagggattgtttagcacagggctgaactgccagagacggaaaggggctagatgaggggggaagttgaatttgttgtaaaaagcaccttcttatcttttagatttagtcgatactggtttctgccctttggctaagtttgctgtattaaaagtgcttgttccccctttgggaggccaaggcgggtgaatcacttgaagtcaggagtttgagaccggcctgaccaatatggagaaaccccatctctactaaaagtacaaaaattagccgggcgtggtggtaggctcctgtaatcccagctacttgggaggctgaggcaagagaattgcttgaacacgggaggtggaggttgcagtgagctgaggttgcaccagtgccctccaacctggacaacagagtgagactccatttccgccctccccaccccccccaccccagccaaaaaaaagtgcttcttcctgtgaactcattgactttatttctgtttttaaagaagtgttgtgaggggagtggctaagaaggatttctcagctataccagctcactctgcctaattaccatggtcaagtactcagtttggttttatcctagggcaagttctcttgatggtgagaagattagcagtcaagaggctccaagagaggggttagagtgtacttagaggacagcctttggctttagaagataattgatgtttgacattttttccctttgtaggctgagtgtcaaatatcggacagggcgagagccccctcattaatcctgacaactgttacttctctgtgatgttagaataaagggtatttgcccttttaatgtcaggccttcttgcctcctgcaaaccactcatgtccagaggatgtactaagaagctagctgcatgcttttccaggcagctagaagtttgcatatatggcaaggcaaacttggccagcttatcttgaatgggatagaaacacccttctatatttgctgtgaattttttttaaagtggtacaatatgggttaatgtttagagctgactatggtaaggaccgtatatgtatatgtatatgtatatgtatatgtatatgtataggtgtatgtgtatgtatatgtatatgtatatgtatatgtgtgtatgtatttgtgtgtgtggctatttttaaagcctgctaaagtatttttggtggacttgcatagattgggaaaaatgaaaaccatctctgacgctcaccttttacaactgaggtattaccatagaacgggcgttggcaaacttttcctgtaaagagccagatggtaaatgttttcagctttgggggtcatgcagtctttgttgcagctactcaactctgccattgtagtgtgaaagcagttacaggcaatatgtgactggatgagcatggctttgttccaataaaactttatttaataaaacaggtggtgggacaaatatgacctggtgagtgacgtgtgttaacctctgctagaaagttctactgcttaaatatagctctggctttgtggctagatttcatcttagaggacactttgcccctcactttgcctcctcgtcttcccagatgccacattgcagattgtcacttgctacagtctgtaacaagaacatatgattctgggtgctttatatatactctgtctttccctggcaactgaaggccctggagatcttgcctagctgttgatctgctctggggtcctaccttaatatgttctggggtcttgtcttgccagagagggtcactgtaggacctcagagaggcccttgggacaggtaagacagatcagcatttcaacagatgacccctggtttccagtcaactatcaacaaccaacctctgtatcttattagaggctctgagataagccttaattccggcacactgtgggacacaaaagagcctaaaacctcccttttgctaatgagttgtgtgttattttctcactttatctcagttctccagcctaactgctcccggagccatcttttcaaaattccaacaattttttccaagtttcccattaaatcattgaaatccaaatgatacatatgcatagttttcccaaatgcaggagggaatctgcatttttttattgaaaaagggagggggcactcttgcaaaataaagctactccctctgcctcatccctcttggcttgatgtaattatttctctgagtatctgatttgttgctgtctctggacagtgctgctccttttttgtactgctgtcccactgcttgcagtgactcaggtgtgcttggaacaaggacgcaaccaactgtggttgaattatatgcaccctgacagccggaatgtacagtgtgatttatgggagttgttcacacagagatccccagatagcctggttttctgacatacatgtgaagttttaaggcccagggtagaggaatacactccaaggaaccaatggatgctaatgacatttctaagcactgtgatgaatcgatccaggacttttttatgtcaacttagagtatactggaatagaacacagcattggatttccataaaactgagctagcagctagaagtttaaccacatgaactttgttactttggaagagcttattaaaatctctgaaagagggagaagagataaaggaagaaaaccaatccttgtgaccacacattaaatgggtcaaaacttagcaaattcacagcccgggcaaatggatttaatggtttatttttatcaatattttacaatagaatttgaaacaagaatgactttggacacctgaattccacctattcactccagcttgcttttctttaaaagaaaggtaccaaatgaaatgatttttaagacctttttttgcactgaatcaacattttgttgtcacaaacctgattagatttctaaaaagtatcatactgtcccttgctcaagttaagtacaaaattgcctaggaaattttttctaaacccaatgccatgttccattctttaccctgccgtttcccagcccgaggattggagtgagtggaaagtatgttcctgttttttcaaaacggtgctcgggacacatttgtgaccacaccagcttccatctcactgccacttctgctcttccggttctgagcagccgtcttagaggtcaactcttggagcagtctgttgatgaggtgagagccgcctgctcaggggagataaaggtagaggtctccaggctcttctctgggggcaggactctcaccccggcagctgcggctttgattgaaaaggtatgtggccctctggagctgacttcaaccaaatggcattggtctttgaaaaatgtactttagcacagcccctgtggaacgtgtttacttaaggattttacccttgctttagaagtgagaatgtgactacagctggactgcccctcactgaaggcatttgctgcgaatgtgtcttctgctaatatgtttaaggatctataatgaaaacagagtcattctgaaataaaaggacattgacataaaaagcagtaatggttgacgctatctgtttttgaagataagggttttgtcacaaaggcacgatttatggtgggaatactgaatagcgggagtgtggcaggtgataaatcactgttctcaccactggatatggagaaaaaagggatacaaagaccttttaaaaataggaaaaataaaagcactccagggcatgtaattttatggaaaacatggtagagaaagtacaataggactgagattgtatgttgttgactgaaatgttttaatctcatttggaggaaaaccatagttaaggtagatttttgtaaaactgaatcgtcaaaaacttagtccatacactgagcagcatataatcatgctttttaatgtagggcttccatggtagctatgatggtgataaaaatcacaatctttctcttctctttatcttgtgcacaagttttcttctgcccacagccaggtagatgagagcaagcaaaagcagatgtatttataggatgttaagggcaagaataaaactaataccttaagagactttttaggaacctcttggaaggcatgagtccagggaggggttacagagtctggggacctcctgggcaccttcatcctccttctcctcctcctcttttctctgtgctgctggaaacctgatacattgccacatggatgggggctcatacgggccaccattgatgcttccttgtagatgggaaggctctgctcccggatcagtcaaaatcaagggctagcttttgaggaaacctgaatctaggcagccggtcatttggagcaatagattatcttagagaggattccttctcttttagaggactctatgaatgcataatcccatcagtaagtgagcatgtgggttaatgccgcatttattacatatctggggatatgtcaggtgcaggtgtgaggattcctgtgccacatagcagaacaccaaaaatcaattcaagaagtgtattcatacgcagcctttactttttggccagtacaaaagcaagtgaaatatgccggtaattgttgccataaaatagcagttcatagtctcacattttgttaacattcgttgtctcttctagatgtatgcctcataagttagtcagtattcgtttgttttgtcattcatttatttgttttttcattcattcattcattcatttgagaaatatttgagaccttctacatgcccattgttgtccttggtgccaatacacagcagagaagaatacaagagtcctgccttcatgctgcttaatcctagtaggacagagccaggcagtaagcgagaccaaatatataatgtgtcagcggggtagtataagggcttggaagaaaaatgaagcagggtaagagaacagaaagtaatagaaggctaaaggctgaaatggcatcattttctcaccccctctcaggagtcagtgtcacccaactcctgtctgcctcctgccttttatcctaaaaacagccctgtgagggggcaagcaggactgtcatttccatttacagatgatgaaaccaaggcacagtgtttaagagatggccaagatggcacagcaggtagatatcaggtcactcagagcccctgttctcaacccctcgagagttccttctcttcaccactgccagccctagtccagcccagcgcctggacctttggccaggggtaggctcagtgagtgcatgtttgaaccaaggcactgtgctaagcactagggaggaagagaaaggtaacctcaggtcctgcctggagaagaccccagacacagggctgaggtttggcacagggctgtctgtcctctgtgtctgtcaatgtgtgtgcgggtgtgggggtgggaggcttctgagaaagcttcactgaggagcagctgatctcattgcagagaagaggagaaaggcattctgtgcagtggaaattgtcagtgtagacgcctcggggcttaagagaacgtgacatggaagagacaggaaatatgtactcttgtacaggtatgcggcacacatgtggccccctccctcccagcctcctcactaaagattattaacctgcttattctcctggttcacctgaggctgttttgagagaatctcagtatctcagtcttcatttcatacgacattcttcgggctcctcttgttcatctttgcagactgaagtatttatgaaggaccttcagaaatctgattcctcctgatgaatcaaagagtaaagaagaatcaaacatgattaaccaggtgaggcaatgtgatgaaaaggggtgtgtgatttagaataggtgagctgggttcaaagttcagctgcagcacatactttgggccagttattttacttcataggacctcagttttttcatctagaaatgggaataatgatacctacctcctgagagataaagggcagaacaacaatttcagcaaggctctatcatttcagttatccttccctgctacagtgcaaatctctcttaaagactgtaggtctggcttccgtgaatcaaatagaaacagttacagcataagcctgggccactgtgttgccttgggatatgcatatcacctgttttaatcccaggatttgactttcctcctagtgctgtggctgattatttaatttttagataatcatgtagcaaatatcatgtattagaaggtagggctataaaaagagtatgccacaaacagagtttggttgttggccagcaagtcccaagctgcctctgctgccatgtgctaccatatcaagcgagttgcccgggaatcccctgctgacatcggtctgtctcacatgcgtgatatttggaaggtagttttggtgtgtatttgtgttgatcattatagtaatgacatgcatttaccacagttttgtaggagagcgactctcagctgtggtttagagacatagccctttggatctccaggtatctcaaaggctgtaaaacttctcaagtcaaaactagttttaattttactgcttgagagatgcagtatgaaacatatgacagcaatgagtgtctatttctgtagcaactcaagccacctgcttttttaggggaagatttataataaaggcacataactatagggcttttaaccttgatttaaaaagaaaaaaaaagactttcctgttcattatcatatctagctctggggagatagacaggttagtgatgatctgcaccattttacagatgagatccctgaggtggcttgtggctttggtccaagaagccatttatttttgattgctggcttcacatggctcctcccttggctggctccttcttatccctaatcccctatctttgttgcttgtctgttacctatcaaaagaagccatgcctgatttctctattggaggttaaactgcttttcccacctctggtttcccttcaactccttatttatttcattatcgcattagccactagttttatttcttgggttttcaaatggtaattattatttaattttattgattagtctgtctccagcattagaacaaaaacacataaactccatgaaggcaaggaccctatcgttgtatttctgttgccctagggaggtgcctgacataccagacaccctttgttaacatgtttggaagggagatagaggctaagttttaaagactaagctgatcattgagttcctatgttccaacagtaggaaacggactggaggaaggctgtttgaggtatgaggattattataaaaggacatttttacaaatgaaccaggtttagacttcaatatgtgtagagttctctgaatcatgtctggcagataaataagacttgcttttgggggagttttttctaattcagtgggctttgaattagaaggaattccaatgcttgttcttgttctgcttgagtagaattgataaaatctgttaatcatcagttttgctttaaacccttgaggaatttttaaactttggaaactcaggtcatgattttgaacttttatttctaataatgtacctggcatttttttaaaaacagattttgttactatttttttagatcattctcatattcacatatagtttgaaagtcttgttcctaaatctccatttgacagattgtagagtccaacatatgcaaataattaaggcattgtctgctcgatgtggaagtatccaggaaagttatgaaaagccccaggaaggatagatgtccatgttgatcaaactaccagattcttataacatgttgcttttacattgtgtcatatggctgaaccagaacaattctgttctggatgactttttgagggcatgtctaataacaactaggtttttctcttatatttttccactgggtcaactctattactttagatatttggggctacaagtaatagagatttcaaatccaaatagcttacacatattattttaggtacaaggacaggtgattcccaggttagtgagtagaggagctgagtggccttgtcaaggatccaagttgtttgtggtcatccttagcatgttggagtagtctcctcatggtcaaaatatggctgccacagattcaggcattgcatctcggcatgacagtctccagagacaccagcaagacaccgttttcttgtctttataggtgtgaagagagctttccaagaagctctagaacaggctgccccttgttagtggtttgttggacagaatgaaacaaaccactaatcctattatgggccataaattaccatgaatggcttggaccaattgggatttatgcactttctctgagggcaaataaaatatgggtcacaccatcaaaggaaaggcagcaaagagatgagtaggcaataagtagtcattgccataccagattcatcctactggaacccccctttatggatacattttcttactctcaaataatgagcattttcaaaatcaggacaaaggagtggttcttttgttgcagagttccttacataaattcatattttccttctaaattttctaagagaattttatggataaagactttccttcagtattttctcttatgagttgaatgttgtgctcacagttcatgtaaatattttgagaaaatgttataattccattttaatctaaagacttgtgagcctgcctgtttatcgctgaggttttctgcaatcctcgtactagaggaagtgtcattttgtgtaaaccaggaaaagaaattggttcaagtaagtctaattgcaaagttgctgaatgaagatatccctttctctctcttacaacaaaaatttaaaatataatttaaaattgtcaaacaatgatcatgtcacatctggaaatttcaggtttttactcccttgccttttttcctaattacctgaatgctctggatattcaggctttcagctgtttgacttttctggaggtaagaaaaggtatccagtttatttcacttttctcagatgtgactcatgtctttgacataaaaatccttatcgcacaggataagcctcaggaattggtttgaagaatgaagacaaacctggtttttatgagaatagggaattttttttttattggaagcatagttttctgtgtgtgtgtgtgtgtgtgtgtgtgtgtgtgtgtgtgtgtgtgtgttttgtatttttagtagagacagggtttcactatgttggccaggccggtctcgaactcctgacctcaggtgatccacccgcttcagtctcccaaagtgctgggattacaggcgtgagtcaccgcgcccggcccctgaagcatagttttcaatgaagagtcggcttggaaagcggtaggatttgtcccaacttcccagggcgtagtggaaggtgaaataagaccacagatttatcaacctaatccttagagacaacattcataaacatgaactgtcagttcatccaaccttctctccttttcagatgaggcctaaagagattaagtgacttgttcacttccattaatttttggtggatataggccgggtatggtggtgcacacctgtaatcccagcattttgggaggccaaggcgggcggatcacaaggtcaggagttcagtaccagcctggccaaaatagtgaaaccccgtctctaccaaaaatacaaaaaattagcaggacatagtagcaggcacctgtaatcccagctacttgggaggctgaggcaggagagttgcttgaacctaggaggcagaggttgcagtgagccgagattacaccactgcgctccagcctgggcaacagagtaagaatccatctcaaaaaaaaaaaaaaaaaaaaaaaaaaaaattggtggatatagtatttccctaaagccctggagaacgggtggtatatacagtattacatagtgctatgctgtctgatattgtgtgtacagttaccttaacactctgtacttgggtaactttgataatgcagatgtagaaattggcagtggtggtaatgatgatgagaatgatcatgaaaatcataagagagcagctacctgacatttattgagcacttactgtatgctgggcaacatgcttacacctattagctgtaacacaataattatattattgccccatttgacagatgaagaaagtgaatttagaggttaggcttgcccagtgtcacacagctggaagtggcagagttagcattctagctcacatttgcctaatttcagagcctgagttctaaattatgaggcttaccactaattattggggagggaaaggatagtatttatgatgctgagaaggaaagttcctgagtggtaccaggaatgacctggaagagtgaaaagccctaagagggattggaccatccagtgagcataggggattgtgtagatcaggtgaaaattggacctgcctcttcaacccacaagagaaagtgcagggcggagaagaaacctcaaggaacggagttgagctttgaaaggagaagttggctacaggtgctggagagggctgatggaatgtatttggggcagaggttgagatcctggccctcccatgtcacacaccctaaattgaggccacatggctgtcagtgaaaacaaacccaggtgctggtttcaataaaaggtgagactaggacacaaagaagggtagggagggcagagaacagctaaggtctgaacagctctgcaaagtaggtacatggctcccaggattatcagacacatttttcacatgggaagacagaattttcaagatgttaagtgactgttctaaatcattcagctgagactttcagtccccatatttgggatatttgatgtagagttatacaggtttggctacagaaggcatgactcaggcagagagaattagaggagccaggaagagggcagaataggcacagcctctaaaccagcaaccgtgctcacagcagcccagaagcccagggggagaacatgtgtgttcaaggtggttgcatgttcatggtaataattacactaatacccaataacagagaggttaccttgtggttatgagcctgggctctggagccagcctgcctcaagtcctacctctgcatcttctcgctatttatgttctgtcagattgttttccccctctgggccccagttgcctcttttgcaaaattagaatgataattatacctcataggatgttgtaagagtttattaagcatgtagagcaggagtcagaaaccttttctattaaggactcaatagtaaatgtttttggcatttatggccatatagcgtcagtcatgactacttaactctgccataagttggtagaaaattcaggcatttaaaaaatctgtttgccataggaaatttgcagaagcccacagcaggcaaatgtctcttgatttataaatgaaattgtataaaatagtagccatagaaagtagacttctgattccaaattatcagcaaagtcatgcagaaaacaggcaactttttaaaaaatataaggttttagtctgtgtaaaggtgattataagaggaatattccttctacgggtctgcttagctttctcctaaccactgcttttgatttatccagttcatcatcttttttttaaatagaaaatataatttggcggctgggcacagtggctcacacctgtagtcccagcactttggggggccgaggcgggcggatcacgaggtcaggagatcgagaccatcctggctaacacggtgaaaccccatctctactaaaaacacaaaacaacaacaacaaaaaaaaaatagccgggcgtggtggcgggcacctgtattcccagctactcgggaggctgaggcaggagaatggcgtgaacctgggaggcggagcttgcagtgagcagagatcgtgccacagcactccagcctgagcaactgaactagactctgtctcaaaaaaaaaaaaaaaaaaaaaaatatatatatatatatatatatatatatataatttgccaacttgcagcccatggttaaataagtaccaccagaaagtctgaaaatgtattttccattcatagaaaaaaggattaagctgacttagaaatgttttatgttgacagtatcacttaaaggagatatacttcattcttaatgtgagaagtgcatcttggaatcatttctggtaaagaattctcttgccctttccccaaattaaaaagaggaagaaaagcaaatgaagtacaaaagccttaaatttcagtgaatagacagctgtgctctctattcgggctttgatggtgggatgggggtgaatccattgtaccccaaattatgtaagcttcagaagcatttgcactacctgaagtcccggaaatgtagatggcatgcatttaacggggctgaccttggtaaatataggtttgtgattgggaggatggttttgtgacacaacttctccaaaagcaaagtgacgtcttagtaatgatatactttgtgtgtagtttacagggaatggagacttttttgttttattcttttaaagggaatctggaaaccacgtctaatttcaatctaatgaaacacctcctaatgccaggggtttctcaggtcagtttcctaagagaggcatatcatgcccatcttatactggatgtcctatgtacaaaacactatctatattacacttacctactagatttcttttattagcttttaccctggtgatgttaatggtattctcatgactctttttttatctgtgggacattaatgtgttaagggttatttagctcccactgtgtgcaatagagagaggtagggagagaatactgagatatcagttcatacatctctgtacatgtgagtgtaatggggatttaggcttttctattctgttttagaaactgtaaatcaaaccagatcaaaagatggtttttgaccagaatttatgaatttcctagtaagtgttgacacagcactgaaatttaaggagcagatgtatcttcttgaaattcaggaagctcacatgaattcctaatgaaaaacaaacagcttttccagcaaaaaaaaaaaaaaaatgacttgggtttctctgtgatgttaattgtaccaagttctgattatgtgtttcaaatcacagtaaaaatcgaggaaagaggattttttttttaagtttgcttgtccaggaattgagacgtgggatttcaggagttctggcccaaacacgtgcctcagaaaatggggtagacaagtgcacaagcatccgcatgtgaggatccgcatgcgaagatgcacgtgaagaccacagcttcctttctggtgctcaccatgtgagtgcatcatttttcaacagtagttcagttcagcctttcttatataatagccttgcaagtgaacggataagcaaagtcagttgctgagaaataacacttccgagctgacgcatccaaatgtttaggatacacctgagatgtctctcttactgaatagaaacaacatccctggaagctctagacttctgaggcaccccagctttccctggtgagtatattaaccttttcccttcttgacatgctgtggaatcagctggaatgctcatttcattgtagccactggacaaaaatgcagcttgccctggtcacagcagtaatgacagataaagtatgggagtttgtctaagagggggtgagccctaatggttgaaaggttgacagctttcagaatgtttgccacctctctttaaagcagctccaccagggcagtttggcaaatgtaaaaacaaaacagttatactgcttgcagctctaggattttaaatcacaaacaaattctatattttattcagccatccagtagatcaatgagaagtaaagcatcctaactgaaggtgagaaagtcatgtgtgtaaagtttattgtcgggatctctttatgtggttatgttctgctaataggcaaattcatttaatttttacatggtttccccagaagagctgtttacatagttgcttgttcttctcttcccttcccttgtcttccctgcttctctgaccattaccatctagacccagcaaatagactttagtgtacaaatgtgccaaacgcatttcatgtgcacgagccgtgactcattgtcagtcacctggagcctagggggctttctgcattaagaaatcttttactcctaataatgctgttttctggatcatgaatgaggctcagccatggctgtgctaaatacagaaatatctgtgttctaaaatctccatctctacaaaattaatctgatgctgatgcaaagggatccatctgccgaacatttccatcccatgaatatgggaaaaggggcagatacaattgagtatgcacaggtgcatttaaacatttaaacaaccctttgaatgatgagtaggttgagtatttctcaatggagcaaaatgtgtctgacatgccattgagcaggtatatttaaatgatttcccggttcttccaccacatatacagtggtgcatattttcttatggaaggtcttgtttctccatctgtatattgtgctccagagcttttgcccccaaacacacccttatatagttgggggatgaggagcactcagcctcgaggttgaattctgtcccttattccgctcactctctctttcctggcctctgtttcttcatcggtaaaatggggacagtaataatggtaagtcataagatgcttataacagtcaaatttggcagatttgtgaatattgtccagcatagcttttggcacataaaaggagctcttcgaaaatgtttttcttctcttgagggttttcagggaaaaggttttgaagaaaaagatttcaagccttattggattaaagtcatgttcgtacctacagattgttggttctcttgagagcaggcactgtctggtgcagactctgggagatgtcccctgcagaaacctaagttttaacataacccatgctaattacatcatgtcagtgacagtgggcatggcagagctgctcccgcccttgacagaaaatagtgtatgtgatttgtaaatgaactgggtgctcacatgttctctgggaatgtaaatattgactctaaggaagaactaagataattttgtggtgagatagtttctagttgtttaggctttcattttgctttgttttaattgcacacacattgaaactatattccagccttggccaaacttcagtcattcagacaccaccatccatccttctactatccatgtttttatttaatatttttatttaaatcccctcttttaaagtgtaaacttattttaaaagcaaaccgtctctttcttacataaataggaaacaagtatcacatgcagtaactagaaggtggccttgatgtgcagtgaaaaacaacatcttcaaatcaactgaaggctccaaggcctgaaacccatgtgcaagagggagattagcaagtgtgtgagagccgtttaagacactttcacaccagagaggttctccttaatatagactcctgagacaagttcggaaggttttcttgtttggattcttgtgtcaacatattttgtagattagacctcatttaacgtcataatctcatcttttattaatatcattatcattgaggggttttgttgcccctttccataaaatggcaccagaaacaaaagaaaataaagttctacacattgctgggccaaactgtgaaactgtgtttaaaacaaaacaaaacccacagttttcagtaactctttctcagttaagccttcaggttgagaacaacattgtcaaccgggcataatattaattccaaacccactgaaaggcatcagccagagaaaggttgtgacaacccccgccatcccactaattgtggttaattgtgtctgcctgtgtgttccagttgcttggtgtgcctggggtcttattgagggtaggaactgtgtctcaacactactgtagcatttctcttgaattcttagcctagtaagatgcatatggtcaattccatcaatagttcttgggtaaacttgaagcctcccacagcttgccaaacagagcagacgcatgtccttggaagcacttgtgatccctttgcgtaggctgtcaaacagtgcagctctgggctgttcctggcttgcagggttaatgtcgaaactcataggcttaagagagtccatgattaagaggttattgtaaagcttacacagcatatttagttaattacagttcttcgtttaccctctcctgccattttgcatttgcaaggaatagagggagcctgctgtgtttgtcttggaatggattctccaaaagcttagagacctacttctcccctttccttatcaggtcctctgggtcccagcccctgacccagggagcgggaccgaacaggaaaaagaggaggaaggggagtttgctcattcacatttctgtgtctgagtggctgtgtctcttgctgcaaaagggccagtgaaggatgagtcatctagtttatccacttttgcctatatatctgttttgttggagtagataccataacttgagagtataccgtggtttattctgtggagagttgttaatgataaagaaaatttagtttttcaaacaatatttttgaatcttgccatgatacttagaccttagaagaaacttatcacactgtacaaaaattaggacatttaagattcatatttagtactttgttttttaaattatctccctgctgactttccagatatgctcctggatttttttttttttcacatacccaagcagctttccctccatggtatagagctagccaaagattttatttgcattacataaacataactggttatactacagagggctatttttggcaacagaatttctgtatttgattttttcactcctaaagaaaaaaaacatatattaaagatataaactttttaaatgtaaaaattatgcattttcattttatagaaaatacaggaaaatatgtgacaaagtgaaattctataccccaaagataatcacttaagattttggtgtgttttttctttttatgcatagaaaaaaattgaggtcatacaatttaactcttgagtttttgtatttttgcttctcttgtctgcaagacataagttgaagtaaatggtatttaatgttctaaaatcactgattacagagttaagtgattttaaatgatattttaaaattttattaaattgcataccttttgaatcataacaacatagtctccaatatctttaaatattttttcagaaatttaatgttagtcataagacataagacacaacctttaaatagtgaatggcagaatggcagaatggcagaaaattgcccatgagattaattggttaagagtgctgagataagttccagctttgtaattacttttctgttatttacggccgttagtttgattacatagtttgtaatatgaggccttggatttaaagtatatcattgttaacttaaaatgggaataaagaataaccacatgctcaattttattgccacacagcaatgaaaaattcatatcataagatgagaaatagtcacagaaatccaacttaaaactagtgatcaggttccgagcgaagatatttcagattttattaacttgaagcagctgttgtctctaatatgacacaccccacagaaatggaataggtcttataaagaatacttgtgttttttcttttttaaagcagctggcttcccatcattgagctgtttttgagttcaggaactccagctcttggccttttccttgtgagaaggaaggctgaggctctagagatttttccctgtgcagctgctgggaggacagggtgaaaggggaaagagcctttgaccaagttctgtgcaggatctgggcacagtggtggggggattgggaaagaaggatggataaaccctccctgcatctatgagcaccagccttgctcctgggcatctcattgtcataaactctcagtaataggagggacaggacaggggacagtcccaggggcatgtgggaggggctggaaagaggaaaacaggcagattccaaggggcagatgccaggagggaaggctgctcctcagtcaggttcagggtcccagcgtggaattccaggaggagtacttgaatctcagcctccagcattcttgaaagagactggtggggaagaccctcaggctggaacgtactggagttcctggcttgctgcagttgacttgctgcctgatctctggtgttcttcaaagagctgctcagatgtcattcttcaggtctgcctttgattcctggcatgaaatcatctccatgcactgggtggttgtccctaccacagcttctagttatgtattagcatgattatttgagtaatattttcctccccatattttatccaacattctatccccagcaccaggccctgtacctggcatcctaaagtccaccgtaaaaattcatcaaaggaaaagatgaccatttaaaggtcattttacttctctttgctttatttagctttctgaaatcttttgataaaaatatatatggaaattttggtagctcttttttgggtgagatagcagtgtgttttccaacaggaaaaggacaaattactatttgtattattgtatatttattatatttcaatataattataaaataatttgctgtgttatataacttttatatccttagtttctgaaaccatttttggaaaaaatatcttaactttcgatttaaatatttttctcaaatgaaaaactttcatagattatgattattacttattaaatgtgagattttcttgatgtttaagccactagaaaaatttcaaagagggaagagtgtgttggcaattattatgttcattttatgatgaagatattgaaagttaagaggatttctcagtcagtggtgaattgaggaaagaaaattgggaggtggggagcatttctaggaattttctcttatgaatccttaagcatattttgtaattattgccttttctgaatcaccctcttcagtgattagcacagtactctgcatgtattaagtactggagttacaattgaatttatgtgtgtaagaacaataaggatgtggaaggaagaggtatttccagctatagataatcttgtgtttaagcctattctttttatttttctacattttaaatagctgatttcaattcagaaatagaaaaccaaggttaccattgactttcctttcacctctccaaagttcaaatcctgaacttcgatcttttcctagagttttctcttctcctgctgttaaattcactgggtatattttctgtcagtgttacctccccaaagtataggacttggtacacatgccgttgattgagactcaagcaatgtggaattggaggtcatcatactggagcaagcctgaagacaacccttattttccataaggaaagggtataccaaagagaataatacttttaacaaaatgtcagtgggaaagttttaattacttcagagagttggattctttctaaacatcctggactgcaggaatctctgcaaattaggattctccctacaggtttgtggattcagagtttggctctgcatttcaataatcattgcagctgttttatttgttgttttactttgagaacaaaggtgtttcttccgagagcttccccagggcctcacactcaaattttcttcctcgtcccaagtgacatggcaagttttagtaactagtgcttgttctagggaaacaaagttgtggctccaaaatgttccttaaaaatgtcagtgattatggtataatcatcctctctgaaagaaaaaaaaaattactggctctgattcaaaaaataacaacacattggctataaatcccctaattgcctctgaaaagcaaaaacggacatgtttaatttttctatcccccctgcaacttatctgctttgtctggtgattaaaataggcgacagccagtcaggcctgttggaatctggtcccttccctgccactgagggcttgggctcagaccttatcatgtggaaaaatgtaagagaaaaatctaattgttattagacatactctccaaaagtcacctagaacagaattgttctggttcacccatttggcatgatgtaaaagcaacacgttttaagaatctggtagtttgatcatcatggacagtaacttctcataactcattttacggataaattaccaagacactgagaatatttgtgtgaaagagcatattcactgccagtgagtgtggatgaaaattgtggaatttggcttattttttttctcttacctttatgtcttggagacctttctaagttgggatatggaagtctttacctcagttttgaaaactgcagtgtgacagtccatggtatagatatttatttccttggccatttccctttgaacgtacattatggtttgtttctgatttttcactgttgcaaacaacgctgtggcccatgcttctgtgaagagtgatgatgatgatgatgtcgatgacgatgatgacagcagcaagcggacacttacagagcacttatctgtgtctggccttgttctcatcttgggagtgtgtgtgtgtgtgtgtgtgtgtgtgtgtgtcttctctcaacaatcctgtgagatattcttatataccttcttattctctttttatatttgagtaaaatgaggcgcagagaaattttgtgacttggccaatgtcacacctcgtaagctgcatactggatttgaatccaggtggaacctcatgggtatatataagattgtaaaaatacacgttccccttcaccaggcctttcttctgacctaagtggtggccattctccacatcagcccttggccctctattctccatctcaggctgcatataaccttcactcagcagctctgtgctggtcatgcccagatatccaggcctcatgggcctctactttgtacctccagctgccagtgagatagttgtatacagttgtcagtttcttccttccagccccattctttctcattcttgtttccatgagtccttatgcccgttgtggctctggccagcatgaacttcctggtcatgtgtgtgccatgcgtattccagcatctcctgtcaccctgtccatgccttcctcacctatccagatgccgccactactttgccagagctgaagtagggataaggtactccctgtcaccttggcctactcctccagcctgtattgacatttcttcctgcgtgttctgaagtcacaccacggaattcttaaggatatacactgtgacattagagggcttgagttcaagtactgggtctgggctactttgctttgctgccctttagtttccttgtctctgaaatggggataatagttctttttttttttttttagatggagtcttactctgtcacacccaggctggagtgcaatggtgccatctcggctcactgcaacctctgcctcccgggttcaagcgattctcctgcctcagcctcccgagtagctgggattacaggcatgtgccaccacgcccggctaattttttgtattttttagtagagatggggtttcaccatgttggtcaggctggtctcgaactcctgacctcaggtgatccacccgcctcggcctcccaaagtgctgggattacaggtgtgagccaccacacctggccgataataggtcttacctcatagaatcaggaggaataaatgagatcattgtgtcaaccgtgttaattatcagaagcgtaagcactattctgaacttggtgcatgaccttcccatattggtgcatttttacaggctatttctgaagttaagacatgtccgcttaccttgagtcaaacatgaaatgtcttacattttcaaaacactttcccttccttgtagtctctactttaacctttaattattccattttatatgttagctttctctctttcaattatctggactagagtcacctgatactcctctcctcaccagggaatcagccaccgtggtgagcacgtagtaggttgtgtttattattgtgtgatccttagtgagtctcaagtaggctgaagctgcatgatgagtcatcacactgagcaactgtgctcggtaggactgtgttgtttatactctaatagaaatatttaccttccttctgaagatctgttttccaaatacctatttgggcatctcaaatcctaaacagtgtttattaatcatacttcttccaaggactagcacctgttcttcttgggcaaataatccgtaaacatacatctggataggtccagttagaattcactaacataaatagcgatgccttgtcagtaatgttttaatcacatttctcttaagttctgcagaatctagttgataagaatgactgttcttttgaaagctactgtggacacacacactcacatgcgcaaaaacctcatacacaccataaacatatgttctttgtattttgtatttcttccagagaagaaaacaccctaattttacagggtcatgaggaatgaatgagataattgtgtaaactcctcagtgaatctgctgcttagtccagttattatccatttaaagttaatcatgaagacacttcatgaaggagaaagttttgagtggtgagaaagttactagggtagaagtataatagtgattatgtatataatgctatctcccagggactgttctaaggtgtttgggtacacacacacacacacacacacacacacacacactcctttaattcccacgtgaaacctaagaggcaacatttaggtggggaaactgaggtactgagatgagtaactgggaggatagaagacgaggacgtgggaaggagtgagaaaaggaatgtgccccaggtgattggagtgtttcgctttgtagtgctgaccctaaacttaggactgtccacaaagaaggaaaggcagtgaagggggatggaaggtcataggaatcagtcacttggacaggcatgggtatttcagctcagccactgcctagcagtgtggcattgagaattactgaccttctccagacctcaggcttttcacaggtacaacaggggaaggataatggcctttgtgttgctatgaaaaataaataaaatcacatgcaggtataaacataggcttagtctactgcttcaagaaggtagcatctcaaaaatatgaccctttagcacttttaggattttctctgtaggcttctaatattagaagtggggaaataattatatgtttctttttttccttttttttttttttttttttgaaacagggtctcactctgttgcccaggctggagtgcagtggtgcaatcacagttcgctgcagccttgacgtcccaggctcagatgattctcccccattagcctcccaaatagctgggaccacaggcacatgccaatgccaccatgcccagctaatttttttattttttgtagagacgaggtctcactgtgtggcctaggccagtctcaaactcctgggctcaagcgatcctcccacctcagcctcccaaagtgctaggattacaggtgtgagtcaccactcctggcctccgtaagtttcaaatgatgcaaaaggaacattaaacaatgatagccattactttcatttgacagagctgatgattttttgctacattgacttttcttggttccctccttttcttctttctataccaaagtatttcaaagctcatccaagacagtgtgtcattttcccctacagactgcagtatccacctctcaaaaaaatacattttcttaataagccacaacaggagtgacaaaattaaacctaaattaaaaattggcaatattacacctttggccctgcacatacagggatgtttagctggtttacttgttccaagtgatcttgtttcactcaaatttaaatgaatgacatcacagtttttacaatttcaaacacaaggtgttccctgaaagcatccagcgttattctgcactgttcagttttagctagttttctttctgataactctcattataaacatttaaaagaaaaagaacattttgcaacattctgcttctccagggcagagacacttcagagtattgctgtctgtatgacccttgttccaacaaatctgctgattcctgaaacagcgtgtttttgttttgttttggttgtgcttctgtttcagtttattcatcctttccttaccctgatcattggcacttctatttctttataattcacaaacctgatattagaccaggacatctttgggtagacgtcaccatatacaggtgtgccttcattttttagaaaccagcatttaatcaataatagtaagttgctttggggtaactacttgcagttattggcaatgtctgctgctgtgagatttggcttgaagctgcacagggcaggtctgcttacaacagtggttttcaattttgcctttgcagtcaaatcaggtggggggcttttaaataaagactgattcctgggccctgccttagagatttctggtttaattggtctagggtaagaccaggtattgattgtttttaaaaacaaccctccaggtgattataatgtgcagccaggattgagaaccagtgccttagagtgtccattctcaaacttgaacgtgaagcagaatgacctaaagggcctgttaaaacgcaggccactgggccacaccccagaatttctggttcattaggtctggggggttgaggggtggcggcgagactttgcatttctaaccagttcccggatgattcagctgttgctagttctgggaacccactttgaaaaccactggcctgcggagatctttccagtagctttgtaagattttataacaagaaaaaagacaggatttcctgtgcttttaagtaaaacaactgcttaaggcacaaatattaaaatattatgcttcccggttcataggcaagttggaccataccctctgtttgctaaggcagcatctgcactaacaggcagccagggcccaggatctgaaaggacatggattagaggcaggtgagaagttggttttttaaataaaaaatgctacaaggatctatagaattgttactaaggttagcaaattacctatggattgtacagctctactgagatacgtagcttaagatgtgaataattccctgggcagcatgaaatatggcacagaagtacgaaggtgactcagacaaacatggtacttgatcccctaaagagggcagtttaacagtagaatgtactgcctgtgatgagacatatccatttcttatttaaattcacgccctacatttctctttctccgattcttgggacttctagttccatttccttttccaaacccttctctccgtctttgagtgaaaaaccctttatgaaatgtttggcaacaaaggatgccacctttgccgattaccaggagtgtacttgctgcatcatcgtccatttgtcctcacctgattttatagaagtgtgaacttgtataagcagctgttctgtgtccaaagacttgggatttgggcttgcagggttggactttgaacctaagcctgcagcagacagggcagcttgattcactcttcctgccatgcaacttctctcgggtacagtgccctttgctagctggtagagaagaaaagagcctattctatccatttgacagaccgctaatgaatagtaatcatgaaaattgaagtcgtgcactgccactgcattcaccattgttatattagcaattcctggacttcatgaacagagcactcgttattctgcaattaaatgaaaaataatggcatcgcttagctataaggaaggaaacgttcaagtgcagcctctgtataattaagcttaacattattatcaacagaaagtgattgtagttgtgttcagaggcgagaagagatatgccaccaaccatttgacctatcaaaagaaaatggcttttgtgatgtttgatgttcttcctaacaaccagctttgtgccttgcatggggcaggtgccattttctgcaccattttctctcttttccagctgttttaaagttctttctcatcagttctcatgactgcctttgtaacacttgtctgttttccatttttccttatgtcttcaccagcatctgttgtcctgctttttgttttatctttttctttctttggcgacaatctattttcttgactcagacacactggctttctgacataaaattaaaacaatccatttaatttttaactaaaacaggtgttgagtgattgaccctatcaagcagctccctgcagaaacctcatttactactagcttctttattgccccctcataattcattagcttaataaatgcttgtgtgaaaaggcagaggccaagattaccaatcttacaatatggatgtctgcccactccctctccagcccacatcccagggaagtcaactaggttgagctctccgcaagacagtcgaagctccagggtgtgtgcttcaaaaagcctcaaattagtgagtgctctaaagtaggatccctcctttgcttcagcatacagagtgttcacctctcagggacatgctgcctgcatcccctttagtggaatctggggaaataaaacgtctgtatcttctgcttcgtaactcccagcagccagcaaaatattcaatgttttggagctggttacaagaaacttccaaatcctcaaacatcatcagagaaagccacagaccccaagcgcctgtcacatttgggtatgtagtgcttgctctctctctacgtagcacctaaggttagctggtggatatcaaagccccatagaggaaggggtgtgggcgcggggttgttggcctagtcttaatttaggttcagcatatgtctgaagcttcccccgctttaacattttcacagagcccagacttatctcagcaagcactccacaacctcttcgttctgaaacccctgtgtattatgaaggaaatgaaatccatatgtttctgattcatttacatgtagctcatcaaaatgtagttttgtaagagctctttggtgtccaagaagcctttggagcctttttataagacttttaaccctcccccgcttcattcttcttagaaccaggaagttgggacttgccaagagtaaataaaagcaagcttcagagttgactctggctctggcctgacccatctctggtctgagtctgcagtggacttagcttcagcaaaaacagaaatgactgtctttaccctttttctggagccatggaagtaggcactaatcccacttacaccccacgtgacagtgagtttgggctcacagcatctcttggaggcagccacttgactctatgtagttatttccagctgagcctcttctctctgtcctgtgagcagagagctgatagggccagatggccacacctggaccagaacctcgaggaggagctcctttaagcagtgccgctcatctacccgcttgcaggccactgcactgtatctccaagactttccaggccagattcttaccaagggactgcctatgcatcagggacttctatcttttcactgggaccatgacagaggcacccacaactataccaggtttcatggtggtattgttggtgctgctgtcacttaatgatacttttgagtgtttagtttttcttcatcaagaaaggcttataagctttaaagaaaacaactatctactgccatgaagattccagagcttttactctgaaaaaccacagaaatgaaatgagtcaacctgtttccagagttcggctagggagaggttgtggggtattttttctcctctatcctaggatgatgaattatggaaagccattcaagagcttagtattccttacttgggctgttgtcgtgagtggggtggaaggaattctgccctcatctttgcacgtcctggcttgtttccttgattcagaatggtgctgtgcctttcagaggcagaacctgggtacatggaaatgcataggcatgtagttgggagtagagctggacctgggagttctcacctcatcttccagctgctgaactcaggctttttccagagttttatttcttcatgtggatgcatacggtgtaataaaaaatcatccgctcacttacaaattatatcacctccaagcattcatcttcagaaacacgcttcatcttccaggatacagaatttgataaagtcattgctcagcttcagcgtgaagacactgcatttaaattttaccatacacattttgtgttatatgtaaatgggagaatcattctcagcagaatttttgaaatatttcagggcaactataaaatgttttagacaagttggaaagccatctgaattacgtattgcagaaccttgaaatctgagcttcacctgaaatcccatggcaggggaagccattacaaaaaagcttgtattgaagctgtttcctcactgatgaatgggcatggcacaagtatgctgggcttatttggttacatttatttctcaaaatgaacaagccagtacttttatgatctaaggacagacagctgtgagtccatcccaaaagtactttcaagtggctttgaaatttcccttatagacagtgacgatcatttgatgcaatgtggtggtgagattgtcttcgttttgtgttgcctccaacaggtccgtactctccagtaatactggtttacagataatgaggcactacacacatcttccttttaataccctcactgggtcgcctgtggtatcatgccaggtggagaaacagaagctaaacttcctccagtgaatttcacccagagttattcattcattgatttgctcatttattcaacatatattgagtgcctaccctgtgctgggccttattctgtatactgcggacacagtatacagaataagacacaggaggcccaagtccaagacacaggaggcccctgccctcaggcagctactgttcttgtggatggagcttatttgtattttagcagtaaaagggagtggcagagccggatggtgacctgggccttttagctttgttaaaaaaataaaagatcctccgatcctccccctcacctcccaccaacccctcctccccgcaataagtgtcttccctcagaacaacccttctaatgtggtgtggaaaaaactctgccatggccctcagcaaaatccacacactaaaagcctttgagggaaaagcattttcatcagaaaattgctgtggtcaagaagtttaaagatccagcgatttttattgacatgttttgagtactttctagttgatagagtctcaaaactggaacttctggagtgtaccctgtgaaacttcttttttcttgtaggtcagaatggttggacattggcaattcctcatagtgcagaccgtgacatttgcctcctctttgtatctggtgtgtagtaagtgctcagtaaacatacccagaattgctgttatgtcccaggcactcagacatctctgagcaatcttaaccatttgcctgttgtccagttgcattttttttcttacgtagctaaagttgtagaacatattattaaaatttggttttcataaactttacagcagtagctaccaggatttttcacagtgtgatcctcccttccccaaagagtttcttaaaccctctgatccgcagattatgacctttctagggaagaggttgctgttattatcacctatggaggctttaatgaaaggggccctggtggcacaggagataaagcagacttgaattcagcaccatccgtcgtggtgggggcttccactcatccctccccaggccctgtcaggagacgccaggcgcttggcacccagtgtgggctcagtaaaggttagcaatgatttttgttattgctactaaatgccagtataggtaggcatgctgtaaaatgaacaggataatctaagcggaccttttttttccttttatttcttcccttttacatcatttctattgttttgctgttatttgtatatatgtgtgcatgcattggagatggggaatacagctacggaggttttgaagaggcacagtattgggtttagttttcatatcaaatctcacacattctgaaatctgtgaagaaatgtgtcacatggtgatgcctggcatataatcagctcctcagaaaatgctgtgattaacagtaactccaacagatatttccttctcaaaagaaaagcacatgattttatagcatttttaaatgccagggcatctcatcagctcagtcttttcagtaatttaaaaaaaaaaaaacccagatagtggaaattcagggtagtcaatggaaaaaattcaataaagctgaatatctcggcaccacagagtggtgtcctttgaatgtttgtttatcattcaaatataataacaccaaaaagaaaaaagcatatgaagtgacggatatgttaattagcttgattatggtgatttcacagtgtatacacctactatcatatcaactagcataccttaaattatttttatttgtcaattatacctccataaaactggggggaaaagccactcttttaaaggcttaataggaaaaaaaaaatccaaaaatacgtaacagttcaaaatgcattgttaaaagagcaagtttaaaaatactgtgtataatatggtctcatctgtgtaatataataatggacatgggagtagaataacagtagaaagaaacacaccaacggtgtggggttggataagcacacaaaactttaactagttcctttgtttttgagacagagttgttgcctaggctggagtgcagtggtgcaatcttggctcactgcaagctctgcctcctgggttcaagcaattctcctgccacaggctcctgagtagctgggattacaggtgcccaccaccacgcccagctgatttttgtatttttagtagagaccgaggtttcaccatggtggccaggctggtctcaaactcctgacctcaagtgatctgcctccttcggcagagcgctgggaatagaagcgtcaaccaccacacccggccttaaattagttctttatacatgttttattttttaaactttttgtaatgaacctatatttattttgataataacagctaaaactactgaatctcagttaggcaagttgaacaccctttttgcttgttggtgtctggtcagttttaatagtctgttttagatgttaaaggtatcagatgttctgtgcaatagccccaaggattgactttgctgagctaactctctacagcgcagttcatttctaagttaaatagttggtccagttttatcagcgtgctctagcatctgtcagtgccagctatgtttacagctttccttggaattggactgtggaagagctgagaagcctaaaggaaatattgaatcctttgtctgttagaaaccctagtaaagagaaagagagagcaccaaatagcattgcaagcatgcgagaataaattcttccattgtaaacatgaaagaacaaatttaaagtctggatgagataccttttttcttttcaatgttaagactcaattttgcctcatttgtagaagagggaaccccctcacctctcaggtgctgcctacatctcactgcagaagctacctttttgcttctgaggaggtgatgggccagttaaatgtgtataaggcagttctgctgtgctcttgggaaatccagtatgctgggtgctcacaccccagtgctggcctccaaggtgcagggcactggacttgcttgcctgctaaaaccaaatcctttgtcccctttctgctctggatgctgtttgtcttggcatgccactcctaataacacttggaaatagaaaacaatcctgaatccttggggtttctctctagatgtcatctttaccttcttaaagctgtctttgaatatgagcagtgtgtatttgcatttatccaggtaaaatattaatcaccaaatagagtgtggagtgtccagaagtaccagacacttggagtacacacaggaaagtatcttttgctgtggcaaactccagttatggaaggggtgtggatgcttgaggttcctgaagtaccaaatttgatgatgacgttccacatgactgtatgaagttaatgtatatatgtgtgtctcatgtaatgatcttcagcaagagagtcttttttatttttattttattttattttatttttttgagatggagtttcccacttgtcgcccaggctggagtgcaatggtgtgatcttggctcactgcaacctccacctcccgggttcaagcaattctcctgcctcagcctcccaagtagctgggattacaggcgcctgccaccacgcccagctaatttttgtatttttggtaaagacagggtttcaccatgttggccaggctggtctcaaactcctaacctcaggtgatccacctgcctcggcctcccaaagtgctggtattatagatatgggccaccacacccggccagcaagagagtcttaaaatgcctttttttatgtcatggtccacgtggaagacttgtttacatttaacctataaatctcctagaacaatcagttactgaagatccactgagacaatgttgttggcctgggattgatgcccaggcagtgtgattgtggggccgttgctcatggcaaccatgtaaacaaacaatccttgtattcttgcccaggtgctggttacctgttgctttctggtcatctagagagacctgtaaaatatttctgctgatttcatttttgctttgcctttctctgcccataattatttaataaagccatcaaagtgggaatttcattgtgtacttttttccttaggttgtttataggactgtgaagacctgtcctaatgcaaccccattaatagttccctctgcagaaaaactccaggttattcttatcttctctttttttccccataattttaggttctaatggcatctcttttatcagtagctcggggtctagaatatttccaaaggtcttttgaaaattattactcaaatactaccttttagcttaccactctgctgaaactatttcaagcacccataggtttctagcatttacaaacatttacatagtatgagaaaattggaaagtggaaataaaataagatgtggtctctgcactcagtgacctgtgcaatacattgagctaaacaccacagtgtaaaatactagatgcttgaaattgctaaattagccacttaggagactgtgtggatttggagacacctagaaagtcttcttggtaaagatgagactttgctaatagttattcaaaaaaattgctatagaagtccaacatgtatatatcacatatataatgtagaaaaatgactggaaagaagtagcagaatcccagccaagtgacagcatgtgtaatgattcagagcttgcagccttaaaccagaatgcctagttcttcctattactggctgttggaccacataactaaggttacttaacctctctctacatcagttttcttgtgtaaaaaggagataattatggtacataactcataggcttatgtgggttaaatgaattaatatgtatcaagaatttagaccactgtctgacctaaagagtactcaataaatgttagctatattgggcatatttaaatggtgagattaggggagattatattttcttcatagtcttaaattttccggactttctacagtgaacatgttggactttgatagaaaaaaatatttctaaagtcaggtctttcagtaagcttttaaagatatgtataccacaggtgagtcatactttgatgactaaaaagtcaatttgagcatattttaatggaggttaggcaacattttttgctgacattcaattcaaaattttttattaacctccataaatggaattaaaagttttccacaagttcccaggacccctttgcttcttaagaagttttagcatacattagagtagacagtttgattccctttgtcatttgtaacagtaaggtatagtttaagaattgggtaaacatgcatctcaggggtaatgtaatgtgttacagttgtttccagaaaatattaataaatgtaagtgtttatatcttcttagagtaactttctgctaaattgtagtctctaatcatttgttatactcttgtgctttatcattgtgttagtctgttctcatgctgccataaagaactgcccaagaatggataatacatgaaggaaagaggtttaattgactcagttctgcatggctggggaggcctcaggaaacttacaatcatggtgaaaggggaggtaaacaggtcattcttcacatgatagcaggaaggagaagtgctgagcaaagaggaaaatgccccttataaaaccatcagatcttgtgagaactcattcactatcacaagaacagcagcatgagggtaaccgcccccatgattcaattaccgcctactgagtccctcccacaatacgtggggatgatgggaaccataatttaagatgagatttgggtggggacacagccaaaccgtaacagtcattttataaaatactacatatgtccaatatagagggtagttcccttatttcccaaacaagattcaaaaacatgttttttggttttgtttttattggaggggagtaacctgaacagaatatgtaaatgtttacagaggcatgtgaaatacccattcataacatttttttttagctatatatatttagggtcacagataaatcacatataaaatgctaagtgagaaatactgactttttcctattttatgagaatttttttaaaatttttcttagtatttaacaccagttatttgctttgttagctcttgagaactgttttttttttttttttttttttttcatccaacagttttcagagcatctgtcctcacttttatctaagtcgttagagacacggcacttcctgaatcatacatgtcacaggaagtattatcctgagccatgaatcttcatccgtgcagtactttaacatattttttccattccttttatgaaagtatatttatgctcaccacaattaaccacttactgattgctttttaaattaatcttaaaagttgttttcagtgccatctgatgcttggaattgtgtagctatacctagcaggaataaatactaagtctgtgtcagtattcttccccttggtttcagttatctattgctgtgtaaaaaaccatcccaactttgttgcttgaagcacccaggattcattgtttctcataagaattttctgctggtctcatgcggacttgctcgtgtcctagctgggatggctggattgttcatcttgcagttggtgctggacaatggtgggctctctctcagtggctttcatgcacaaggaggctcacacaggcttcttgatacagcagcctcagagcatcagaagggcaagagtggatgctgtctggtctttgaagtctcactcagaagtcacctgttgtcacttctgtgttctattagtgcaactgagtcctgaggcttgcccaggtttgcactgaggaaatcgattccacctcttgctgagaggagcagcaaagaatttatcgccacttttaacccactacaacctcaatttcaactgattgtctctaatgacttcttctgtaagcatccaaaacatcccttgattgaaactatctcaaggtgacctatcttccttcaacaatattttgtggttcgaaactatgtcattaagagagtgactttgaaaacctatataaggacccagatgtgaggtgactgcctagtctgaggaataatgactttaagttatatttgtagagaggtggtaaagccagcgaagcagacccatggagaaatgcaaatctgtcatcagccttgaaggatggggcaaatttggtggtgccctggttaaggaggaacagcactgtgtcttgctggcaaagcctaggagactaatttgtaaaattaacatttctttgagaatatgctttgttactagaaagcagtttgatcaatgtactcttgtataagcaactagattaaggaacaaaagagacaccttaaagaaacacagtgagccttcagaggaggagagccttcatatcactgtaattagcaaacgtctcttatgcatcagttgggctgccatgaggctgtaattaccaggtcttagagtttgcctctacctacatcattgtataaaatgaaaaccagatgaaacaatcaaatgttctatgcaggagaaaaatggatgcaaaacaaggcttgcaaaactcttaagtgctctatattgctaaaggttaactgcattgcctgacataaggaaaaaccaggaaactactctaaatgaggagtagcatcaagaaaccacaaaagaaagagctcgacataataaatacattattaaaatgcatagtatacagtgtaaaaggcagtctgcaatttttgaattatgtgtcctataaaagtacatcaggtaaatatgtgtaattggagtccctggtgctctggcaaagctcattttgctgaccttcagaaaactacactgacttttttaggagtattattttgatttgaaaaagctcttctttgccagtaaggaaaagtacagtatttacagaaaatgagacaaccacagtgtacttaaagtgtatgtagtgcatgcgtgttctctgcaagaaaattaaaagtctctgtttttcattcagaagtaattagagaatgtcttttgtggctgctggaaaacagatgcaagactcctagaagtctgaagtgtaaaattaaagtagaatgtatcattgggtgtcctaatcttcaggtaatggcccaggcctgggaaaagtgaacagactttgtgttcccagttgtaaatgtgctccatggagtctatgatcatgctcactcaagatgtgacaaagcataaagagtcattttggtccagaaatccctgttggaacattaaactgggtgctgatattgactatgatacctggaaaaaaggcctcccatcatttcttaaagaagataacagttgtaccaggcacaacggttcactcctgtaatcccagcacttcagaaagccgaggcgggcggatcatttgagatcaggaggtcgagaccagcctggccgacacagtgaaaccccgtctttacttaaaaaaaaaaaaaaaaaattagccgggtgtggtggcgcaggcctgtaatccctgctacttgagaggctgaggtagaagaatcgcttgaacccaggagatggaggctgcagtgagctgagatggtgccactgcactccagcctgggcgacagagtgagacaccatctcgaaataaataaattaatttaattaaaaaaaagaagataacaggtcttattggcctttcattaactagtactgtccataatttcagaacattccatagaaggtggaaagttgaggcccttgcctgggaattgttgatgccaaatatcaacacatttccaaatattagactgattagtgtcacaggtttaagccacctggtcaaataaagcaaatttttcacccttattagagtaggttaactgctgtaacaaacaaccgtaacacttcagaggcttaacacaatatttattacttgttcaagtcaagggccaaatacagttcagcaggccaagggctctgttctttgcagggatttaggaacacagtcttctccatctgtggccccaccttccctaggatctctgaatctttccacttggaaagaggatgaagatccaacaggggagatttttatggggcaggctcaggagtggtgtacattgcatctgctcacattctgttggccagaactctgttacctgacccccagccaactgcaagagaggctgaaggctgaattgagctcagagcccagagcagcatcagtgagcattagcagtctctgccctagctttcctgttgaggaccagggcagaaggtcatggcaactgggactctcagacatagttttcagtctgagtacaaaataggaggcctctccagtgggcctggattatatgcaacgaaaacaactcttgcaatacaggagaaattctctgcaaacagagggattaagaccccacctctgcgacccccgtgacctaacagaagtaaagccacttgatcatatttatctcagagtccatttcctttcttgtgtctgatgcattggttcttgaatgtggaaaacctctttcccttgggtagagacctaccaccatgtgggacttaaggaccaggacagctgaataacacgtgtggcattctagacacatggccttcctttcagtctctaaattacgtatattggtttaaagaagcctttgtttcttaaaataagttctcaatgctccagattagaagcagctggaaatctttgggaaggggcagaggtttcagatgtgcttctgtgtatttttttcagtggacatgacagatgctccaaaatgacacacatacctgtcatgccagcaaagccacatcctcagggtgtctgccttagcagcagtgatgcctgggttgtcagggtgggctctggaccaccacaagcagtactgctggggatcccattgtgggacacactccaccatttccatcctgtcaactcctcttgcaggcaggctacaaggacaccaggagaatatggaatggagcactggaatcagaatgctcattcttgatattttattaattcaatgtaatgaagctttcaacatctctgggatgcacagttggttccttggagtcattaaagatagcagatgccaagacctattagaaatggcttacagtggagtgcagtggcagagacctttgtatttattaccatgagcaaaggttacattctaaagaaagaaattacagttacattccttggtattgttgttgttggtgtagctcaatcacatttattgtttgtatgtgttaaggggacctgtctaaatcatatcatatttttcttttactttggtgttacataatatataattacagagaaaccccaaatccaaatccttgtaaaatttccctttacctgcagttaattcctaagccaagttacttcagggcatagctagagtctgctttgcttgtttttgcaatatgccatgcatgtgggtgcgtaataaatggtattctacaatcaccttcaaggtgtacattatgggcgagatttacaccatatgtaacaacagaggactggagaatgacagtttaggaaatgcaggttataagcgtgcaattactctaattatggacctaaatggaacttgacttgttttcactctgtagtcagtccatgtgaactgtcaggcgaaactttcacaagatattctctccccaaaaaggcagctctgtggatatgtgtctgtttttattttctcgagagcctttgctttcactttaagctttgggaatatggataggggcactgatagcccatggcttggctgatacatctttgcctttgctgttactgggcatttgtatcactgatgctccagttaagtctccattcaggtgtagagagaggaatccttggatactgtgagggcatttccaagtccttatttgcatatcttgatgatatattggagtgtgaagaaatgcatgatcatcacaaagtgattgtcactgtattgctctgcttagagtaagccctgctgcaataacaaacaacttggaaaatttcagaggcctgcaacaataatatatttcttgctcttgatacatttccattttgggtcagcagctgctctgttccatgtcattagccttctagaacccaggctaaaggagcagcctgccacctgggtcattgctggtgttaaggcagaaggaaaagacaacacggcagacccaggtgatggtccttagccttaacccccgagaaggggcaaccaatgacttcacaaggcacattgcattaacaagtgacaggatgaagtctgacatcaccagggcagggaagtatcatctccccacagagaggggcagcaaatagactgagcaataaataatacagtctactgcactcaacaagacacaagagtgacttgctcaatgctgtcctttgtaaaccagaagtgttttgaagaccggatagcaaactattagaaagatagaaatgacatctaccctcttttctgagcctcagttccgtaaaggtatcttagaatcatcagtgtcaaaagatattatctacaagatatgaagagaagaataggaaatctgtgaaaagtggagcagaacaagagcttaagaaaggcagtactgccgaggcaagacctaggggctcctgctggcccacagactccttgtaaatcttgacccatggttttctgaacctcttgagatctggtcattagttcccatgaacatattcctttctacaagcatttcattccaggaaactactggaatgagtctgctcctttcaccagaactcttaagtgttaaaataacaaaaatcaacacataaaatgagatgcactagctgtaaaattcatttccaaagatgtagggatgtcccaaattcaaaaaaagagagacggaatttaacctccattggaatcttgactgaacatggaagattactgccaatggaattagcgtagcttcagaataaacaagagtgggtcaactcattcacccactgattcagcccttcattgttatgtgctgggcattgttgcaggtattcgggggttagaggaaaagactgagacaagcaggagccctgcttctgaagcatttaccttctagtgggtgtgacagttaatgatcaatcatttgctcacttgtaaattaattattcaaaaaaacctattattaaatgttggggactcaacggtaagcagaagaatcaaaggtccagtcctcatggatctgcattttaatgggggaataaatagaaaataagttataaatagaaaataataactgccaaattgacatataagacatccggtggtactaagtgataaaaaatgaagaaaggagagtgggggtagggaattgggggtagggactacagagttgtagtcagatgtgctatttggtatagggtggtcaggctaacctcactgaagaggtgacctgcatgcagaggggagaaaatgaggctgatattcagtgaaggaacacaaaatgcagagtggaacacccagtaacacacctatagctgatttctttgccttctctatcctgggtttcttattttgtgtattacaccttgtaagaccctcccacttcaaatgcaggggcaactgatgacttcacaaagatagtggtggttactgtggacatttggtggataatctgtttcttatatgggatacgttcccaacataatcccctaggccactcttgttacaaaatttaaaaaaaaaaacaattttttaaagtcctttgagtttctaatatgccatggatagatatgttttcaattattgcatttggagttcaaaataaaaaaaagattgatatgtgatttaaaattctggtgattctacagctctgaaagtaattgaaatttgtttttgaaaagatttgagtaagtggatagaggtagaagttttgggaggaagttctgtccttcgcaatggctccattgtcaagcaaaattaaggcaagtaaaaattgcagttggcttatgtgctgaatcccaaattagtttgggattcagttgcttttgccttaactttcgccataaacaatatggaaacttgattaagttaacttaattaagagagattgctagatgaggttattagaaatcttttgtaaaatgcttcatttctgatccatttgatgtcaaacattttttcctgtctttgatgttgaaataatcagattaaaatcaacttgttaaatatgaaacctatggacgtaaagacccattgagttaaagacttctcaaagagtttctaggtttgccttttttaaactgtgattttcagtagcagatttgtttgcgaatgcagttagtggctagatttctagattcttctggtcaggaacactctagccggcagtcactacactgaagggctgaatgataaatttgaaatgagatcagatttctcgcttcttacattaccacaatagaccattgaccctctaaacaacagccatggcaatatgtgcccccagcaaataacatggagatctgtaatgcctcttcacttattctcccaggactgaacatgctctttctgcgaggtcatctttgttcttggttgtttctagatgcaattcagggtgtttagtggaaagcaggtagatcttaaagtcatgcagacccaagttccaatcctgctgctgtcggcctgtgaaaacttagacaaggtattttctaagcacctttcttcatgtgtttgccagaagtaacaatatcacagtgagtgtgtaatgaggatcaaagtgagatgactcaaggaacgccatcagcacaatgcctggcgcacgataggtgcccattatttgttatttatgtttgcaaagctggagagatggaaattattattcaggtgtcctgaccttgtttgggagtatctccgcagttggtaggcttgagctgaatgtcatcaaagaagagttttattgaactaacactgtgcttaaaaatgcttggaatttggctgggcgtcgtacctcacgcctgtaatcccagcactttgggaggccgaggtgggtggatcacgaggtcaggagatcgagaccatcctaacacggtgaaaccccgtctctactaaaaaaaaaatacagaaaatcagatgggcgtggtggtgggcgcctgtaatcccagctactcgggaggctgaggcaggagaatggcgtgaacctggaagcagagcttgcagtgagccaagatcgcgccactgcactccagcctgggcgacagagcgagactccgtctcaaaaaaaaagtttggaatttgttgccaatgattcaaaattgggagacttttacagaaaagtctggagttttggcattattttatacaacactctcctctccctgagtccccacagggccagctatcagcaggggctgaaagtggctgcttccgttgggtggagatgtatgtgctgggttcatttccctccttcatgtttctgcctgaaccctgaatgcagctaaagtattgatgacactcggtctagacattaggctgattagactcgatgagcaaatgtgtgtattttctgtgtgtagcattgggaatttgggaggctacatgtaggccttgagatgtgtttgtctctggaccaggaaggcagtcccttatacaccaatgactgaaggagagatgcctccttctgaggagcctgtctctttgattgagaatgcagctttggtagcaactaatcagaagtagtatttgggaagagggttgggacactgggtcaggcagaaagatcagccactataaccagccatggagcacagtgatagatacaatcccaagtcatcctcaagtgtaacacaggcaaacatggttatgatagagataggaacaagggaagattagggaaatagcatcagtagaataggacacatgactgaccgtggagaagccagggagaaaggcaggattcatttgattcaaaacaaacaggatagttcattttccaacaccttttgggacagtgttagcactcctttttttttttttttttttttttgagacgaagtctcgctctgtcacccaggctggagtgcagtggcgcgatctcggctcactgcaagctccgcctcccgggttcatgccattctcctgcctctgcctcctgagtagctgggactacaggcacctgccaccatgcctggctaatttttttgtatttttagtagagacgggatttcactgtgttagccaggatggtctcgatctcctgacctcaggatccgcccacctcggcctcccaaagtgctgggattacaggcgtgagccaccacgcctggccagcactcttgataaagtaaagataattagaaattatagtcaagtaataaccttttccatttatctggttttcttcagagctttatcccttatctgatcttcataacctgctaaatttgtcacaacaaagtaacagaagagttgtcaatatgctggtccattgaacgaattaatgacatctctttcttaaaattcaaagttttgattgattaaattttgaggtacataagaaatgaatagaaaccaaagattttcctgattttctctctaagaaataaatccaaaatttctggtttaaatttactttaaaaaataaacaaaaaacatttgatctgcattgttctcatcacaatttaagagactatattcagctatgaatgccatttacggttttgttcttatatttgacccagatttagcataaccaggtaaaccaggactttttacaagatcactttaatggttactttgatttaaaaaaaaattctcaaagcgccaagaattgccttggttttcataaaaacttgaatatgttgtcattgatactgtggttattcatgttaagttctcaactaatgtccatttctgtgaaggattttgtagggagccagtacataatcgtggttttgtcatttggtagtggtcttatgtaaccacttaatttttattgcaagagtgttaagtcataaaaagtgtctacactgtgctcagtaaaagaaccagacctctctagacatctttgtggtcattgttccagcattccagcgttaacttcaggctgacagagaattcagatcaacagaaccactgtggtgaggccaaaatttgacccccagagtgcgatgggaatttttgttctgtggctttgcactgggctttcgtaatggttatcagagtttaagaaattatgattacatgaatgggtaagaagtaaaatcatgctaataatgatgatgatgatggtgacagctaacatttatggaatgcttacacttgcccggtactgttctgagggcttgctgtgcattaatgcatataatttttacaaccatcctataaggaagggactgttactctctcctatttatagatgatgaacctgaggcatagtgagattaaatgacttgcctaatatagagcatttaatgaagtggcagaacctagactcaacccagcctggctgatgtttgtttttggtttgtttgagggaattaatgagtaagtcaatcaagatgatgtagttggacacaggcactttgaaacagatttcttatctttctatccagccccttggcatcaccttgataaccagctttattttactgtttctgtgatttctttgtcccaccctcccacagcccttttgcttaacaaagtgctttgcggataatagaaagccagtacttgctggcttgaattagaaatggatgatctgagccatactagagtgcagtgaggcagaaggagtcccaaaggtggcagtgcaaacgttctcactgtagcaggggtacagagccatagggggaggggtggggactgtgggcagtgaagaacatgtagcagagaaacctcaggtcacctgtttgcagccctggatagaggcaggtgtttgtttgccctggcttggtacagttttgtcttaatgccttgggacaagcacatggccagtggcaagggtgccggcaccaaacacttgcacggtctctttccccacagctactaaacaagaagctagaccaccaagctcttgagatttcttagtccgtgtttagaagataatcaacaaaacctttatgtagaaagacagaccgtaagattttttccagcagaggtgcttactttttatttgcccacatggaccccggttccaaatccttgctccacagccctagccacagagacacaaaacaaaaacccctgaaatatctgtaagtatactttaaccttgtcagagtgattttggaaaacagggtgatcagcaagttttatccccactaacctttgggttagtgatttttttgtttagaaggtttgctctgtgtgtgcatgtgcgtgtgtgtgtgtgtgtgtgtgtgtgtgtgtgtttcccacaaaagattcttaggactaaatgtgtccactttaccttgccattccccttcttcctccactccaaaaagcattgatgcacagacctcaatgccagattgtgtacaacaagaaattctttaccaatatccagtcccgcaatctagttcatgctgtttcaccatcctttaaaaatggttcgttttgttactttttttgatcttcacaacatggctctattatattcacaacatggctgtgaatataattgaaatccagctggaaatagagtgaagaatagcatttagtgtttaaattagcagaatttgagatcatccttattacttcgtaatcgcatataaaagatcattctctttctgagtcagttgtttattcttgacagtttatccccaagactctctcttgggctaaaactgggccgtgttttcttttggtaacattactctaactttaacagtgctcccctgtatattgcgtgatttgtctaatctttattgatgattgcttgcctccattggccattcttcccattgaaatgtttttctctacactggtagcctcgagactccttaggaagcttcccctggccttcggtaaggttataacagatagtcagccttcctggcacaccagttaaagcaggactgggcgttggaaggtttttaaagccagctgctcaaaatacctgcatcccaggcaggtctaaggaggagagatccaaggcaaccacgtcagtaataaggagccatccagccctcaatctctttagtctgggggagcagcccttgacctctgagcccactgctttttgaccttgacctccatacttctgagtgtcagcaagagcgatttgtccaggtttattgtgtgtggacataagccggtgggcttttggctatgccagcacagagagacctcatgagttgagccaatgaacatctgctcatcgtgggataagagttctctgtagttcgtgttttgcctcatgcgagtaaataggggtttatttccatcctttggtttttaggtcaagtggtctttctgggtggtctgggacatgacatgaaaagtgattatttaggattcctcttgtccttctttcaacaatgccgagcccacattaaccagagttctggaaaatgagtctttctactattaggagtgggcaaattcttttcgtaattagttagaccactttaaatagctcaaagaaagacagccactttccctgaaacaactttattcatagacctgagaattctgagaacagctcagaatgtatgattttttttttcatgtcctagatttaggaattggaaatagcgaggctgacagtcagattctagtacagatggaatttttgattcttcatattttatcataagagaaattagaaacttttagaaagaatcgcctaacctaatatctactgcacattcgaggacctcagcattctagctgccctttactatgaatgcaagatatccgtttctaatggattttcaatattgaattgataagatctaggatgaagtataacttgtggccttaaaaaccatttactggttcatatcctatgcggaggataggaagtgagtaatggaagctgccttttactgagcacctacttgatgccagtccctgcatgaggccttctccatatattgtctcctttcatccttaccactgtgcatcaggaaggttatattgtccccatttcacagaaggtaaaaactaagactcagccaggtgcagtgactcacgcctgtaatcccagcactttgggaggccaaggcaggtggactgaggtcaggagtttgagtccagcctggccagcatggcaacacctactaaaaataaaaaaaattagctgggggtggtgatgagcacctgtaatcccagctacccaggaggctgaggcaggagagccgcttgaacccaggaggcggaggttgcagtgagccaagatcatgccattgcactccaccctgggcgacaagaacaaaactccaactcaaaaaaaaaaagtagctgggcatggtggcagacgcctatagtcccagctacttgggaggctgagccaggaaacttgcttgagcccaggcagtggaggttgcagtgagtcgagatcaccccactgcactccagcctgcgcaacagactgagactgtctggaaaaaacaataacaacaacagcaacaacaacaacaactaagacaaagtttatgggacaggactagagaatatgcacattctccacattgctctgtctgtatgtcctcagttcataattgaataagcttttgtttcatggctacagatttgttcttcatagatatattgtactttgtttctgactgctcctggatgcaaagttgatgtgaaaacctgacaggagagatgtaatggagataatgttctgagtttatgctggtgaggtgctggcaaggctggggcttagaaaacagaagtctccagctctctagttccttatctgtggaatgggtatggggatacttgatgggttggtatgagaatactctgattgaattatgaatatacaagtaaattgatttgatgactccttattcagcatcttttagtattgaggctgtggatggcattagatatacagtggtgaataataatagtgctcattttacaaagggcttattatgtaccagagagcgtattaagtgctttccttgcatcatcacttttgatttcaagcacagaaaaaacatgaggtaggtaatattaaccctacatctacttaagatgaagaaactaccgcccagagaggttcagtaacttgccgagatcacgtagtccgtgcacagcagagctgagattgggagccgacaatctacctctaaagcctgtgttttcaccatgacatcctaatgtgtggctccatctactgacacagagggtccctgccctcaggaagctcacagtccagtggggaaaggacagaagcgaagcaaacataaagacaatgcacagctaagtgccatgaaggaaagggacagagtgagatgagagaaacaagcaaggaaaaccacgtgagactggcgaatgcaggaagccctcgctgagggggtgagacccagaaaatgcaggaggcaacaagtagggagcagcatgcctcgccttggcagggggaccaccatgtgtgagcctagacatgggaaaaatctggataccaggggctcaactaaagtagctgctcatcatgagtgcatgtggttattggtaaagaatactttgagcttaaaacgtattcccaatcagttggaagaagaactctgcagctctctctccggatttagtgccttctctattttgttacatatgttcaaatttatgaacatgaaagggattcagcctttgcttgaatgcctataagtggccacatttcacaaatcctctcccttctcccaaatgtgggaaaacagaaggaaggagaagttttgaagttctgcctccagatatttcctcagtggtcttttatggggcttgattccttagaaactgacatgtgttcataaaacatggcattcctctgcatatatatacacacacgtatacatagatacatgacttaacaaaattataactatgagcaaggaagccctcaaaaaagcagttattataaatgctgaaacatgctatgcataaaattaatgaatgttaatttatttgctctgcttttaacagggccacatcatggaaaccaccagaaaagatttcaagaaaaacctttctgctagtacctacccagaccttttgactctggcatagaaggcaatatttaaaaaagaaattatatagataatatatataattttatttatataaatacatatatattttattataaatttataatttcttatatctgtgattttcatatatatgaatcagatctatgattttcatatatatgaatcggatctgtgattttcatatgtatatgaaagatgaaagatcgtatatatatgaaaatcatagatctcctgcccttctgtggtatgtttcacctcctgagacacactgaatattttcctaaaatttaaactaggattatgttcacttttaatttgcatgcctgggtaacaatgtcactaacctttgctactcctttataaatcgaaattaattaaactggagcttgccaatgaaaacacagccttttaaacatagatttctggtctgtagccccgtctaggaaaaaaaaaatctcttttattagaaattgttgatctcacatcaaagcagcaagagaaaaccaaattctctttcatttttaataaaaaggctttctgatctccaagggcacacctgaccgtgccacttgcagtacaggcagcctgtgataagtggcccacagcagtcaaagcctgtgctttcagagttcactgttttttccgaacttgatctgttcagagaggctaatttgttactcagagggaacttgaaatctccctgtgattgccttgatagctggtggtaatatgcatcactgtggtttttaagcttttttaaagacttactttgactatctttaagagaaaggagttttgtattttcttgctttacataaattaagcctcaactttaagtttgcagctagattgtcttctggtctccaaaattctttgatatgtttacagccttgactattaaaaaggatgatggtatcttgccatgccttcttttttgcaggattctatattaaatagtaaaagtcagcctgttagtccaaatgtttcccaaataccctgaatatagtgccttgtgaaaggagaggtcccggggaagtgtaagcatgccctgtgatatctacttgtaagaaatatttcatttcactgaaactatccattactgatttttgcaaatccaataaattgactcccaggctctgaactccttttacagaatgctttggatcctttgccagggtctcagtgaatgcgttctctacttgttcatttcctgctgctttttgaaaagccttctgcctcctttctgccagttgcatctgttcattcctaaatgagtgcagcttccagaaagcagtggccaaggacatctgagcaatgggagggctgtgtgctctcctgctgtgtaacactgaggttgatgcttgtcttatgaagccattccatccctgtagttgtgccaccatatttttcttcggacctttaaccaactgttctgtttttgtgatcatatttttcacttatttgaagtgctgtagtaaatattttttcatagtattccttatgaccctcagtaaaactttgggtttttttcttcctgcaaagaatccctatacagtgcttttgttgtttgatattttatatgcataaatgtgtgtatttgtatgtatgtacatatattaatgtgtacatatatatatatagctattgcaatttgtgactatttaaataaatggtattataatttgttctaaagtttcttaaggtagtccattatgtaatctctaaataatgagaattgtttctctctttcaaatatctcttccttttggccccgtatggtggcttatgcctataatcccagcactttgggagcccaaggtgagtggatcacctgaggtcaggaattttagaccagtctggccaacatagtgaaatcccgtctctaccaaaagtacaaaaattagctgggcatggtgatgcatgcctgtagtcctgagcagctactcaggaggccgaggcaggaggatcacttcaaccagggaggtggaggttgcagtgagccaagactgtgccactgcactccagcctgggcgacagagcgagacttcttctcaaaaaacaaacaaacaaacaaacaaacaaaaaaaactcttccttttattgtgtttttcttgtcatatttcattggctagaacatcctgtgctatcataacttttcatttagacacacatcattgaggtttgagtgaattcatagttagcaattatgtcctagagtagtaattccaattttgtcataaaatataaaaactgcagactgatacaagtaattcatattaggtacaactattgaagaacaaattatgtcatctctaaataatgagaattgtttctctctttcaaatatctcttcgttttggccaggcatggtggcttatgcctataatcccagcactttgggaggccaagagcaaatcttctgtaaagtgaaatattcctccaaaaacaaagaggaaaattattgcagttccatttatcaggtgcttccaagaggtcagataccaggttcagaggtaaaaactcactgtatttgattctcacatcaaatttctgaggtcttaccattgtgccccttttactgccaaggagactaaggcctagaatgtaagtaacttgttagacattgtcatagcatggcgataaatgcagacccttctgaggagcacacagcctgctcactttatagcactagcatgttttgatgcttatggccccaaggtaagttaaaatgtctttcatttttatgtcagtaactggaaagtctaaaagttaaattaaaaagaattccacttgtgaggaagatcatatctggatgtctatctcatgtgtatctccacatttagtgttactgtcgatcaggggccagcatacttctttaaagggccagagagtcaatattttagactttgtgggttatgctgtctctgtcggaactactcagcactactgacgtggcatgaaagcggccgtcgacaagatgaaagtgaatgggtgtggctgtgtttcaataaaacttgatttatggacagtgaaatttgaatttcatataattttcacatgtcataaaatattattatttcaaccactgaaaagcttataagccttacagaaacagcccatgggccagatttggctcacaggctgtagtttgtcaaccctgctcactacactgaagtcttagaactttgacaaaacagagagggagaggtgcatgcaaccactgcttctacaactcgtccttccccatgacaacaggtatttaacaaacatttctgagggcctgctactgcatgacagccccaatttgggcaggaaagatacagagacaaaacaaatgtttttctggaggttttgtagtctacttggagaggcgttgcagggtggaagaggtaaaataataataataagaagaataattacaacgcagtatgcaaaatgctttagacttacagcagagtgtgcagcagccatcgacttcagcaggcatctggtggatgctgggcttctagaatctcaggccctctggaagtgcatctcaatccccctcagtatcttgtagcaggctaagtctttttggagagactcaacaagtttttaggtcgtgtgatggagttcctgattgcacactgctgtgctggaggcaattcagagacctcagagcagcgagcgagcccagcatctttttaatctggcgccatctgcccgcctacccctcccaaatgcacattttgatcctctgaagcttggcaaagctttcctcagctgatctcagctcctcagaatgagagttaatggggaattggagggctgtgcactggccccagtaaagatgtccagagcgtgaagtctttctgcaggctgagcagaggaggggtgctgacggagtggcacgcacaacaacccgtttaacgagtccaccggcaacccagtgctcctgagggaaaacatacattggcagcacttccccgtgcctgtctcctcctttttctcttgctgacacgtctcacttgaattaaatcctgggctctgccatgccaagagtctttggttgtattcctgctggccttttccagctgcctagcttccaagccatgtgcaacacattccttcactagctcctgttcttaaatgtagaggttctccggggctctggcctcagcccactgattttccagtgtttacacgcaccttgagtgatgttatccttgcttgtagttgtattaccatctgggtgctgatggcttttgaatcagtattgccagtgagacctgccccctagcttcaggtttcttcctcaaactacctccccaaggggctcacctcttccttatcaacacctgcttgcccctgctccccctacccctgctttcatttttttctgtgtgtgtgtgcttgtgtgtgtacagacacgcatgtaatgtaggacctgggagtctttcattgtcctcctttttccttttcccgcccctctgctaattgagacccaagtatctggaggccttgattcagggttgggctgtaaagacaacttggattctattcaaagagtcttttactttagttcactcttgttgttgttgttgtcgttgtcacagggtcttgctctgttggctgggcgggaacatgcagtggtgggatctcggctcactgcagccttagcttcccgggctcaagcgttcctcctgcctcagcctccaaagttgctgggaccacaggcacacgccaccacacccagctattttttcatttttaatagagacaaggcctcaccatgttgcccaggctcctcttgaacttctgggatcaaacagccctcccacctcagcctcccaaaagtgctggtattacaggtgtgagccaccacacctggcctagtttactcttgatatagctaattagcagccccaaagatatataggagacaaagcagtttgatatagctctctgttacctctttcttctctaagcagagtgccaggggtgtctttccatatgcaaacctgatgatgtcatctgcctgcttaaaactcttctgtgttcccccctgctttaagggctgacaggtatggatgggatgcaggttttgcagtgcgccacccccaaggaacgccattctcatcatagtctatgtgaataacacctcctacagctgcaggagcattgtacagcctgtactgctgtctatggcagctctggccagtaaggtctagcagtgcttggccttagactcctgtcccaccacatcacatatgaccctctccctggtagataatcccaaggtttctgagtcagtagttctggggtcaggtataaaaatctgccctcctatcacattcccgggtgatgtgatgctactgttctggggaacacactttgagaaccactggcatagccatagcttgacgtaacttgatgttttttctgttacgactctttactcacttagggcttccaggacatgcctggacatgggctgcctaacccaattttgcaaaagctgggggtatctccattttatagaaacaattaatgatcccacttactctttttaaattaatattgaactctccatgaagcccataaacacattccttgtggaagaacttgaaacagtacagattagtctaaagttccttctttctctcatctttgccccagaagttaacactcttgtcagtttggtatatatcgcttttagactctattctgagtttgctggtagaaaatagccttcgtgctggcatttccccctcctcttaccatgaatcacatcatactgaacctcctgttccacagcttgctgtttttcattcagctgtatgctctggcctcctctttacgctggcgtgtatagattttgctcagtctccttgctcttcacagccactctttcccaccctactttctgcccaagggactccatcagccagtgctccctggcttccaggtgggtgtggccagtgggaggagatcagagtgaagtagataagtgaggttggggtctctcccttcgaggtggtctcatgagggctgtggctgtggagggaagtttcctgaactcactgcacctcttccaagcacattctgccctctgcacccactttgcaattagacctgattcatcttaagtacgtcacttgtctcctcagggaacctcactacataggtgctatgggctggatatttgtgctcccacaacattcatgggttgaaaccccatcttcacggtgatggtgttaggacgtggggattgggggaggtgattaggccatgacacctctgccttcatgaatgggattagtgattataaaggaggccccagagaattgcatagtcctttccaccatgtgaagacggaaggcaacatctatgaactgggaagcaggccctcactagacactaaatcttccagtgccttgatcttggagttctcagcctctggaactatgaaaataaatgtctgttgtttataagccacccagactatggtattatgttatagcagcccaagcaaactgagaaagtaggtatacctcagtctttttttttaagttttaaaaaaattattgtggtaaaatataaataacataaaatgtaccaccttaaccatttttaagtgtacaattcagtggcattaagtgcattcatgttattgtacaacctttaccattatccatctcctgaacttttttatcatctcaaaccaaaactgtatctgttaaacgataattacctatttttccttcccccagcccatggcaaccaccattctccttcctgcctcttgaatttgactactctagataccacataggtggtatcatacaggatttgtctttttatgactggctaatttcacttagtgtaaggtcctcaacattcttccatgtcatagcatgtatcagaatttcctttctttttaaggctaaataatatggcattgtatatcacattttgtttatccattcatccactaaatgaacacttgggttgcttctaccttttggctattgtgaataacaccactatgaatgtgggcatccaaatatctcttcaagaccctgctttccattcttttgggtatatacccacaagtggagttgctgaatcatatggtaattctatttttaattttttgaggatggccatactcttttcatctccagttatgtgtattctttgctttgacctgaaagacataacagttataattgccctatctgtatggtatcccacatcaaagaaacttattttagtcgtgcatgtgaggtcagctgtttttgtcttaaccatttataattttgatgctggaaaatattttggtgcacaaaacatattaccaaagtattatacattacagaaactctacatcgtcttgcttgtgaaatgtgaagccattttcaaagcagatgtgtaaattacagatatggattcaattatatggcatactgaatattttgattgccattgctatagattctacaaatatcctgtagtttcctccctgccattttgagaatattctcttgtgtacatttcattcagccttttaaagaatctcttagcatcctttggggcctaagcctcgctgtgacgttaactttgagggcttttgtttacctagtatctgttcttctataagtaaattttaggtgccaaagagctctcgataattatgcaatgttttgttgagagctctttcacatagaaacatgaccagcatagcttttttcacatagaaagaagacctgtttggaaaatccttggcaaactaggattataaatttaaaagaaactgtgatttgttctgaattgtattataacttgccaaaagttagtcacacatataaattatacaggttaactaagttagccaaagtcacagggctaggaaatggaggatccagaatttaaatgtggatctttccactgtatcacctttctatccttccacatgtggccacctgtgatagggtaaacgcacacacacacctcctttcagatgtttggactgtttcaacatgccccagatgggaagtgaaataagcactttgtattctccctttcgtgatggaatttgggttactgggattgaggaggggccaccaaaacttcagcatggctgtgataaccgagcacagcaacttgtcctcattttccattgtgtgtagtgtttgctttgacccgaaaggctcctcatagcccattccataggcacatgagcacagccagcaccagaccaagaccataaatggatctgtagaaggtttgggcaggtgtccaggactccgtgtcctgtaacaagtgtaaacgttttctggagtgtttgttttaaatgtcagaacttgaggataattttggccagggttgtttttacatttttcatggatgcctatttataggtctgaatctaaatctattttttatccagcctacccagaaaccataaagaaaaagattggtcatttgactatataaaaatttaaaacttatgtatggcaaaaaacataacaaactagcaagaggagatgaagggctaattttctcctttcttaacgtgtttctacatgtcaaggaaaaagacacactacccaatagaaaagcaagataagaatataatcaatagacatgtgaaaaggtactcaacttcattcataattaagaaaatacacaaccaaatgatgttggcagagatgtaacagttggataataggcaacattgatgggtgtgttgacataagcactcataaactgttggtgagagtttacattggtgcagcttttggcaatatctattaaaattaaaatgttcattctgtctggcttataaattccataatctatactgtggatgtaatcacaaaagagtgtgccaagatatgtatgtatacaggcacacatacatgcacacaagaatgctacttgtaacattatgcaatggaaacccaccacaacaatatatcccttcctcccaaattagaaacaagataaatgttaaataacaatacatctatacggcaggaagccctattaaaaagaatgaagtagagctccaaacgctcagttagacagatctacaaactttgtggcaagcatttatagaagttatttcttaaaatgagatctctatactggtatatgcttttatctgaaaggatacattaaaaatgagcagtagttaaactttggggactgttgttttaggtatgtgcataggcctggtttgtcctgcttttattttgtactttttaaaaggacttttcacccatgcattatttacttaaattaaaatttgattgaaatccatgtgaaaatggttctaacagttatagataactaaatttagctttaagtcttgatttcctctctgcaatataattgtccagagctatgcttttggaaaggaaaaaatggagctgagagctgatttccagagtatgatctagatatatcctgggctctgcttttctgtggaaatcgatctttaaaaaatattgggtggagttaaatttgaaatagagattctgtaacgggtggatgaggtcatttccttataggaactttttggagttgggagagaagcacatttatttctaggtgtttaagaagggctgattgggccgggcgtggtggctcacgcctgtaatcccagcactttgggaggccgaggcaggcagatcacgaggtcaggagatcgagaccatcctggctaacatggtgaaaccccatctctattaaaaatacaaaaaaattagctgggcatggtagcgggtgcctgtagtcccagctacttcggaggctgaggcaggagaatggtgtaaacctgggaggcggagcttgcagtgagccgagatcgcgccactgcattccagcctgggtgagagcaagactccatctcaaaaaaaaaaaaaaaaaaaaaagggctgattgttggtggaaaaggaggctctcacccaattacctagtcagaaaaggacacctaggcttttgtgtccttggagtcctttgtttctataccaccaatgaatctgtaggggtaaagtactggggtggagtggttattcatgttagaaaacagtatagggggattttgttttacaatcaggtatgctagatttagatgtggcttccatcgctttctcactttgtaatctagctgagtttgtttactcgtctgtaaaatgggtttatagataatatctccggtacagaattgttaagtgctaaatgagattatgcaggtgaaatgcttgtctttgtaccgggaacatagcctttgtatctgccattattgttggactacaactgtacaattttagctcaagattgtgttcatttctgccaggatgaaaccagcaagcttagttcattgcttggaattctgatagttaattgggttatagaaccagcactggtcaaccaggaaagccaagtcagaagatcagccctcaaccgttggctaggtgcctgatgagaagtgcaaaatatagaagattcagaccaattggttgaaatttcttacatcatatatactggaaatgtaggaatttaagtatatttgtgtattcatggcccttaaagcccaaatcaagaccagaaaagttgcctagataagatgtgagtaaaccctaagtatcactctccttcctcgacccagtcttccagcccagcccttttatcattaacttttctcaaccaaaatcttgatagaactgtattttattgttacacacatgcacagattacacattatagtccatttgcgtaattcatccatctgcctcagacctgccttaaccctgaagagtagtttagggtcatctcacatgtttaacagcatcaattccaacttgaactaagtagaataaacagatcccagacctcctaccttagagacccagcttttcaatcttttttctatcttcctttcaacatgatcaaagcagcattccctaatcctgaagacaacacaagtacttctaagtatcctttgtttgtcttgcttatcccaaccaagggtaattttacatttgcattactaatcaccttcctaaaatgcattgttcctaaaattagattaaatgtctctaaatggttttattttgtttgacagtggcagcctgacccttaaatatcctatctgtgaatgtaccaactagaaggacatagaaaccttgtatatagaaacaaataagattcttctattttgtcatctctgaagtataatttcatcaatgcacttaaattttgtgggtgtctcttttcgggtgcaataaaaattcatccaagaacaacaaactaagctattaccaattaccattcaactgtgggtcagaatattttagtctagtgggagagtaatatttctttggttggttcagtaaaggttcaaaagtctgagaaaattgaatgagctttatgcttaggtcttagttctggacctccatgttaaattcttggtttgaggcagggaaagatgaaaacttacttgcagtgtagttagtgtagagagagaaaacagtggctgtagttaggaacaagtgaatgttaacaagtttgcttctcaggggcattggttaaacaacttcttaactggccagggtccagcacgttaatcattaacctagggctgagcatctgctgcctgatgtatccagaattagtttatcattacctctaacgaccatcttttatggttccgaagagcctctatgcagtctcttatcaccgccatgcctaatcttcatttaccgggagcagtgtgctgatgtttcttagttagaccagagtaagaagtttatggtcagttgatgaatttttaattataactgtttaaaaagaagacgatgactatgaacagcagctcactcgtagcaatctttggacagtacttcgaagtgacccactttcccatttaactcttgggaagcctgggttgccctgttttcgactttggaggtccgtgggctagattcagagtgccctggcaggctggcttgggtttgaggctgtggctgcagcctccgcaacaccctatctcagcacctgggaactggcccttggtacccgattctttcttctttgtgtgtgtgtgtaaatcattttcattttttctaatgatcaaagtatacattaaaataaatgaaagcaatacaagtccatgtgtatggtagaaaatctggacaatactaaaaatgtacagaaatggcttttaaagattaattttcaacctataaactaagctacttttcattttagtgtctttttaaaaacagcttttaaaaacattttaaagggctcatcatgttcaagaatgagggaatgtttggctacaaggccttcagtatgactctatcctatagctggaggtttaataatcaattatattaaagcttttctaagcctccagaagggtttgtctgggtcttatttactataacaggcaagttaaagaaacttgagtttaatttatatttcagttcactttttttagacaacaagtgcaatttgggctttatttatggaaggagagagttgtccttctccccggaaaaaaaaaagaaaaaaaacaactaaaattcccatatgacgctattaaatgcctgccattgggttttatgtttccaggatattgtccacataaatatatgcaatgttaaaagaatgtggatgcctagtagcgtgtacgttttagccttctgaaccaagggtttatgaaactggttgaagagtgttttattgaaacaagacaaatatttatgaacaatttagaatcatctgttttgaaatgtaaagtgcgttcctagtggtgcacagagttccaggtgtttcctgtctgaatttggaacggttcgctgctgtgatgggcttacaaagttgtgctctcctagcttttaatcagaactgaagaatcacgcagcttccctgctaatgccagagcaactgaaagcactcacaggaacacacttgattaaatgagtagaaagccttcttgagacacctaggtgtgtgtatgctgagctgttacatttgtcatggaattaacaacaataacaaacttgcttaccaaaggagcgcgttaacttctgcaagtgtataagtgtataggctctgctgcttaaacacattcgtaccaatcagaagtttactttctggtctctctggcttctgtgttgtcaccatccctggtttctgtgaaatggaaatattgtgtattcgcccagacggttggaagccgttcatgtaaatatgggccgttgtgatttaactgtcagcctgaaaggccctacttccaagggctccttttaaaccaagcacaatgaggtgtctgttttagatgcggccgccagtccttggttgcaaatacatggatttgttagccgtttgccagcagaactgctttttacaacatgccccgctttgtctgctggcgtggtggacggtactttagggcagtgagaaatgctgccattatctgcctccatccccagatctgttcccctcattggctccgggttgggattgtagggggaggcgtgcagcaaatcatcttctctaggagcagtcagaaaataagaagggaaaagcttgccccacaaagaatgtccaaatgcacaagcaaaaccacatgtgaaatcccaccacgttcaccccctggaaacccagctctagaggatgcagacggggggcccagccgacacccagggctggagtagaggcgttttataaaggatgatcttttttctagcatggacaacaaagggctaagagagtcgtcccgcttcctgcttgggcctttctgtttttgggttggcgggagccttcttcagtagacttcactttccctgatggtgagagtgtcagagaccacgatgggttacaggcttgcttaattgttttttactgggggtaagagaggggtgaaaaatagagaaaagcatgaaagagaaatgaagtcaccatatttctgccataaaaaagtagccactggtaacattttgccgcctctgccttcagtgttttgttttctccctttgtatatgttaaaagcgatatctgaatatttttccttcatattttcatgtcagaactgtagagtatttcagtggtccccccagccacggtttctctgtccaaggtttcagctgcttgtggtcaaccatggtctgaaaatagatgagtatagtacctatcataaggtattttgagaaagagaccacatgcatatataacttttattacagtatattgttttaattggtctattttattgttaatctcttactgtgcctgatctataaattaaactttatcatatgtatttatgtatagggaaaaaatgtttgtagggttaggtaccatctgtggtttcaggcatgcatttgggccctgggcaatatatccctagaggataagggggagatgactatgcatatataattaaagctgtccttggatctacctccttgactccaagctccaaaccagcctcctccccactgcaggagtcgatctctatgaatgttatgttttctttccttctgtattttgtgcttatgtggtcttttaaatttccttctgactcaggcctcttcactggcatagagcacatgctttatttattcccctataactggatatttagactgcagcttttttgcttttccaagcaatggtgctgcgagccttcatagacctttttccttgtgcgtgtatatgtgctagtgtttcttctcgggtagagatctagaaatggagccaccagtttccaggcaagaccagacgtaaaaggttgtacataaggagcactagttttacatacccatgaactatatttattacggtcgtgcttgagttctggctgaagaattacgtgacacaaaaatggacagagttagctacaggaggcagaaagcgtgcagtagggatcctgttgaatcctcaagctaagtagtttaccaagctggttgcaaatctatttggtattttcctgattatcaaaatacttgccactgataggaaacatttgtttgagggcctctcctcctccacccccaacctccagtgtacgacagatgaatcagtcatggtagaagaaacaaatggctttctgttgttactgcttctttaaagataatccgttgttttcaaaacatttgcaacgattgctttcaaggaaagggtggctggaggcctcagcccctgatttccccaggtggaaacatttgcagtgggttttcagggaagtcacagagaagagccgcccgcccgtgccaggattcaaggcaggaagttgtctgtttggtatttactcaggcgtctttgggcaagaattgattattcaatcagagttgaaagttactgctaggagttgcttaggcagtaagagaagaggctgttttccttggaaaggcctaaaagcctgaatctccaatttaaaattaaattttgctgtgactttcctgcaggatctcaggtgagagatacttcttgccctccaagactgaaagcctagtttgtcagtacgttagttgagtactgagggaacgcccctttgagccatagcactgggagatccagaagggacatgagccaccatctctttcaatgaccttgtttttatagaagaggaaactgagccaggggagatgaaatgatcagcctagtgcccacatgttggagaaattacaggacaaacagacagaggtccaatttctgcacctaaagggctgagaccgcatgggtctgcgtcctcctgggtccgccctttcctgtgcctgttgcatggtagatgcttagtgagcgtgttgccctgagaccatcccatctccagatggctggtttccaatgtgattatgagggcaaagtcacttcctcacggggggcttggaaagtaaaaaaggaaaagtcaaaacacataagaaatggaaataacagagtaagcctgtgtgttttaaaaactactatttatatcttgcctccttccacaaaggatttaaggcagcttaggagagttaaacaccaacaccagagccctcactacacagtaagtaactaattgccacgtgaggcttacagataaatgctgagagcctgggtgggggaaattgtctttgctgctgcagagacgttttaggcctgtctggataaaccataggcataatatataaatagaacctcaaagggacactaggggctctgttgccagaggtttatttttcttttttggtttttgtatgagagggccttggttatggctagggaagtggacaggggagagaaaaaatatttattttccaatgtatcaattttgtgtgccataccctgccttttcacatatctctttcagaaagttctccacgtttacatttctggagaagttaaaatgaaagaccctgtttacatttatagttaaaattaaaaacaggatttacctgggagctaataccctccagtgacttaaggttggaaattaaggcttcctggcttatctttcttaaggatagaaaactgttcactcctaaatcgccccctagtggtcccttaagtcactgatagtctcctgcccgaggagctgcacggcaggtcccagttggaggcaccatcatctgttgcattgctccaaggtgaaattggccatcacgatgacagaattctgcaaggagaaacttcggttgacttttcttctttcactcccagggttttcctttatgtcttcactgctgtttccagatttctgaagaacagtgcaggactgagtttatgcacgaagctctgaggaccaaaggtggagggaggtcttccttgaaaattactttgctgaggccttgctccttgttcaaggcaacactatgggaggggttgtatggtggtggctgctgctcagcaagggtgtccagcatgtgccggggaagagaggttttttgaagtacatttctagtcgatagccaagcctattgtgaagagtgggaacagggctggtaatagctgcatctcttttttttttgagaccgtctcagtcacccaggctggagtgcaatggcacaatctcggctcattgcaaccttcacctcctgagttcaagccattctcatgtgcctcagcctcccaagtagctgggtttacaggcacgtgccaccatgcctggctaatttttgtatttttagtagaaacggggttttaccatgttggccaggctggtctggaactcctggcctcaaatgatcgcccacctcgtcctcccaaagtgctgggattacaggcgtgagccactgcgcccggccagctgcatctcagaatttttgttagcgagtctgacttacaattgccaatacctgagagttcctttagtatgcagttttagatctccactaaggcttcatttaaatacatcttttctttgccaagtgttcagctgccagtagtgatttctcatatggctgattctaattagacctgacattgtcaaactccataacttctccaagttacagaagtgatacagtttcatttctaaaagcactggaaagctcagagtgagaagtaacctgtcatctcacaatacagaaaaatacctatgccttacgtgtgcttcatgagggggtggtagaaaatgagaatgaaatggccgggcacggtggctcacgcctgtaatcccagcactttgggaggccaaggcgggcggatcacctgaggtcaggagttgagaccagcctggccaacatggtgaaaccccatctctactaaaaatacaaaaattatccaggcatatggtggcaggtgcctgtaatcccagctactcgggaggctgagggaggagaatcacttgaactcgggaagcagaggttgctgtgaactgagatctcaccattgcactccagcttgggggacaagagcgagacttcgtctcaaaaaaaaaaatgagaatgaaatctatgcttatatgtgtgcataaatgtttttaaaaagagatcattttctgagtgtattgttgcctacttttactttgcagtgttccacaaacaatattttgtcattaggtagtttttcagcctcagggcttttaatggctatgtagtattcaacctatgcctgtgctggctgtgatgcaatttacctcacctattactatggttatttttaccattaaaaacaatgctgggttgaagttttttttgtttttttgttttttttttttttgagacatggtcacctgggctgctggagtacagtggcacagtcatagctgattgcatcctcaacctgggctcaagccatcctcctgcgtcaacctccctaagtactggggttacaggcatgagccaccgtgcctgaagataattatatgtaaatccttccattaacttatgttttccttaagaaaaatttctagaattggaatatttgtgtcatcattttagatatctctccagaaaagttgtgactattgctttcccacagatcatattcgagtaagtcttttccctgccccttccataatacagggttattttcaactttggccatgttgttgagtaaaaagtggcactagattatttgagtagctgattgttatctagttggattgaattttattttctttttcattagccaattgtatttcttctttggtgcagttgcttatgttccctgttactgggctgggctgtttatcttttttcttattgatgtagaaaagctttatttgtattaaagatgtcaaccttttcatctttgttgtacacatttattccctgaatatggtttgccttttcctgagactgggagatgccaatcattaattatatgatcagaaaactgttatcctgcccaggcccgacttcagaaacggacgttgcaagatcaacctgaccagccctggggcctgtgctctctcagccctgaggtaccacctgcaccctgttattctgcttatgttgatattcagacttgaaattgttctgaggatatcttgtgtattttatctcagtgcagagataatgagtttcacatggatggaggggatcacagtggacaccatttcctttattttttttctacctgctctctacctgcccgtacctgagttccatggtttgtggctgtgttgattcatgggagtcttaggggggatacttgtcatatttaaatgagttcacttgaccatccaaaagatggttgagtgcctcctctgtgcttattacagagggattggttggaaagtcggttgggggtctctaatccagcgcaattttattttttgcctcaaatttttaaatagagcttatttttcctcacactgactttatgtgctgtttttttttaaaaaaacaagaggacatatcaaatcacctataaactgatgcagtttgaatatgtgtgctcttctgatacccagtaagtttctgatgatgaaaataaatgacctttaataaacaagttacttagtaatatgtatattaaacaaatagtaattcgtattgtaaggttccaagcttcgaaggcttgacaaattcaatagaatatcatccacaaggtagacaatttgaaaaatcctgattttctgataggtctactggtttgttaaataaaatgttttttttaatttgaataaccaattgatgttttgcaatttttgtttgggagaggtatttttgcattattatttctacccagtgtatttgtagtctgattctgctaaaacaataacaaaaatcttgatggagtaaagatagttgggtgaattaaattctatgacttttaattctgtgccttgaatcctgaagcaaagtctatctttaaggactggggttttctcaaagggctcaatcagagggtaatttcatatcagaagtgctcccaaatgattattcgtgggtaaccagttacataaaatgtcatcgtgtataaaagtatagtttagttcttaattaaaaagcaaaatctttgccttcagcttcgtaatctcatactctcaaattccaagccacctcccatgggtgtcacactatcttagactaggaacgggatttggctataaataaaaaactagatagaatatcatttccaaagagccaagggcacttgctggagttgctacagagactatccttttcctatcacaagcacattcatatgaaaacattgttgttttgctttttccatacttacttggagagaatttcccaggaagcctttttgtgtatttccccacaggtcaatcaattatgttgttaattaatataatgaaaaattagatcatatacatgcacttaaatgatactaacgcagttatctttatatatacaagctagtgacttatgtgggtataagacctccttaataaaaagtggtatactttggagatgggaaagtggcttgtggttgcagggaggtgttaagtcacagcattatttcacttcttgaaaatgaagccctcagaaaatggagtcattacaaaatatgtcagatctgtaatcaccaaccaaatgatttgtcagaagcagcccaggttaataatggctgtccaagaaagagtgttcagatgcatgtcagggccgaattgagtccactggtgtggctgagatgaggagtccagaaaaataacattctctgtttggaaccaggaaggttgtcatggagatgaaaatcttcctggtcccataaaaaccctgcttgtcatctgacttgagccccgtatttgcacaggtggttctcctgagaagggctgagtaaaaacaaatctattcttcctgaatggcgcctttatgtgtccaagagaatatgtttcctttcttcagtccctcaattaatgacccattatcagctaattaaatcatgtaaattttatgtgagttcatttgttacaccacatgctaactaagtctattcctgtgtgtttaaccatataactgttttaattgtgagaatgaggtacatcaggtgggcatctggagagaataataaagtactcaagaaaagcagacacacatacacagcagtgtaatattaatttctgtttataaagaaggcagaaatatgaataagtgaatgtctagcacatgccctgtgacttcgggatactgtgttcaactctattctctacagaaaaggagtcacatggctgggtttctgtttcgctgagttacgtttcagatgcagaagtcgactgcatgatacaaaaacacatctgtttaggctctccccctccccactcttgctttctttcctatgtgtcagagagcagaacttgatctttgtatacattttgtataaaagccttaattctaggtttaatttcagtttgtgatacctttctgccccaaaaaagttcaaagcttttaccaagtttctcaaggcacgttcatggttgcactgagagagttgagttcagacacaataaatgctgtgttacatttttggaaacgtacttgtattgtcatttaagaccttgcaaagtacatagggaaaagcattagatgatgtcctctatagtcaaaaactaccaaacaaagcaaaagaagaattttttattgttcattggataaggccaagtagacagcaatgggaataatactttcattaaagctttacggataaagaaatgatttaaagtgaagaaatcatactttttttgaagcctggtatttaaagaatgaaatcatacttccttgaggtttaaaaatattcatgtgtaatgctagactttggttatgcattcccagatgtttaacgcactcatcatttgtaaatggaacttacgtcagatttatgacctcagaatcttcaagtaaataaaggaccacttatacatttgcttgtaaaggtagcacctaatagagaaaatttgagggaaccattaaaacaagtataggtttagcttataaaggaaacactagtatctaaaactagtttaatttcttttaaatggactgggttaccaaagtacttcatgacattttatgttagtaaaatgttaaaatttttaagttaaaatcaagaaagcattgagataaaattgttttattcaaaacaacaaaactactatccatgatagtataatattctctgaccaacagtattcatatacacagccccagaagtgcaaaaccacaactgtgttttcacacctgtctcttgcaaattcttacttaacagatcaaaatgaccatcttgtagaaagtattttgtgtaagacactgtcacctgtgagccagcaggtggtgctctggtaccacgtcttgatcattcgtttcaactgagagaggagggctgcagtctcaatgataccaggctctaggattttctgtaagatgccacacagctgatctttagaaatacctggcctctgggggatttgctttccatctgaccatttaacatccttgaccgagctgccttctctatagctgtactgttgaaatttgtcatttcttacagctgcctggtttcatgagctgccagtctcagaacatagcataccataaaataggaattctgaccacgcagccttatgggtaaggcaagggagggagttgaagggaaaccgctatagtaaaagaaaactcagaaagataaatgttaaatagaatcaatggatattggagaagataattttagttgttggtggccttaacttatggagaactcagtatcttttctcagctccacctaacagttcccatcttttaggaaagcaattatttagatgccagagaacaccattatggaaatggaatctttttaaaataaaaacctatcattttgactgcaaccaagttatagttttgactgaatgcataattattaccccaaacaaaaggttttatacctgattccatgccatgattcttcattgtgaccctttacttgattctccatcatgagcaaccaaatcaagatgcacatgtgtaagtagtgccttatttttttctcacttagcccactgttgtttctctttgcttaatagcacagctctaagaaaacggttgcatttggtctacaagctagcagcaattcaaggagcttcattttctaatgacttgttttattttattttatttcatttcatttatttattttgatactgaatctggttctgtcacccaggctggagtgcagtgatgcgatctcagctcactgcatctccgcctcccaggttcaagcgattctcctgcctcagcctcctgagtagctgggattacaggtgtgtaccaacatacccggctaattttttgtatttttagcagagatggggtttcaccatgttggccaggctgttcttgaactcctgacctcaagtgatctgcccgcctcagcctctgaaagtgctgggattacaggtatgagccaccacacctggccttctaatgacttgttttagaatgtggatgtcaatgtcacccaccttattctcaccaaatatggagctagagagccaagtttaacgaggttttcctttgacaccctgagagcctcgcgttgcatccacttctttccaacattattatttatgctttttacatagtaggcacacagcaggtatttgttgaatgagccattgctagattagaagtgggaaagactgacagtcgaatcgttaggagtcgtctgcagtcgtcaaggtgagtgatgacagtggcctgtatagggaaagggggaagctggagatgggatggatgtgccctgttggagagacagattccacagaatctatgagcaaactccaggaacatgttaaaagtagatgagatcctgaatggagggcatcacctccaaagcccgtgtcccagttgacagtggaaaggactcagagagatgcctctagctcaggtgaggagtggatgtgattttaagccaaggtggaaaacaagtggggaaactggttctgctgttaagagcccaacagctgtggctatgtgtttggattttgcgactcgaatcaggttcattaattatggccaaatgttagcaagagtttataatgataagctgtgcaaagagtttcaaaaattacaagtatttctgaattgcttacacggacattggtagggaaagagaagagaagatggaaaacaaggaatatacgacaccatgcttgcccttgagaattttagagtctgtcatgggagaccagacttgcacgtaggaggcaaaacaccaagtaagaaaaaaaaagaaatgatatagctcaacatgagcagaagagttggtggatagattcacataggcagcagtggatcagttaggctgtgtgaagaaatgaaagccttaagattgaaggctttggagagaaaaagaggtttctttagaaggcattggtgtggtggacagaggtagaaatgacctggaataaatttttaggtggtttaaaggggtgacccagcttgggaggaggcgagaactggcaggtgggctaggctaggttagtaagatgccaacataaaaagatgaggagctttacccttaatccactctagaacaagaaggcattgttgggaggaaaagagcatgttaaggctgtgttttaagaggattattctggcaacaacacttatatagagtggagccatggtgattagcattcagcagtcctggcaactcagctcagaaatattcagggcccaaagtgaaatgtggcagagctcatgtggaaatggggttggagaggggagtatcagaaagcattttaaaaggccaagttcaatcttagtgacagattaaaaaaataataataaataataaggacagccaggcacagtggctcatgcctataatcccagcactttaggaggctgaggttggagaattgcttgagcccaggagttccataccagcctgggcaatatagtgagacccagtctgtacaaaaaatttaaaaattagccagctgtggtggcatatgcctgtagtcccagctacttgggaggcggaggatcacttgaacccatgagatcaaggctgcggttagccatgatcacgccattgcattctatccagggtgacatagtgtgaccctgtctagaaggtgggggaaaaaaagcaagggctttctttgtaacccccattcctgtggtgatggggttttccaaataatgaaagaaatcctcaacactaaatagcaataacaaccacaacaataatattagctaatatccaccaggctttctgtgtggccagctgtggtctaggctctgtatgttgactcatttcatcatcacaataatgtagaggtaggtactttcattatcatcatttactataggcaaggaagttatgtcatggagagattatgtaacttgccaagaaaatacgactaggaggtgggaaacccaggtatgagccagggaagcttccccagatccccttactgctttttgtaatctaacagaagacccaaccaccaccaccacctcaggctttgggcattttagaggatgtcatttagatgccacaatattaaaatttcatcgatttcttatctagcgattgactagaatagtttcagaattaggatcattccagaaaatccagaacttgtggttgttaatatctagagcatccaccctggagccttacacgaatagtagcagatgcctcagatatgttttaggtggtgagttggtgtaaggactcgagacagagatgactgtgagtcaggtctgagagcctgggaggggagcggctcatggctcagcctacatgtgtgaaaaccacagcgtgtggccatgtgagttaccagcgtcacctggggccagcctgggcctcgtaggtttataatttggtcatggatgctccctaatcacactatacggattacaaatgaaaactccatgagatcaggactcgccggtcttcactgatgtttgtaaccagtgcccagagcaatgcctggcacctggcatttgctgaaggggacaaggaaagaggcatgctgttggcaggtggtaagggatccaggacactcagcagagtgattacggagcataagaaccagccgtgtggttgtttatccctttcgtgcggtgtcaccggccactgggaatctcctggttaaacctcgtctctcaggcaggaacagagcctggtttctgcctatgctgggaccctgctaccccagcttgtatctcagaagacaagcagcaagcctgaccagcgacccgcacagccagcatctgggtctatgctgtgtgtattgtaaaaagttaacatacgggccaggcacgatgactcacacctgtaatcccaggactttgggaggctgaggcaggtggatcacgaagtcaggagttcgagaaccagcctaaccaacatgtgaaaccccgtctctactaaatatacaaaaattagccaggcgcggtggcgtgtgcctgtaatctcagctactcaggaggctggggcaggagaatcgcttgaacccaggaggcgtaggttgcagtgagccgagattgtgtcattgcactccagcctgggcaacagagctagactccatctcaaaaaaaaaaaaaagttatgaatcactgtgggcttggagcatctccccctttctcctgctagcacaaaaaggtagcgttaggttatagggaatagcaattaattcattgtttttgatgttgcagttagggaaaaagtactcgaccatttttcaaatgcctaggtggtgttgtttaactctggtgaaagcagtgcttagagtcctgtgttctcttttgatactggagccagcggtagtttggtacatactaccaactgtcccccaacactaaccactgaatgtctacttatcccagctgggaaggccaggagcttttcaggttagtcgggatacacataaagtcactgtggatggacttgatagatagaaactcaagtcaggaggatggagaaaatgggatgggtctgggaagtattttcaagtggagtgacagggattgatgacttactatgtctggaaagtgagggagggagaaagatgatttttgtatctctacatgacagaggcagataaccaggatttgtggccttaccttctctggcggaacttcagatataacagatctctgcctagaggagaggaaggagttagaaccagcaagctcaactgttgttacctcagcatcttcccagaccctaccaccctttcaggtctctcttcaattatcagcatactatacctaaagtgcttctcccttgggcagtggtggggggttcttgtgggtgtgggcccagaggttcgagtcgtgcccctgttacgtccccatcactgcgctgagctgttggcgggggcggggacggggggcgctgtgccggccctaaatgagttttctttcctcccttatatccctagatatatatggagacaaatctgttgctgtgtgctgtccctgttgtaaaaccatttgaggtatatttgaaacaagattaacacgttgataactgtttaagctgggtgatgggtacgtagagtttcaggacgctgtcctctacttttatatacgtttggaattttccagaataaaaaaaattttacaatggcaataatcacctttaattcttgagcctttctgtactttgagttttcttaaatcaggatgcacctctaatatcagcagtgataatgaatcatttgctttataatagtagctgatattccagctcttttgattagtaaaaaagttaaaaaaatttttttaaagtagctgaattcacaaaaatctgatcatttggcttaaagatgagttttcatggctttcttcattattgataaatacaccaagaaaagcaggaccaaaatcccacagaagctgtttccacatttacctaagtctccctgtaaaatgcatgtgtgttactgctctccaaatgtacatttttttttctgttctgagtgtaaaaagcagacagaacagggaagcaaatgttcctgaatggccacatttaaattaatcatatgctgtcttaaagaaagcaaaataaacaagctccaaaccgaaatactctgtagtatttacccaattatttttaagcatagaaaataaggcccaaagtgtgtattagtcacattttaacatcagagtcaccatataatttagttcatttgttaaccacatcagcacacgtgcgaatctcaaaaccctgccatttgctgtgcccatacgttaatgattctgctgaagacaaggccaaatacaggacgggagaggaagaaactgtgtcctcagttagcttccttgaatataattagtaatggtcagcgagctattgattacatagtaaaacttacaattgtttgctaatttgagggatggattggccacctggtaaagctttaagtaaaatattttttaaataatgtggggttttcttgggtttgtatctttttaatttttttaccttttttattactaactataaaaggactttttgtgtgttgaaatttgaatatggatggatgttagatgaaattaaagaattgctaattgtgttatgtgatattagcattgtagttataattttgtttttttttaagtcctctttacttagaaatacgttataaattatttctgtgtgaaatgacatggtctctgggatttgcttttaaaaaaaacacccaggaaataaaaagaatggcgagttgacatatgaaacaagaatggcaaaatgttgattaatcattcaaattgtgttgggtacatgagagtttattaagttagttctctatgttcgtatatatttgaaaatttccataataaagtgttaataaggaatcaaaggaaagataaacataaaaatcagaatatttacctctccgaagaaaaagaatgaggtaattggattgtaaccctcaataggcatcaacaacttggaaaatgttcttaagttaaatgatgggtacagggtattttttattctttgtactgtatataccgtgtgtgcattattttgtatgtatcatacatttcactttaaaaataaatgaagtccatcaatatggagcagttttttttttcaagtgcatatcttgacttgagacttagtctttcaggctgtactttgatgaacagataatccttataattaacacatcaattaagaacagatatatggtgctgaaaatcttggcaggggggatggggatagggggaagggtagggaattagatcaagtaaaaaatcgatgttgagtaccagctatggtttctatcttaattaggcaaccttccttaaagatatagcagttcttgaaaagcaagaagagtgatctgatccttaaaaagtggagaaaaataaacaactttcatttacataaactttctttggcactgcatttttgctattgccaatatcataaaagtctgccttgtgttttataacactggaaacgtgagcataaatcagtcctagagaagttctagccttatgtgtgtaaagaggcttatgcctcgatgttcattgcagcattgtttgtaatagggaaaaagacaatcagaaacatcctaagtgtccatcaatagcagaataattaaataaagtatagaattaaaaataataagacaaatatatgcgcacggataagaaaggtctctaagacatgctgtccagaggaaaaaaagttacaaaataatacatgatgtttgatggcatttatgggaagatgcatatacatgaatcaatataaatctgtaagtgaaaagatctgtgagggcataccccaggtagatgtcagtggtttctccttggaagaggagatgaccaaaaggaattttagctatattaagcatgttctaatttttttttacaagcaaaatatatttgtttcttacttccataattaaaaattcttttaaaaagcaaaccacttgctgaaagaatcttgctatcgaaagaagcttttcaataaatgattttgtaaaatgattgtttttcagggtaaagtgattgttacattttgtaaagtgattgttacatgggcatattgcgtgatgctgaggtttggggtatgcttgatcccgtcacccacatagtgagtaataccccataggcagttttccagcatttgcattcctctgtcccccctctagtagtccccagtgtctgctgttgccatgtttatgtccacgagtacccaatgtttagctcccacttacaagtgagaatatgcattatttggttttctgttcccttgtaacactatctcttcaagttacatgttttctcgattgggtgttggaaaagtaagctatatcttctatactgtggaaagttaaggaaccagaaatcatgtttttcattctctaaaaaattatgtgtgctctttagatattatcttttgatactgagactacataagtgtccttcaaataatgcagaagaaaaagatcataggcaggcaaaaattacttaataaattaagctttttaaagaagtgaaagaattatatccagaaccaacagctcttaaatattctatttcaataaaaacaatttatatacaattgcggtgaaacttatttttggcaaatactcttccgtaagttatgaacatttctcttgataaattttatactaggtatataagttcctttattggtgttttggatgacagcaaatgactttccataaggcagatgtagattttattcacacaacttttcaggagtagctttatgtaaatatgttaggactgtccttccttgagctttacagttaaccaatgaaagtgagttattttagggaatggttagatttggacatggaccaaaattagttttctaatgagtggtgttaaagatgtgtaactactattacagagataatgtaaatggccttctacttcttaattctctgattctgatcttgttttgtagtaagaaaggctcagtatgaatttgaggtacttaactaacttgttacagtggtggtcagtgaagaaagattctatcgggcaggactctctggaatgcatgtgtcagaagcccagcccaaattggcctcagcagaaaacaaaacatagcgaaaagcaaatgacaattcattggctaaagcaatggaaaaatacaaggatatctagcttgagactcagctagagccaaatattcaaatctggtcatccaacgttgattggtctctttcaatttacttagctgtgctaaacactgttggcttggttttggggcacgttcttctcaaacatggtgaaagtggcccctagcaccgccaagattgatcctgtcacagcccagcaatcccagtggttgcttaaaagcaagtccttttcttgataattctagcaaaaatcatagggaggtcacccattggcccagtttagggcatgtgccatcccttaaccaatcagcaatctgactagccaggcctgaggcacctcttcatcactaaaactagtcgtgatagaatcaacttaagtggaaccctgttgagagaaggagaggagggatggctgccctagtggaaatgagctattaccaagagtggatgagggcgggcagaaacaagaggtgcacattacagggataccagggatttgagtctgcagtctctctgattttccatgagtgcttatcttcttgggggaggtgggggcggtgtgtgaacatccacacagcctcctgctcctcctcatctactggggcgctcagtcacccaggtttggaatgcttctgaggtgatacttaatgttacagttcatggtcaccgtgctccatgtacgtgaggtcatgtgtattgtgtattgtcactgtctctcttcccagttatttttttcagtcaggtgctagggaattctccttttcttactatgtcatggctgtcctccccactccatggggctttcagaaagacaggtagaacataagagtctagagagaccttgggtgtcacccaggccattgaggctccatctgggcttgaaagagccctcacctgcagtaaaggtgcctctgaggccaaggagaaattatggcataagaagggaacaccaaggagatgggggcccggacataccctctcccacctccttcagatttcattctttataaaatttcacataagggaagagtctccaaagtgtaaggagggccaaaaaaaaaaaaaaaaaaggttgaaaagccttccatctagtctaaccctaagagtactcatttatttttgttttaatttttaaaaattgatacataataattgtacatatttatgtggtacatatgatatttcaatacatgcatacaatatgtaatgatcagattaggtaattggcatatccaccacctcaaccatttatcatttatttgcactgggaacattcaaaatcctttctcctagccattttgaaatacacagtactgttaactgtagtcaccccacaggcctatggaacagcagagccctttcttcctgtctagctgtccaaatgccagtgcttagcagcagggcctcagtaccacactgcctccttgggtgcttctctgctgaatgtgccttatcttttcacccttctctaagctcctgtgaagcggggtgttcttaaacacctctgcagccccagatcactgagaacagcaccatgcacccagacatccaatgaatacccttcacgtgtgctttggataattgttaagtcccatattttttagagcatattcaaggcaagggtcataaattcaaatgccccctagggccaagaaggcaaaggacaagagggaatgagaccagggaccgtagcgagctcacaggcacacagcccagcctatgatataagctactccagagccctagttatccccaggaggagatacaagcccacagctgcctgcacatccacatttttgcacgagaagacagaaatctgggtttttctgtgaaatattttgataattttattttggaaaccaatttagaaatttcagaggccccttgaaattggtttgggggcctgatatgctcaggaaagggattctacagttagagaatatgagaagcactagttgaaactttcttcactgctagttttcagaatctttttaagagtgttcttttcagtggtctgtgtgtttttcctttagagagggtggggtgtgaagaagcacatatcaaaggcagaggtccctaaattcatttcttgctagagccttggagtaccctgagacgtgtgaaccctgcacctctggtccaatcaagaaccttctggcttcatggtcgctcatgcctgtaatcccaatgctttggaaggctgaggcaggaggattgcttgaagccaggagttcaagaccaggctagacaacaaaaagggaccccccaactctataaaaaataagttaaatattagccatacacagtggtatgcacctgtagtctcagctactctgtaggaggtgggaggattgcttgagtccaggaattcaaggctgcagtgagctatgattgtgtcactgcactccagcctgggcaacaaagcaagaccctgaagaccctgcttcttaaaaaaaaaaaaggaaccttccacacaaggtttttcttttgctcttcctgttgactggaagtctgtctacttgaattaacaagggctcttcttcccatgacctcatactcctctcagtttaaaatctgcatttgagcaatggatgcaaaacctaactggcaatataaatttgcatcttcttgaaatgggctccaagaagcaggtttgtggccagtagagccagctcagaacccaggagtggtacaaaaagcattcagatatcaagattcccctcctggctgcatcttccatgggggaggccatgaaaggggcccctggtgaaccattgagtcatttataggctaatcttagtacactccctgaagtagggaatgacatgggctgcaagaattcttcctaagcaccccagagagaacttcaccgatttaaaatatgagtttctgtaacctgagcaggagcttgcgtggtacaagggcttatgcagcctgcctgccaggaggccagagggtcgcacttatgagcttgagcaaatggggcttttgggaatcagcagcctccctgagctttcctggagcgagctgaactgaccctgaacttggagggcttgcctggcaggcttttgctgtctcctgatattgcagtttcaacatgagaggggcaggaaatagaagccccgtgcgttgaaggactgctgtgcctgcacttatctctggccagggagtccttggacactgttttctttggcagccagctggtctaggtcacttgaattcctttgaagttcagggatacagggagcggtagccactgcctgcattccttactcaggaggcaggcatggggtctgccattgcttacctgccagagaaccaggccttcattagaaaggtcatttttatgtgactatgactgaatagttcagccttttccccttaagtgggattttgtgctgattcagcagtaaagaataagcccataccccccatttttgttgccattgctcacatttgaatttataggtggagaatgggtgaagaaaaaaaacctttgatctttggtacaaatacagctgtggggctgttgcccacatttgccgtgatgtagatgcccatcccaaaaggagcaagatctgctcttgcagtgggtgttgagaggggctgggaggctttttcagtcaaatatggagctgaaaactgtcagaatgtgctggttgtacattatcaataagaatcctaacaggagcacagtgtgatttctcttcgtagtgggcgtacatggtcttgggtttccatgtgcagcagtgagagttggtctccaaagcagaacggtcagcattaacttcagccaagcaagcattctgtatggggtgctccctttaagcccaagggaaagcaggctctgctgcttttgccacctttcagagggagaggtgtgccccaccaggggtgcaggtgtgctggggcgtgaagataaaattagttgtttggaaaaaaataatgtctttaagtttctgcagagcagatcgtaccaattaaaatcagttcatcagaggattttttagtcaatccatacattcacacataaagagatgtgattataagtaacttggctgattccacaagctactcacaaaatcagatcattattttgtaatcacatttgtgggtttagatgcctgagagaccttctgaaccatcaccgttttgggtgcctgtgagaatatttgaaactaccggccgggcgtggtggctcacgcctggaatcccagcactttgggaggctgaggcaggcagattactggaggtcaggagttggagaccagcctggccaactgatgaaacaccatctctactaaaaatacaaaaattagcccagcatggtggtgggcacctgtaattccagctactggggaggctgaagcaggagaatcgcttgaaccgaagaggcggaggttgcagtgagccgaaatcatgccactgcactccagcttgggtaaaagaatgagactccatctcaaaaaaaaaaaaaaagaaaagaaactgcccatatgcatggctaggacagccttgatgttgtatttagtcttatgcagggcaactcctctgaagtcctcctctcacttctcactatcttacactatttgtgatagacaatggagaaagagggttttcttcagcagagttggagtatctactctgtactggatgctaaggatacagtgctaaacaggatcagccacataatttgcagggaccagtgcaaaatgaaaatatggggatccgttgtttgaaaaagcaggaaaaggtaccattaaagatatgaaaatataaagcttttccttttctttcatgatctttctgtctccctgtcctgctatttgctatttaatgccatgcattttcaggcaaggaaatatagcacaagtggaagaagctgcaccctgcccactagctgctgggtacctctcctgctagtcacctgctcagtgcactgtgccttggctggggctggggaaatcaagccaggtatctcccccatcccaagggcctgcagccctaatccacacccaatgcatgatgcccaaagatatggcaaccaatgtgccaggatgcgttaggcctatcgaacacactgtggcactgtcatgcccacccactacaggcacacacacctgactccaaccctcgcctctcccaggccccaccaaggatggaaatcagcagcagagatggggaggagggggccaggaggggccaagcctccaggtccccagtgcatgctccatgatcccatcaaatttcacttacaaaacacaaattttaagataaaattatttagaattttaagacaaccactagagcattaagccccaagcacagggttctcctaagtgcacgaagccagccctgttggtaatagaaagataggaagatgcctccccttacctatgaatataatttcttctaagggctaagtaagacataaacaaagaggtcaggacaaagaaaggccgagaaggtgagagacttgtagagatggtaggcaggtggcttcttggatgacaagtcattgaagccaagtcccaagctatgagaaggtagcatccaagggaagagctgggaagattgttccaggcagcagggacagcctgtgcagagaccctgtggtaggaaagaacctggctcattggaaaaactgaaagaaggttttgtgactggggcctggggactagggaggagagtaccatgggagatagtaggaaaggttgataggggcaggcagatatttggagacagggtaagttttatcatcatagcctttaatttccccaagtggtagctgtatctttctactcctccccatcttgggttaatttcttcctaaaaggcagaggctttaatcccaaggaaacctttaatagaaaaatttacattttagttcatttgtttccttaaaacggggtttcatctggtagctatcagacctgtgctggcacctgttgtggcagttaatttaaaactcagaacactttgtgcctttcatttgcccccttgaaatataaaagcctagtgccaccgttgcaaccttattgaaaagagcttatctaaaattggggaatatcagcccacagtaggcatataatgtgtttttctcctacacactgctgtgagataagaaaatggtttctagggttctcattaggtgatgtttctgggagtctttgccctgttgtgaaatggccttaaaggtgaatgctttaagtaatgagcagccaaaggccccgcttctggcaaagagcaagaaattgctggaaaggtcagatgggtttcaaaaatgttctgcatttgcctcaaatagtgacacaggaattattcagcttacataagagctgtttataggtgcttggagaaaatcaaggttgtgattgttttggctatttaatggggcatatctgtcccaaatttatgggggaaaaaaaagaaagtaagttttagccagagaagaaagcttagggtcacaggagaacagagcttcgaaacggcctggacagtcccagcagtcattagctgggatcaagcaattgtgacatcttcatcttgtgtattgtaatgaactgattagtccacccctcggaaaacatagaaaagcaaagacagccttctcctgggaggtgtaaagagtgaacgtttaaaatgactgtctaggttcctctgctccgttttattatttaagtacttatattggtggcttttccccccagaggtaaaaaatcatttgcttcctttttaaagaagaacgtgaccctctaataataaggcacagaattaaatgccacttaaatttattatagttaaaaaaaatttttctagaaagtggcttgaattttagaacctgacactatcatgtaggaaatacctataaatttagagatattgaagttattgaaaaaaaatccagcaagttgacatttagatgcccctattaaaagtcaattaatattgtggattttttattatattgctataaaaatccatttgattctcatgtagatgagaagttttgaatatttagatgtcttaactaatttattgggggaaagaggagacaaggtgtaaaatacagtgggcaccaactttggagcaaaaagacattttaactagacaaagatttagcttataataggccataagtttaaggctgtttcttaggttgatttatttatatctctccagtcctttccaaataatcagttttcctgatatgaaataaaatatctgacctttgatatgtccgatgataacgtttagttgttatctatgccaatcagttaccgccagctttgcaaataatcacaaaacaaaatatcttccagctctgcctcccaacttaaccaatgctacattgaggaaactttcatagacctgacaaattgcatgtatgactttttccttcttttaaaattatggtaaaatatacttattattttactattttaaccatttttaaatgtacaattcagcggcatacattacattcacgttgtcttacgtccatcacttctatttcttaaccttttcattaccctacacagaaattctgtaaccattgaacaaatgcatggctttttgtttattttttggctggtttaatggggctgttttcaggcttttaagaatcataatgcttggtggattgatttttttttccttccacctcatgctcttctccattctatgagtgccctgccagctccaaagccatgggaatccccagctgtacacttgtgcctggattggaatcccacccctcctatccatgggctcttacacaggccatagaacttggagttattgcccatcagagtcaaattcaagctgttgacctaaaagcgagccattcccagccactggcatctcccagcccccactgtctgctaatgtgcttattatttttctgtttccttcactatgcagtctcttcttgcagcgtgctctttcccagcttcctgtcagctttatccacttaccttcctctgatgaagataaaggttttttgcacaaaatctgctcagccgcattccatgctgtgtgctggcaagggcattgctaatagctttaaaattcacttaaagaaattggaaacagcaagtcacgtgcaatcattgtcaggcatgttgttaattacttgatagagatgctatatggactgccttttggttgtaattagaggtttttatcatctttgccttgcctgtaagcttttccaaatttctttatgaacattacaagtggagatggataggctaacacatatcagattacctgccagtttccctgaaattgtcttatttaattgtcactctttgcatgccacttgcatttctttgggtgcttggattagaaaaatgatttttcatcgtcttatagtttaaaattagcatttcctgccaccagtaagtttggacttgaccaagatctcattcagaaagttgttggaagattaaaatactctcacctatgctaaaataagagcttaattctttgcaatgctttgtagtatttgactttgaagctgccagaagttttagtagccaagtagtagtaggaaaactacttcaaccacgaagaatctgaattaggagcaagctctaaaccactgaaaaatatttcaaaatttgtttgaatctgtaagggtcttcttttgtaaagaagtaaaaagagtttgaggaaagtatttcttattccacgatgatgctattaaaatattaatattataaatattaatattataaaataatataaattattttgatattaccaattataagttaattggtaattttcctgagtgctgaatctgtatgtcagatttttttctggggctatgtgtgtctatcatgtaatattaggttggtgaaaaagtaattgccactcagtggcaaaaccgcaattatttttgcaccgacctaatatttcatgctcagaacagtcttgagacaggtatcttcattcttcttgttttacaagtcagagaactgagactaataaaaagcttgtttttgtcgcttacttggggcaaaggaagaaaggttagaatagatgaatgctccttctggtttcattttaaagttaaatttactctattttaatctcatctcacttcctctaggagaaggttggctcgccctggtttcgggtgcctcccagtctgctcaaaaagaaagcccaggcctcctttataccagcttctaggactttcatatgcaaacgcatctgctgggaatcttgctaagaggcaagttctgattcatttcctctgcagaggagcctgagattctgaatttctaagaagctcatgggtgttgctggtgctgctggtctgtagaccacactaggagcagcgagtatatttctgtatttcactccttcccaaagccatacctagtcctcttcaaggtactgctacatttctctcttatcctttaatactagtcagcttggaagaacaatctgctgcagctttcttttctttccttactatctgtgctatagtttatcttcttcccccagctctccatgaagctcttctgtcagaggatttgtagggcctttctgccatcacatccaacacatactgtcagttctcacctttccctctgttctctggggcatcgaactaaccacccccctccattggaaaatgatcctctgacctcaccactctggtgcatacactgggtaatctcatgactttggcaactcccaaatcacccatgcgtctgctccagaaccctgatctgggacatctctgctcaaatgtcaatatacctcaaacctaaggtatatgaatccaaactcttgcactttctctttctccttctcctcctctttgcctttccagtctttcttaacataggacaccttagagatgctttagactctgcttctcacacacccgctgtcaattccttccagttctaactttaaattatttctcatatcatcccctccttatccaccccaggcccccgcatcatgtttgccaggattgttatacctccttccatagattctacgtccctccacttttttcttccttcctgcagtcctttcttttataatacgttcaagcattaaaatttttctaaaaccttgatttgatatatattttcctaatgggtaaagttctgacggcttcccagtaaagaatatggttctagtcactttgcctggcctccaaggcccttcacagcctttttcacacacaccacttcccactgtagccggctctgcccaacccaaacgtcagccagactgcctcccaaatacatctgggaatgttctgctgccacgcctttgcattcactgtctcctccttctgggctacccttcctggtatggtcaattaaacccacctcacctgttcactgattgggttgtagttgtcatttctagatttcatattatctacctcactttgtagcatatgcaattaatttatgtcacttccatatatgccacttaaaaaataagtatatatttgcttaactatgtggcagccactttccccagaaaagagagaatggcaggaaacctgaaagagcatcatgatagcatctggaaaatgcaaaaatacatttcttcttttctgtaaacacttcagcatttgtgaacccagggcacatttcctccctgggacagccaacagcactgtgaagatatggttgacaagagtatccagcttacattaaaaatgcatctaactaaaagggtttaagtcaactgctctttcttgcatcttcattatgttgactttacaaatggggaaaaagcaagttcaagaaggaacgtctctgtggcttcctataaattgcttcaaaatgaagcctcttcccttcatccttgtagatttttcttggtgacattctcctttctgagtgctttgagcagccactcagatgcctggtatctctgtgacaatcacagtaatcttttctttgttaattgacctcctctgaagtacggagaaagttttatcttctaccctggattataaagcaaaggcaaggcatgcgtgtttgttctcttctgttctctaaggcactagagtttaatttacggtaaaataagtaccatcaaaagcaatttcctaagccccttggtgtccaaggaaaaatctgcatatgtaatgatgaaagctagagagcagtgccttctttggattgacccaaagcaagtagcatagcttctgaatctgcactgaataaacaacaggttgtggcctgtcctcagaaacagtgtaagttaaagatcccataaattctgtgtcactatgtaatggtgtcttatagcaacctggggtcctttacttttgttgctggggggctgtccagaccagccctgaggatatccaagggcactacccaactccttaaagtgtgtttaggtatttaattgagcttgcctaggggatttctgagacagaggagaattgccacctttggggtacatgatgttttaaaaaatggagttgaagactgtcagagatttaaaaacaaatacaataataacaacaaaagcctcagatgagccaggtagtaaatgtgtgatttggccattctgagacgcctagatgaatgacagtcactataaacgcgtaggagaggttgtgtctatctaaagttgtccactattttttttagaagagaatgaagagttgagactctccagtggatttatctccttttctttgtggctttgctttaaggatgggcccagggtttatatcataatgtgttttctcttagaaacagggaaacaatctaatgaactaaacctgtggtggtatgcatataattgttcttgaaatgaattataaatacagtacaattaaatagacacagttctgtgaaaaacaaacttgataagggagcagctagctcttccctgcttctatctcatacctgcgtcagacataactaatcatcacattcttatcctcagagtccacccatggctccagagtgctctcagtgttatcactccaggcagccactgtcaatctatcaaagatgctcttaatgttgaaaaccatttgtttgccattttcgcataatggaaagaatgctaggctgtgatttaggacatctgtgtttagtccttaatgctaccactagctagctttgtgtgggggtgcgaagggatggtttctgttttttggaagggaaggaggaattctttttttgtctttttctctcttctggactgttcttttctataaaatgattgaataatcgttgaggtccattatacttttaaaattacactctttaagttttatgaacaacctatttataaatttgaacatttccatttttaagggcaagaaataagagtaagaggtttgctgctcatgaactcaatgggtatctctgtgtccagctttcagtcttataggagatagaatcctgccctcaggccaggtgtggtggcttacgcctgtaatcccagcactttgggaggctgaggtgggcagatcacctgaggtcgggagttcgagaccagcctgaccaacatggagaaaccccatctctactaaaaatacaaaattagccagccatgaaggcgcatgcctgtaatcccaactacttgggaggctgaggcagaagaatcccttgaaccttgcggtgagccgagatcacaccattgcactccagcctgggcaacaagagtgaaactccatctcaaaaagaaaaaaagaatcctgccctcacacattttattaattttaataaattgtattctcttcattcttggttatttctaagtcaagggaaaagtttagtctctgaagtgataaactcctggctgagcactgtgacccatttaccctctgctgtgcctaatgaccgcacatagtctttgtgtcagagggctcagagccatgtaggaatcattagagagcaagaagtctgtatgcatagaggtgagagcacgggtatctgcatcagtacaggctggggccacattgcaactctgccatttactaaacatgactgtgggcaatcacttactcaagccctaattccctagctgtaaatgaagaataatatgagtatgtaattcttaggatgattggcattaaatggaatagtatatataaacaagccatcagtgaccagaaaaaattatagaaacagcttgtgctcttattttgttgggagagaaaatgttatggaacatgttaagaaagtaatatgaatgcaagggtctttggccaaagtatgcgtactaggttgggagcagggcttggggaaggacactgtttctttagacagatatatcatctggtgatgctgttgtaccggatgccagagatacagaatcaattaaagacaagacttgacttttaaggaacacacagtatggtggggaaagaagtggaaatatcaaccctgcttctccatgtgcttttacagaggcaagcgtgcactctgggtgatggggtaggcaggagggccaggggagaactttctatgtcaggcttgaaaagctggctagagagtatgtccaggaaagaacagggtggagtatgcagtcagcatgattgagaagagagccagacaaagaagttagactaaaatttggaagccttcccaagccgagagacttatgtgtgcagaaaaccaaaggtctgagacttcttgcctggatcttgaacaagagccaaggaattctgcttgaatttcaacagaggcttcagaatatggagggtcaagggaggtgttaaaaccagatcacaaagggcccgccccaggtgctaacctctgagaggtttgaattctttcagtcattatagcctgttggccactgttttgacaacagtggcttcagccaggctggccttcatgccccagtggttttagaatcagggcattctctgacaggtagtcacaatggccaagggcaaactgctatgtctagtgatgggggagtattagtagagttattaatagttagaccctggcctcaggtcctaccccaaggatggtggcttgaacttcttcataattggattgcccccagtaaaatcacattacaaacaaaagagtttattggaacacctggtgcctgtatctgtattggaaattgtattccaatgtactaccctgtcccttgcagctaatctaatttcctttccttcccctcatcatctacccccgccccccgcaactcatacatgtttagttttacaaaataataccacctatagccatgtatgaatcatatttttcttttatagtgaacgtgagtccccaccacatttgtgaaaggggagttgagttcacacaaggcattgggagcacaggcctgggctggggtcaggcaggggagatgggatttttgggggttgctccatccatctggttatgttatttgaggaggctgagaccaagggaaaagggaaaggcttgggcctgttcagcaaactcttattacaaagaccattttgaagcactctgctgtgccagcacaaatcgtgattggcttctcaggctgagccatgcaccgatgaagggtttgaacaattccgacaggtgcctggcctgagctacagcgggctggtggatgactcccctcggtattcctggagagttattgaatgtggccaagcaatgaaataacagtgaaaagggaagtcactttttttttttttactttgagaaggtgtatgctggcaaaaaggagcctgtccatgccagagagacccttgtggtcatattctgctaattggtctctttacaacttgaaaacattgataaacagaaggaatttaacttttcttccttgggggctgaaagagcatggatgctcagagtggcagttttatttgaagttgctgggttattctgatatacaatgacagtatcctaaagaaatgagatctttaaaagccaggacctttttcaagcagtctaagctcaaaggagcagagaattattgaaggtagaacaggattcaggccacatttcttttaaatgctcatggaagtcagtcttgatagtgaacagatgttcattcagtgctgaattattaggttggtgcaaaagtaattgcgacttttgccattacacatagaacctaagtttctgctctgagaataaaggctaaatgctgattaatccattctgtaagacttggccaaaatgtgtttttaaccattattagcatgtagtttcttttagccccattttaatctcttgtgggttataaccccacttgggatgcagtgaagaaaaaagcaacatggttcagagaactggacctttcttttgacagtttaaaattctacaactattactgaccttttacaactattacaactaccttttcagtcagtggtccccaaccttcttggcaccagggactagtttcatggaagacagtttttccacggactgggcggggcagaagttgatggttttggaatgattcaagcctcttacatttattgtaatgctattattactacattattattattattacattattattatattattattacattgtaatatataatgaaataattatacaattcaccataatctagaatcagtgggagccttgcaactggatggtctcatctgggggtgatgggagacagtgacagatcatcaggcattagatttctataaggagtgcacaacctagatccctcttaagcagagtttgcagtagagtccatgctcctatgaaaatctaatgtcgctgctgatctgacaggagacagagcttaggtggtgatgcaagtgatggggagcagctgtaaatatagatgaagcttcactcactcacccacctctcccttcctgctgtgaggcccagttactaacaggccacagactggtaccagtcctggggttggaaaccccaagttttagatcacagttctatacagattcaggatttggccaaagtaatgcaaattcacccttctttgctttgatttcatctcaaagtgatgtcatttggctgtgtccccacccaaatctcatcttgaattgtaattcccataattcccgtgtttcttgggagggacccagtgggaggtaattgaatcatgggggcaggttttccccatgttgttgtcatgataatgaataagtctcacaagatctgatggttttatacaggacagttcccctgcacacgtcccttgcctgccaccatgtaagacatgcctttgctctttattcactttccgccatgatcgtgaggcttccccagccatgtggaactgtgagcccattaaacctcctttcctttataaattacccagtcttgggtatttcttagagcagtgtgagaatggactgatacacaaagatagtgatgatttagggattcatggcagcatctagccagttccataccctaaatgtcattgacattcaataaatccttaaataggaatttaaaaatcttgatttatgggtgattttttgctcatgagcgtttgttttcattatttttgaatgttggagaacatttttgcacattagggaatactgttggctcagcagccctcaccaagcagactttaattttaataatccaagactatggttaatccaagactgtggacaatccaggaattatctgtctcacttttagcatgcatttctgtttgttcattggagactgctttgtcagagatgacattctgagttaagaagatggatcttggaaccagagagacccggaatttatattttttgcttcctagttatgtgtcctggagcaagatacttcctcttgctgagccttggttttctcctctgcctaatgggtataataatagtctttatagctaacatttaattagtgcctactgtgtgccaggcactgttctaaatgctttgtcatttaatctataatacaaccccatgaggtgtatcaaggtataataatgatggtgcctgcataatagaatatgatccattattaagcaagatagttcatgaaaaacatttcacatgctgtctgatacattataagaactcaataaatatatggtatcaatggtagttactgtagttatctattgcgtgtaacagattggcctaatatttagtgcttaaaaaaaaccgattgtctcacacaatttctgagggtcataaacctggaagacacttagctgggtagtcccatgaggttgcagtcaagctgtctactggtactgcagtcatctgaaggctcagctgagggtcggcttccatgacggctcactcacagggctgtttgccaaggcctcaggtcttcactggctattggtaagaggcctcagtttctctcaacataggtctttccaaaagggatccttgtgatacgtcaactggcttcccccagagcaaatgatcaaagagagggtacgtgtgtacaagaacaagcaaaaaatggaagatgcggtgtcttttataacctaaccatgaaagtagcagccatcagtcctgccatcttctgttggtcacacacaacaaccttgggacagtgtgggaacatactacctgatatggtttggctctgtgtccccacccaaatctcatgttgaattgtaaaccccaatgttgaaggggggtccaggtgggagatgattggatcatgggggtggtttctcatggtttagcaccatcctcctagtgctgtctagtgatagaattctcacaagatctggttgttggaaagtgtgtagcacttttcccttcactgtctatctctcttccctgctctggccaggtgaagatgtgccagcttccccttcaccttctgccatgattgtaagtttcctgaggcctccccagccatgctcctgtatagcctgtggaactgtgggccaattaaacctcttttctttataaattatctggtctcaggtagttccttatagcaatgcaagaacgaactaagatattatccaagggcctgtgtaccaggaggcagggatcattaaggccatgttggaggctgactgccacagtggtctgtgtttctaagaatgttaaatcacattccaaaaccatgaaggtgggaagctgagcttaggaaaacttgcctgaaattaaggatttgccaccaaaagcctatcagcctaagcaatcagtctgtggtacattttgcgggtaggtgcaaccaccatgcatgtttgaagggtgtttcctgtggcttctaatttgcatatcctgagatggtatcaaacgcttgcatttgctcctttgccatttcttcactccagcttttactttaatattctggtacatattttttgatcatccagtactgtgggcatggctcatcttacagtcagttctaaaagtatatagcaacccctaggtaaaagttcatttcattaccaactggctgaaggcagtgaatttatattcaatcacccatctgagtgttttcccccgattttctggggatggattcactgcagtattcccttaaatggattttttggcctttctctcaggcctgcatttgacattttctcaagaatgtttattttttaatttacaactttgagaggtttattttatgagatgggttttatgcaacaaaacataatgggttcagagttggggggggaaccctgtgaatttgaaattgactgccatgaggaggaattattcatttcatttgtgggagaaaaatgacagctaacaggaaagtagaaaggtttcaggtctcaattcacagatgaacaaatcgcctttcataagtcagcacgcttggtgttttgtatttgccgtaaatatctgtgaggcttttggaaggatgtgattagggtatgatctctcagtggagggtttttgcagggtcttcttggttaaaggggccttttgaattaaaacggaagaaaatgaaggcccttgcctcatgaacatcagagcttggagccagactggcctgtctttattccctttcttctgtgtagagctggtggtcccttctgtttttcaaaaagaagatgcttggatactcaatgcctggacttgctcattctaataatataatggtgaaatattaacttatctaagtactggaagcttcaataaccattctgcctgactctttgagcagaaaagactgtggaaaaaccactgtgctctcattttcaccctcacaccccacaaccctccattaatttccaggcatcacccttcattagccaccccagggctgaaggactgtgttatgaggctgcagggtcatgaacctcaccatccaccccttggttcatttcacagcttgctcctttcttaataccttatggcccattttccccccttcacttcgcaaggggaacctttcccagggcctgaaatggatggggctcctgctgctcctcttttgttcagtgcctccctattctgtgatcttaaaagtgtacacccttgccacaaccatagcatttgctcagtactctcaacataaaccaagcttagatcgcaatgaaactgcggacctgcaggctgccttgcttcactgagtcaatttttaaatgaagatggaacacaagaggatgatcttattgttcagtaaatttactctaatacataaaccccatggtggaagatggtatttggtgagtttaatctgctccaccttttttaatgaataagataattataagatgtgattgtatttgctcattatacaccaccgatagcagtttgctttagaaatactgcataggtaaagtaaacttcctaagctgatcaaagcaaggagaagggcgcacctgccaagcactgggaattttcccatctgtctgtaccatgaaccatgttacctttgatctttttctttggtgattgacaggctggtgaaaaccatagcaacttctgaaagtgcctatcaacgtggcagtgggagcaaaattaatgtgtgttttcccccaaagaagatactaggtgtgtaaaggaatggtttagaagcatcagggagacagggtagcactgtggttaagaacatggaccctagagccagataagcttaggtttgagtccaggctctaccgcttagtagatgtgtgacaagtatattagttatctgttactgtgtaataaattactccaacacctagtgacttaaacagcaaccatttattatgtcacacagttgctgaatgtcagacacccaggagtggctcacccgagtggttctgtttcagggtctctcacaaagctgtgttaggatgttgactggggcagcagtcatctgaggcttgactggggccagaggatccacctcgaggttcactcccatggctcttggcaagaggcctcagttcctcaccacgtgggtctgctcctggcattttactcagagtgagtgcctaacttctctgagcctctgtttcttcatatatcatataaggaaaagagtagtacttcaaaggattatagtgaagattgaatttcaatgaaagtgcttagcatgtcatctgattcatgattaaattctcccttactcttcttaccatttttatcatcattgtgatcgtcacctaccccataattcctataatgtttaaatgggcctatgtatctccaatttctgtttttttttttcctctttgccaccaacaatcttcccattcctctgaatttcaaattctttcttgactgcctacaattagaacccatcaaaatgtcaatacccaaagacagatggagccctcctggggtctcagttggctgccaggacatggaaggatgtggctaatggtagaatttgcagagaacttgcaccaaatattggccctgtcattaaaacaaagagaaaaaaaaatatttctgcgaaagagtttttggtcagagaactataactacagtttgagatgaaacacaggaaaaaagacatagtggaaggttgtagaatatatacacagagttcacttaataagagatattaagtagagagcatctctatctgttacactccttttaggggctcttaggatctttggactgtcttcagtgataaggctcaggtgtacacatccaagtttgcctagaattttgagaggtccccagatatcgtccattcactgcacgttaattaaatctatataaacagacaaagaatgcagtaaagaccaacatggtatatcttgaatgcatatttgtattggaaagtgaatagtaatttgatattcctttgtacatgtcaaacagtcatttatacaagcacacatattaaacttttggtgtttttgacaatttacttgctaatccagctttctgaacgataccagctacccataatttgtttttctcagccatgatgtaatcattaagttgccataatgaagattgaaggtttaataatggaaagtgttacaaatttcaatttaatcattcctaaattgattagcaactttccccaaatgcctggccacagaaaaacagagagctaagagagacaaagtgctgtggtccgagtttgataaatggtgctttggtgcagctgtaattgagttattgaatttactcatcttccaaatgatgtttgcattgtctcagccatatgtgttgagggccagagaaaggtcattagaagcttcagaccgagggcatatacgggttacagcaattttgaacagcaacaccgtggttagtcaattaaaaggaacacccagcaacgtgtccctgagcctcttgccacagaatggtcagtggtgagatcccaaaggcctatttaaaagagtctgaagattctgtaagtaaatgtctactctcggcctcaggctatttagccctgacaaatgacgtgggtgagcccctatgggcagatttgaaggaaaggacacctataaacaaatccagcctggcagctctaacaaagccagaattgaaataattagataacagcactggcctcgctcaccaaagagaggagctgtgtgttgttttctgcattgctttgctaacaccagatgtgaactttttaactttcacctagatttctctccacaacagtatcttaaaaatagtaaatcagcatggcacttcagcttaagacattttgagaaaaggctttgttggtcttttccccgtagcccactaacttatccctgtctacccgcatttcaggtgagtgtgaacattaatgccgcttgtgtttcagtgattactaaatagtcttcctttttgtcctggacccatttatatagctgtcacatggtaaatttttaatctaagatgtgatattttacaaatccattagaattcttgtgaataaacattctaaacggaaggggctaaagccaggaggccattttgcctgggaactagaaaagacaagccttcaggatgtggactgagaggccaagaagcagggagaagccagtgacagacagcaagggagtcccagccctccttgagggcaaaaccagtagggaaggctgactgggcccagctgctagttggcatgggtgaggacccctcagaggacatggcccggctccaagacatgcatatggcaggcaccacttggatgacaagccacctcaaaacacttggtttgctttacagtcataaaggtaaagttctctagaagcccctagattaatttattacatagatactatatgagttttttagggctgcatttacaaagtactgtaaactaggtggctgaaaaaaagagaaatgtattgtctcaaagttctgaaggctagaaacccaaaatcagggtgttttcagggccacgttccttgtgaaacctggggggggacctttttttgcttcttcctagctgctggatggtttgccggcaagctttggcgttcctgggctggaagatgcaccactccaatgccctgtcttcacatggtgttctatatctcttcacatcgttgtccctctgtatcaaaatatcccctttttatgaagacaccagtcatgttggattagggccaacccttaatgacctcatttttacttaattgcctctgtaaagaccctatttccaaataaggtcacattctgaaggactggccgttaggactctagcatatcttttgagtcagtcgggggtggaggggcacatttcaacacattacagacatcaagttttaaaattgcaaaatggaatcaattatttccttttgttgtctaagtcaatttggaatgtgtttctcccagatattttcattgaaggttaattttctggatgttttaggggaaaagaatagcacatactaacaatggatctcaaaaatgtccgtttgggactagttggtcggaatgattggcacagtgggtctttgggtcctgcatgtagacttgagttaaccatttcaagtggcttcagctctaggtgacagatttcactccacctgtggctggcttctctgtatgtctgtgcattgtttccagaaggacttgtcaaggagcataggagtatttccctcttattcaagaacagcatccacagcacatggcgggcagtaagtggggtgggggagcattaggctttggaaagttacagccctggattcaaatcctaccaccacctcttactagctgagtgaccttgatcatgttacttctctttcctgagcttttcctcctccataaaacctagtggatgaggctcaaatgagctggtatgaacaaagtacttagcacatagcacagacttcatgaaggttagttcttcaagcagcccatcctttatatagtctcagaccacactggtataattttagttatctaacactatatagtttacacggcaatttcacttactatatttaatttgtatttattgattgagggacacgattaaaaatataaaaatgcttcttttaaattattcacaactggtagctataactatgaatcttcctatgttcaatattttaatttttttttttagccaacagccactaatcttgattagttagtaatctcagagctgatatcataccccaatgcagtggttctcacctggaggcaattttgcccccaaggaacatttaataatgtctggagacgtttttggttgtcactgctgaggaggaaggacaactagcatctagtgggtagaggccagggatgctgctagacatcctacaacgtacagcacattgaactaactacccactttcaacatagaactatctggcccaagatgtcaacagggctgaagttgagaaactctgccttaagctaccaagatattttcatgagtaaatgctcaccttcaatcagtgcatccaatcagaaaatgggtgccatgtaaatagcactttgttttaatttccatcctgcaaagaaaacattcaaatcagaagtaatattttctaatgttatgaaaaaaaaaccccatcagcttaagtcaataagcgtttgatgagtacattgccctggggtattgtgttgctgataaatgacagctgtggacaaaccgggcatttgggtcaggctttaaacgtgagttggccaaaagcttttgggctgacccctacatgaacggtgattgtaatcacagtgagtaagcacggagtgttggtgaatttcactaaaagcagagccatccccaagagcatgcataccttgccttgatggaagactccaaagtcacctgacgccaaataatgcaacctccactggtggctagagttgttcagatctcattcgtattaaagagatgaatcatgaccgggagtggtggctcacgcctgtaatcccagcacttcgggaggctgaggcggatggatcacgaggtcaggagttcaagaccggcctggccaacatggtgaaaccttgtttccactaaagatacaaaaattatctgggcatggtggtgggcacctgtaattccagctattcgggaggctgagtcagagaattgcttgaacccgggaggcggaggttgcagtgagccgagattgtgccactgcactctagcctgggtgacagagtgagacttcatctcaaaaaaaaaaaaaagatgaatctttttttcttgaaagaaataaaatagatatttggtagcatcagaatgcctagtaataataagtataatcataataataataggagccaatattacttgaacacctattaggtgtcaggcgtaaaccaaaagttgtcatgcttcttctttgattctcatagtagctcctttgagggaggtactaatgatcccatttctcaaatgcagaagctgaggctctgaggttaggtgataagcccaagtttattcagctggtaagtggcagagccagggttaaatccaggatcgctggctccagatctcccgcttaacctctggtgcacttttgcatcagtcaacacaatgagagggtttgggtgggggtgcttttaaaaattaaagaacactgcctcagttggggttatttaaagcttgttaaatacctatttcaatctgtcaccatggtaatgatgccttttgtgtataagagatcttggaaaacatggtttgacttttacagcccaggagatagggcttctgttcaaacattaagcattctcatgccatcttcatggtttttccatagacatgtacctcgtcactataatttccaaatgtgctttaattgactcaaagaaaaaaaaaaagagtaagcgactgtatttggggcatggagaggggggaaaaggtgcttaaaacaacacaaatttgtaagccctggaagccagaatcaaaatgtgtaaccaaactataatcaaggtgtgaacatggctgcattcttttctggaggctctaagggaaaatctgtttccttgacttttccagcttctagaggctgcccacatttcttggctcatggtcgcttcccatttccaaagccaacagtgtgccatctctctgatgatgcttccatagcacagcttcctctgatcctcctctctgcctccctcttcagctttttttttaattattattattatggtacaatatacataacataaaatttgccatcttaaccatatttaggtgtgcagtgcaatggtgttaaatatatttgcattgttgtgtgaccaatctccaggattttctcatcttgcaaataatgaaactctttatccaataaatgacagctcctaattccctccttcctctaaccctggcagcctccattcgacttcctgtctatgaatttgactaccccaggcacctcatataagtggaattatatagtacttgtccttttgtaactggcttatttcacttagcatgagtaactatattttccatgaaaacattctctgacttctagaaatggaaaatcagtaatgcttgtcataaatagagggaatagccataaaaatgaacagaatgaaagcagcccattattagatgctagctgagttctactgtgtgacactctgaggttcttatctcccactgagattagcaaatattagcaaggcgcaaaagatgtagcagcaccgaactgagactctttcataatctggaagatggtaagacatttgataaagccaaaccctcttgctatgggactcagtgttaactcaaggcctgcctttccttccactacttcaaaacagttcaggtgttactgggaatcgctgtgtagaacatctaggcaggaaagaagaaatgaacaggaacactgagtgagcaactaatctaattggagaaacaaatatttgtccttttgtatttgagcgtgtgtgtcattgagtatactgaaacaaaaaaattggctttgccatcctgctgcttccttcacctgggtagattccagttgattgtcaattatatgtcaccaggtggtatcaaaaggcagtttaattccccatgaaaattaggacttaacctgactctgtggctttactgcgagtacatggtgcttggaagctgctcattaatcccattctgtaatgcccttgagatcaccaacctgaaagtgaatctccatttcctgcaccatctctgcagctggggtcagatggaacatcagatagggtctgatgacagtccctagattatgactgtagacaataaactgggggtatcttagcagcagatccaggataaattcctggggacccatttttgcccctttttagaatctacccaaacgtcctacagaggaaaaatgaaatgatgcatcacttaatatgttcaagtggaaagagaacacaaatccttgctctgctttttctggaaaatttgcatacattctgcctagtgttttatgttccagaataatctttctttcattcttttgttagttaaaacagaaaccagagacctcattgggggtgtatggttttaagcaagatttatattataataaagaagccctttttggatccacatcaaaacaatttgaccctttctacaaattcattctagagtttctgcgtgttaagggagagggtgaggataaacccagaattgttgctagttcctgcatgtcttttatttcctcttaattgctgcgtggaccagccccatcctaaactgaatagactcactaaggattctctcctgggccagaatcctcactccaaatgagctagccataatcacctgtcgttattgaagcaccaattcaggtgaggtttttaccatcatttcatcaccaactcttggagacacagccaccgtgagtgtcttgcttttgttgttattaataggttttttgttaagaccacagatttgcaggccccataaaagaactccaagggcccccccttttttttttttctatcactctttgtagtcctatcctgtgataactgcatttgtttggggagataaggaactttcgttggtcattttagataggataccatatgtcaaatttgtaaaatcttgttaacactgtgttttcttcactagagagttaccctctagtaggggaaaatggaactgccaattacagcaggctcctgctgtgaataaactggtgttatattcccagacatcaggctctgcaaggagagagcccccagttgccttttcctttctagcctgatagacaaagctttagagtaaagcgtaattagcttgactgacaatcaggaaaatacaatcttcagtatctgtttttattttaaggtctacttgttttggagacatattccaaagtcattcagcaattcattcctcaatgcaaaattcagtcaattgaaaggccagaatttgcttaaaacattcaatgtgtttttcaaaagagagataaatgaatccacctagtgaccaacaaaacttatggtatatcagactataactattaaaggagaaactataaatccccgtggcagtagagataataaatttttttaggctgacccctttggggggaatttggatcttacactgcgttcttaattttattgaggcaaagatattgcagaaagaaaatcgtttctctggcactaaacacaaataatgtacaacaataatcgtgacttcctggtagccgttttctcatccgcgggctagcttcatcattgtataatggtgagatcttgttcatcaacttctgtcccttaagaggttttccttgcaaaattggaaagggatattttgtattttgttttgtttgttcattttgggttttgttttccaaatcttctctaattctgcaggctggaaacaggtagctcagtgaatgttcagatcacatcctctggcaccatctatataaggcaatttgttatagaaagaagttaattgatttaaggtaaaggaagggaaatatacagaaaaggaggagagatggagattcaaaatgcaaaaactaaaacacatagaagaaggggtatacttcatcatccattggctgtttagtacctgctgtgtaccaggcaccaggctgggctccggagataaagtgatggattttataccgactctgcctgtgagtgctttcatttagcatgggaaagagatggtgcataccctattccaacataattaagactcattttattacagataagcaacctagagacaacttagcaacagaaacttgtgatcacaggtattcagaaatttagcagagcagatggttgggaagacgttggtcaaaggttacaaattttcacttaaataagaggaataagttcaagagatctattgtacaacatgatgactacataacaatatattgtattcttgaaaagtggtaagagagtaggttttaagtattctcaccacaaaaatgaccactatgataggtaatgcatatattaattagcttgctttagccatcccacgatgtatatgtacttcaaaacatcatgtcatacatgataaatgcatacaatcttatctgtcaataaaaaatttagagcagaatctaggttccagatttttttaaaaagagacacctttttttcttttgaaatataggaaaatttaaggatgccctttatctttgttttaataatgattcaacgttgtactggggattctagccaatataataagaaaaataaacaagatacagaaactggaagggaagagacagaatagttatcatttatagatgatataattaccaacatagaaaatcttagcagagtttagagcttatgtgagagttcaacaatgacaattagagctcatatgagagttcaacaatgttatttgatataaggtcagcttacataaatcagctgtgcactttctataccaataataaccaactagaatatgacaaaaaaagatattactcacaatagtgagtaacaaaacccatgaagtatctaggaattacccaataaagaatacacagggccaggcaccatggctcacgcctataatcccagcactttgggaggccgaggtgggcggatcatgaggtcaggagttcaaaaccagcctggccaacatggtgaaaccccatctctacgaaaaatacaaaaaaatagctgggtgtggtgatgtgcgtctgtgatcccagctactatggaggctgaggcaggagaatcccgtcaacccaggaggcagaggttgcagtgagccgagatcgccctgtttcactccagcccgggagacggtgtaagactctgtctcaaaataaataaataaataaaaaataaaaaagaatacatagcacttttttttaaaacttttaagttcaggggtaacgtgcaggatgtgcaggtttgttacataggtaaacatgtgtcatgggggttgtacagattatttcatcacccaggtattaagtctactatccattagttatttttccatggtgtatatgtaccacattttctttatccagtctatcactgataggcatttaggttgattccatgtctttgctattgtgaatagtgctgcagtgaacatacatgtgaatgtgtctttataatagaattatttatatttctttgagcatatatccaataatggggttgctgggtatttctgtctctaggtatttgaggaatcaccacactgtcttccacaatggttgcactaatttacactccccacacagtgtaaaagtgttcctttttctccacaatcttgccagcatctgttattttgtgactttttaataatagccattctgactgggagacacccttttctaagttacagatcccttcataggaaatgtatacatatggagttttcaaataatggagaatgtctgtaataagtagtagcatgtgactgaaaaaatggcttctggtgctactagtgtctccagtcatctcagggacaacaccttttcagagtaagtaaccaggcacctttcaaatactgtgtcataggaattagcttcttccacctaagagaccaagctctctgtttcatgctttgggtaatcctttcctgctggagtctgaccaagtaaggatgggccttggttgaagtcacaatgcagcgagccctgggaaagcaggaatttggccatggctcgcccaacaagatgaccacctctttttgacactagtcttcccttctcacatgtatgccgtccttacttgcaatggtaacactttgtcctagcatctctctttcctattcctttctatcagaggtggtcttaatagtaagcagtcacaaaacaaaatgactgaaggtgattgcatatttagctggtcaagagcacagggtttggaagcaagacagacctggctgtgaatcctgattctgggcataatacttagtcccattaagcctcctttctcatttgtaaaagtgtgggccaataagacttaaggcaaaaggtagttgcaaatgttaaatgtgctaatgtgtgcaaagagcttagggtggtccctgtatctggtggtggccacttaaacgatggctgttgttaagtgacagaatgaggataacccccttccaccacatgcagagaggtattgagaatacaagtggaaagctcagttttctcttgacatgccatcacacccaaactaaagtgtttcaggcttacctcttgctgctttctgcaatatgatgaaaaattctagacccaaatggaatcaagttcttttttttttttttttttttgagacggagtctcacctgttgcccaagctggagtgcagtggcgcaatctcactcacggcaagctctgcctcccaggttcacaccattctcctgcttcgggctcccaagtagctgggactacaggggcccaccaccacgcctggctaattttttttgtatttttagtacagacagggtttcaccgtgttagccaggatggtctcgatctcctgacctcgtgatctgcccgcctcggcctcaagttccttttttaaaggttcacaaactatgtgaccttttaatgacaaaagtatgactttatacctctagagaaaattaccattcagattgttctgagctgattacccttgcctttcaactgcaaactttcccaatcaaaagtgtgagcataaagaacagcatcattgcaaacatgtaatctatctgacatcttgcttttcatataattgaaagaacacatatgtcagtttatactcaagcaaaaatgatatatggtatcaatgtgaaacatgagagatgatctaattttttctctcattaatgaatattgagcaaatagagcatttcaggatcaaggaatatatgagattctgtgtatttattttcttcattactctagctacagtgtcacccgagagtatctgggagatgacaaccaggcaattaaaggcaactctgtccaagcgctggccctgccgtagtgaatcatgaccctttctctggcctccccatggctgaacccctgtccttggggaacctaggctgtgaatgacttggcagttaccacaacacatactttttttatgtacacatgacatgtctgtgatatgatgcatctgctgtccgcaaaaccatctaaatggcttaacttctccagatttcattttaaaagaaaaagtcactaatctacatgaaaagttttgtgtttcatgtccagattatcttaggaacttcaactgttgttgtagggtgaggatggggagatggtgtctctcaatagatgaatgaagccaactgcccatttttaacaaaacacatttgtggtgaccattacctaatacattcatgagatgggttccactaacacagatctctccggtgtttgtttatttaattaaatgggagacatgtccaaatgattccttttgagatttctttggtctccaaactcatgctgcacattccatgtttacatagcttcctgaattatctgcaaaattgactaagaatgctgcaaaatgctaaaaataaaaacatatacatgtagaataagcctggctaatggttcttttcaggcatatttcttttcactgaaataaatgatagggtttagattttcaaccacttcctaacatgataaaatgagacacagtgctggtctctactgattcattcgttctgagatcaacttccactacaatgaataatagcaaatgtaaaataaatcttggccaggtacggtggctcatgcctgtaatcccagcactttgggaggccaaggtggcttgatcacctgaggtcaggagtttgagaccagcctggccaacatgatgaagccctatctctactaaaaatacaaaaattagcccagcatggtggtatgcacctgtagtcccagctactcaggaggctgaggcaggagaattgcttgaacctgggaggcagaggttgcagtgagccgagattgtgccactgcactacagcctgggcaacagaacgagactcccatctcaaaaaaaaataaaaaataaaaaacaaatctctgtgtttctgcctcatcatagaaaaggctgtgttaaattcatttactagatgaaaataagtattattaatttgtttctttgttctttgatcaacttcttatttaagaactcttactaagagcaccttcatgctatattcaatgctataactttgcattaagaaaatgtggttatcataaagaaaatggtgaggccacatttgtcagatacctgacatactccctgtggagaatttttaaatttcttactttgtaagaagcctgtcgtttccagtggatggtcaagatgaatcaggatttgaggcttaagattgttggtagtgtttactttgatttaatgactccaacagatgaggggccactgggcttgctgattgggtctgtactgacttttagccatcatgatggagagtaaagctcatgtccatgaaagacacaaatcataatgcagggaggaaggatcaatggagagaatgttagcataggtagtgatttgccctgtcatcgcactctcacctattgatatattttttcagtgacaggattctttcgctcagacttttttcttttgctattataatagttctcaaaatcaacaaacttttagttgcttagaacaaccaccacagaaaagaatgtgaatgtttattaccactgaactgtacacttgaaaatggtaaagatgatacattatatatgtatattttacctcaaatcattttaaaagcccccataatgtatatatgagaattctaacaataacagattctgtcatcttccacaaacattgtcatctacatttttcacttggaaggggaagtgcagtgagctctagtgaaaaggcatgcatggacttccacaggcagacatctggatgtgactcctgcctgccacgtattagctgggtgacctgggcaagttctttactgttctgagtctcaggctccccatctgttaggcagatataaaagaagagtgcttctattcacaatagcaaagacatggaatcaaccaaaatgcccatcaatgacagattcgataaagaaaatgtggtacatatacaccatgaaatactatgcagccgtaaaaagaagaagaccatgtcttttgcaggagcatggatcgagttggggggcattatccttagcaaactaatgcaggaacaaaaaaaccaaataccacacattctcacttgtaagtgcgaactaagtgatgagaactcatggacacaaagaagggaacaacagatactggagcctacttgagggtgaagggtagaaggaaggagaagagcagaaaaaaaataactattgggtactgggcttagtacctgagtgatgaaataatgtgcacacccccatgacatgagtttacctataaaacaaacctgcacatgtacccttgaacttaaaataaaagttaaagatgaaagaaaataaaattaaaaagtacttaattcatgatatggtttggctgtgtccccacccaaatctcatcttgaattataatccccatgtgttatgggagggacctggtgggagctgactgaattattatgggggtggtttccccagtactgttcttatgatagtgagttctcaggagatctgatggttttataagcaactggcattttcccttgctggcactcattctctcttctgccgccctgtgaagaggtgccttccgccgtgattgtcagtttactgaggcctccccagcaatgccgaactgtgagtcaattaaacctcttttcttttttcttttttttctttttttttttttgtttgagatggagttttgctctgttgcccgggctggagtgcagtggtgcaatcttggctcactgcaacctccacctcccgggttgaatcgattctcctgtctcagcctcccaagtagctggggctacaggcgtgtgccactacgcctggttaattttgttatatttttagtagagatggggtttcaccatattggccatgctggtctcgaattcctgacctcgtgatctacctgtctcagcctcccaaagtgctgggattacaggtgtgagccaccgcacccagcccaaacctctttcctttataaattacccagtctcaggtatttcttcatagaggtgtgagaacggactaatacaactcaaaatgtatgagatgctcaaaatgcaagctttgagatctaagagatcatgcaggtcagtttcctagcattgtatctagtatgtaataagtgttcaataaatgctagtttgccatgaaaacttcaaataagcataaacgttggagaaaaattactttaaatgggaaaaaaacctatttaaaaacatctcattgaggcataggatctgtgcacagggagtttacctgaccctgtaagataaagtcccttggctttcttcagcagcagaagaaaccagtacttagaggtggccagtctctgaaagagaggtattggcatcagacttgggagtggtcagttaacagctgttacgggcatctgctgggcaccgagcagaatccactcatgaagactgctctgttgcctcctgttttctcattgtgtggatgaagaaagcaaagccaccccaagctaaactgtaacccattgacaagggccacatttggagggtccactgtgctcagaatccttcaagggagaaaaagaataaaaagcaaggacagaccacatttttccccactggtaacagaacctcggtctctgagccctgtgtgcctgtctctccagtttccctggtagaactgctgctgcctctgccattgcatgtctgtttccatctggtcaggctgctataacaacatgccataaaataggtggcttataaacaacagaactttacttcttgcagttctggaggctgggaattccataatcaggatgtcagtagatttgatgtctagtgaagacccatttcctggtttataggtgatgccttcttgctgcatcctcacatggtgggaagggcaagggtgctttctggggcctcttagaagggcactcatggcattcgttgaggtctcagaatcacctgccaaaagccccacctcctaacaccgtcacattggtgattaggtttcaaaatacgaattttggagagacacatacattcagactacagtaacatctctgtggtggcaagtactgggcttgcaaaatgatgagaaacaggaccaggccagataccgaggaagaggtaagggaatccagggggcacatggaacagcacgcaccctaggagtatggctgtcaatatcccagagttggttctctctggaacccaacaaacccatattgggccattctccactcagtataccatttcttcacaaacactgtttctctactccagagccttgatggtgctcttaatatgagctaaggtacggccgggcacggtggctcatacctgtaatcccagcactttggaaggctgaggcacgtggatcacctgaggtcaggagtttgaaaccagcctggccaacgtggtaaaacctcatctctactaaaaatacaaaaattagccgggcatggtggtgggcgcctataatcccagctacttgaaaggctgaggcaggagaatcacttgaatccaggaggcggaggttgcggtgagccgagatcacgccactgcactccagcctgggcgacagagtgagactctgtctcaaaaaaaagtgagctaaggtagaaatttctttctccctgccatgaatccattcatattacttttttaaagtaagcattttgttttaacataccaacaggatacatacattttaaatggtaatgtctattaagtaccaggtgttttttttttccccctactccccttctggagagaccatcctctcaaaaatcagcagaagaaattcgtagcacagaaatcaagttctttatatattatttatctctctggctaaattttataccacgctgggcagtatttatgcctgtggtatgattatagctacctttaacatttggcctagtcttgaacgttggtccaggaaacaaaacttttcagccctacgtatcttgcttaacctatcaatggttgaataaatggatgccttttatcttaattcctatttatacatgacgatgttattgtgatgggaggcatatatctgtgtactgtcctatcagtcattttattcttcaggggaaaaactgtgaacatcatctggcttcaaatttggaaatggtgactatttaaaatgttaagcaggacttaaggcagatagttttttaaaaagaataattttattttttctttctttgtagcaatagacattattttgtttcacttctgtcaaatctttattcaaccataaatgtaaatcttgattgcctttagaagaataagattggctcacttgggactttgtttaggatgagcaaggctaaaatgaaagctcctgtgatatcagggtcagatacaacaagtatttgccaactctaggaaagtttcaccatctgaccttaattattccacagaagggagggtttcaccatgataacaaggagaagcgcacgcgcgcacacacacacacacacacacacacacacacatttttcttctcttcagtacctaagacgtcaacatttatacgtagaccatatgaacaatgtattaggtttctgccctaacaccattccaagaaagcaaagcccattttctgatactaacaatttagtttttgaatctgtttcttccttccaccattaccactattttataagatacccagaagaaatggttattatttatgcagggtttgtgctccctctgctggttctgtaattaactaataagtctaattcccataactatgctgatgtcatcaattatttttgtgcatggacatggaattacccaaatcagcatgttctgctcaaacatcatcaggaaaattagcagggggtcagaggaggacagttggcctagcgaagaaagtgtaccttttgatttgtccaagtctgtatttgaaaaacctaaatgcagttttatgcttttatttgctccatgctagagaaaaacgatctattattatttaaactagcatattacatcccatcctttcagaggtagataaggttggagataaataaaggttgttcatcttttgaacaagatttattataatatctgttttgcaagtgagaaaaaattagaagttcagaaatcatgtatgccttgctgctgagagtctctgcaggctaaaaaagtagatttctataagtggcacataatggccaatgccttgacttcccagatctgatatgtctttttcacaagtgtggagtcgggacatagccatttcttaatgtcagcacagcatcatgtattcatgaagaccataagctctgtagctgggtcaactgaggtttaattctggttctagcacttactctgtaatcctgagaaggttagggtacctaactttctagaccccacctttcttgtctacaaactgaaaataatattgttggcaagagttcttaccttgtaaagtcattgtaaggattaaatgaaataacaaatggtacttaaagtaaatggatgatgatgatgttgatctgaaaatactctggtcattactcatggtgattctttttccaacatgaaagcagcttcttttcctgataataaaaacttactgtgaaaactgggagggtaactttcaaatgataagggttcaatactccaggaaatattgtactcataaacaaatagtctgaaataagaggggcataattgaatggaactccaggagaaattagtcaagatagtgtagaaaatcaagacatttcttacagatgataagtcagtccaaccaagatcgcaattaaaaaaaaaaaaatgaagaaactttaaaatgggtaaaatcctaatacatagagatgatatttgagtatatatcctttggatgttttgtagtatttgttcatgcttttaaaaaatctatttagttacttgtaaaataatgccacacttttcaagcttttttgagaacctccttattctcaatcagtaccatattctggccatctttccatagcagtaaatgtggattaatggtcaatattattcttggcctccttggtcctgtcactcttagcatttatagataccaccccacccagttcaatgactgtattcttagatgatgcagattaattccaataacaacccaggcaaagcaaacaagtaaatccagagtcaggataggttacgtgtcgtccttcccaaagtcaggtatcaggaactcttggacgactcaaatcagcccctttttcattacctcttccaaaggagagtggtctggagacacattgatgttgcagggcctcaccctgctcaggagggggttgaggtgtcattgctgatgggttttggtgagggaaaagaaagaggtggctccaagtgctaggccccttcctctccctactccaagtttctctacactctctggttctctggctcttgtaggcttctcagagactctctgggtttgtatagatggtggttatttctgccatgtgtgggaaactcttgtgaaacatatgtgccaggggtaggaatcccaggcctcctctcctgcccaggggataccatcatctatgtttgtttttaagctggtcttaaaatgaggaatcttgtgctggaatagcttgctgtgatctgtttaactataatttttacctgtacttttcacaggcctggcctactctctgtcgtgaaaatatttggaatttatactttaaacagtgtaggccactttggttgttgatttaaaacatgctagaggtttttataatggttatttatattggccaacactgacccctctgcaatgacctgttgatgttggacaaggataagaggcactgaatacaatgcaggaaatggaaagagatcaaaaagaatgaatatgtgagcttagtaacaatgctttgtggcttaacacggagatcaattgtctgtgtgtgtgaggttttcagaattgcggtatttggcccacttacaggaattaagcgttctctttggagaaatttaagagtttttcaaactgtgttttgcattacaatatcaacgttgctaattctacaaaatcattcttgattatatataattatatataaatgtatatatacttaaagcatgaagaaaatacttcatatatctatatattgaaattattgtaccttttttaaagaaagcaaaacagccattgagtaaagcaagtgtctctggaaagtaaggccatttctgtggactgttcaggaattaacagcgaattctttcttctttctttgttttttttttttgtttttttttttttttttttgagacgaagtctcactctgtctctaggctagagtgcagtggctagatctcggctcactgcaacctccgcctcccggcttcaagtgattcttctgcctcagcctcccaagtagctgggactacaggtgcacaccatcacacccagctaatttttgtgtttttagtagagacagggtttcaccatgttggccaggatggtcttgatctcttgacctcatgatctgcctgccttggcctcccaaagtgctgggattacaggcatgagctaccacacctggccaacagcaagttctttctagcctgactgctggaaagggaaagtggcatactttctccaacctgtttctcttgcccccatactccatttcttccttgtattcaatggcagagtgtcagtttgcttgtagtccatttcctatgtcatttatcactgtacaaatgtcagctgtgagacaggagaacatgtgtgtttgacagctgcccaataaattatgcagaagaacaagttaaagacaactgcatggacttaaaacacacacacacacacacacacacacacacacacagatatatggaccgttagagaattggcactagtcgttgcctcatgaatatcttaaaatattattcaactgtaaccactgagcgaagtgttagcatggtttgagagacagcatcagagtaactcacaacttaaaaccaagtaaaatctggtcccccacaaaaagatctgaaaggagatgcatatgctttaaaaatccaagttttcagtgaatgcctgaataataccaccagttaggatggtggatgagatgatcctggaagcctggcccagccaggactgacttggccatacatcttgttccctgtgaaagtagaggtcccagcatgcgtttctgccttcagtgaaatcatagagagaagcaaatttaaatggaattacctttgcaaagttaaaaagtatattcctataccagttttggagaactctctgtggcagctattttgtgatttcttggagaagataacaaataattatcatgttggtggtagagaaaagccgtgtgttttgtggctcaagtctaaatccatttatttactctctttagtgaccccacccctatttgagaccgtgctactaacctaccaccttgacagtgcctttgagtcgtgtagccccacattccaccctgagagcgtctatctgtggaatgatggctggagataaaggagtcagtctgtagccaggaggtcatttgtcctcttcacatgggaatcagacttattgctgtggcccgagctatatccatcgtctaaccagctgagctaattagcccatagctgagctaactagcccataaagacatagcaggttattgcttacccacattagtaaagattcgattctgtttggccctcacaattttctctgtgttcacagttcataccagcaagggattcctgttccttaggagaactgacttcccagtaaacaccctgagcacagtcatctttaaatctctgtttataaggctgtgtgtgtgtgtgtgtgtgtgatgagaagctagagcatctgcgggattcaataggcagaaagctgatgacctatcatatgatagtaaatgattacgacatgagtgagagttacttggcatcagcaagctggtagttattttaagaaaggggaagcgatgttttaacacagtgggcaggtgtgctggggcaggaaatatattttacctaatcaaatagcatttagccaggtagttggcagctcagcctctctctaaaaccaactttgctttggtatttttctcccatttatttactctctttagtgaccctgtttggcacatctttgcaccatgaccaaagtgacagactttggtctctgttggactaatcagtgtgttctctgatccatgacatatgttccctgtagacatttaaagtcaacatattcagcacttgtggtctggcaggtcagagttattaactgagctgatagactggtttggatatttgcatccaaaagactttcctcctcatcctctaacacatagagccacacatccactcccaacaacacaaatattgactgtaccaatcatttattagcagtaaaaatttgagagcaattatttttttactgcgcttgccctgaaagacaccattaattactatattgcctgtggatgtgagccagtttcggtgtcccaggggcctgctccccacccggaagaagtatttgcagctccgaggaacacagcataggatgtcatctggcaagcagtgcactgacattgtcttctgaagtgagatgtcaagactgtttctgccatcctattggattcctcctgacttgcagtttacaggtcaggattggcggtgacggtaggtttccccaatggcctgaaaactccaaatagaggtgggtgtgggtgaaatttgagatgtgccagcttttttttttttaaagagcatgagaaatattccaaatcatcctagaataattatcagcggaagaacttttttgattgttgattctgcaggtctcatccagagggtgaaaagaattaaggcttctgatgggcagcaccagccagtctgccttttcagttctgatctttcaaaggcaggtgtgatgcagagatagtaatggtgctgttggatggttttcctcctcttcctactctagttagcagaaatgcaaaaatgccttttggaatttaaacttgtaccctaaaccagtttgaccacattttttgctcaatttggaaaatcacacaagctatttggaatgtatgtatgtatttattacaagtgggctattcctttattaaaaatatactgattagatgtatagcatgtcctccctgctaaaaagaaaatgaatcgtgacttattaatgtgcctgattacgtgataggcctcgatatctattggctgcactgatcagcttgagcctagctcttaccacaccttttgtattttgtgtgtgtattgattatgatgccaatctgcacatccatgagcaatgtcacccatttttaaatataacttggagaatagctaagtagtatgtttaacaagggcttgagaatgtttagtacgctctatagggtaaggaagaattgctactgagaaggcatatgggatcagtggcatgtcaatgtagaacacagtaatgtagaatggactggcatcatgagagggaagcctctctcacattaaatataaaaatatcttaggaaacattttccaaaaaccaatgctgttagaacttgcagtggaactgggctgacttattttcttccttcagaggtctttaattaataaaaagagaactgagagtaaaggaaaaggcacagtccatccagtgcctcctaaggacccttctcatcatcgtcctccagaggaggtacctatggcgtgtgctgcccagctgttggtggttgggagtgtgaatcagactgagactctgtctaggggtgctggtttgagttttttaagtcaattgcctcatctacgtaaagcatgcagttagaacaggcttttcttacaccccagactgaagcattttttagtcgagaagtcaatttaagggaggcaatatattcttttgcagcctgtgccataagaataaaagtccaggctgccacttattacagtttaactgaatgatggattctagcctgttttaattaaattacatattcaattatttttgtttgaaattaaaagcttgattatattaccgaatgctatgtaattttacacgcgttgttcgcttatttaacagtgaggcgtgggatatgattaacaatgtggctgccagtagaaagaagcaaaataattatttgttcaatatacaagtcctcatcatgattcagaaatcaatatgcatccacggaggatttgctcgcactgtggattatggaactcagtgtggccttccctcatttccctatgaatgtaaaacctggagactttggttcaccaggcaggtttttatttccctctctctctttttttttttaaagactgatgtttaactacagccgttgggacttaaatcagagcatccagtgcccgaatatgaatattaatcagatgccaggccatggagttcctcgccgagtttgacagtttaaaggatcagttagttaattagaagatgacatggcacgctgggtcccaaggctctgtcctgccttctgtctcctcttttcatttccctttttgacaagttggattacatcattacttgtagtttcacttgttagccccaccatgaaatgagaatattttatgctttaattatctgtgatttcttccccctttctctgcaaagaccaggcttaaaatgaaactcaaagaaacataagaatcagaggttcaaagtcccatgaaaatcagtcttgtgactccaaccatgccacacaccacattgcagtgagaaatagaaggtttgtggtagcatgagaaactgggttgtggtagtcatggtgactggttttaaatataaaaggtgcctgtcctgactttcgtgccacaagtacagatgtatcacaccaggtgtttccatggcttctctggcttgaggtgttacatactgtgaatatcctcaggggtagccacaaattattctggcctatgtttcttgcccaccctagtagctaaatgcaccccaatgtctgaacaattctgttctaaatgtttttttcttgccatgatattgctcacttgtgaagcttctattaaataaagtttacatgtggtctgtatagcagcttagtccccaggaaaaaaaaacaagattgagattagtgtttagctcttcaaatgaaggtttttctgatgccctaagtagaattaactcttcactcctttctccccatctactctgcagacagctgctgtggcacatctaaagtttaattacaccagacgctgagctatacaagggatggaactagggttcagcatcatccctagcaaacattaaaagtgaaaatgtaaaaaagaaaggaagaaaactaaaatctactgagcatttaccattaatgctgcaagccagccacttcactgagtaactctgtatgagtaatttctcattagtcttcacaacaatcgtaggtggttagaagaaaaaatgaagacttgggaagaatcttgccaggtcacaatggcatgtgctaaagaagctgagctgggatttgaaattaggcagtctgatcccagattcccctcctgtgctgaatctcacatggtaggtgcttatttacgggtgatgaaagagaaggatgtttttggttgtcagagggcatttctaataggttgaactcccactggcagtatatggagacagaagagaggtgggaagaagaaaatgtgtgtgctagatatgatccttactactggaaaagctatgatatttagggcatatctatatttatgtagaatgcaagaggaaaaggagctagcaggcattaccagagggatctgggtagatgaggaatgtatactatgaaaggaccagggaagagttaagaaggagtgtagagtcaacagggtcaggtgttacagggaaggtcaaggcaggtggtggtctttaggagaaagaacatcaacatggttaacagaaggctggggccacatctcagttccgccggtaagtaatctttttggactgcaactgaattatctctaaagccagtggaggtaaatcttgaactatggacctccacgtcctcctatttagatagtttgaatggaggacttacaacaagctcttggttgcggcaattgggaggtcattatgaccccagatgggacagctatagtagtgtgtgttcggctatggaggaaggattgcagagggcaaaccaaagagaatgggtggaggtgagaaagaagagaagttaagtgtagactgctctatggaggaacgtgtcagcaaaaggagggagagggagaagactggggagtggcagatttgggagccttcagaatgtcttgagaaacctctgtcggcctggagagggaggagacaggcaacaggaagctaggacagacagcacgagtgggagggatggaggtctgggagagccttgagtccgagggcacgaggcttcgatttcctgcacagactaagagaagcagtgcaactgaagggagggcagagcaaggttttgcagttgaagaaggggcacaaagtttgtttctccaccatgaaaataatttggggatgggagtgaatacagagacaaataaatggattgcaaaattatatatattagatctaatatatatatctaatatatatatatatatattgcaattctttatatatatatatatagtcaagaggttggccagaagcagggaaggttcagctcacgtccatccgaattagtcaggaatccttccatatcattgtctgactgtcaccagagggctgcagcaagctgggaagtgggagaaggcaggagctaggagccagctcacccagcactgtcgagagcaacagaatacacaagtcacgagggtaagacatgaaaacctactcactcgatgcagtaggattcagtattttaaagaaggaactgagaagaaaaggtcctcaattcgccattctgtgcaccctggttacccttcttcctaaggtaagggaaggttcacatcgccagaagcagtctgttttccatccacgttcttcctcagcttccctgggacatgttgctctctgtccccgccagcaactgaatccttgtacagagagtcaggcagataagaaagtgtagtgagtattctgtaaatttaaacttactctgttttgaaactcctgaggttatgtctaataattttttcaggtttttgttttccaattaaggtactaacgcatgaagtttttaaatgtccttataagacaaatatgtatttggccactctgttagtcctcagcattgttcccctctaattttaccagtccatgaaatccaaatgatggaatagtattggtgtatagagcacacggtatgattggtcattagctgctgtggtgggatcgtggcatggcttggccaagcaaagctttgaagaaacgctcactgcccatgtaactgtatttattccttttcctgaaataaaatgcctcacgccaaggtaggtcatggtagatggactcaaagagaaggtgggcagaactcagagtgctgacggggacccctctgcagtgaaaggtgtaaaatgaaataagctgttaatgttccccatttcattccaaaaaataaattgtggtttcagagcacccacttatcagctttctagttgatatcacccagcacacttgtgcttacccccagggacgaatcacctgaaagatgttggggtcaaggcatcaaaacatttggacgcacattgatgggttttacacctttgtatctctctgatattactgtttcgcttcagcaagcccactaatatcagatatatcctatcagggactattttaaatcacttcaattttccctgcccctgggctctggccatcagaccagaatcctaagcatgtgttgcctgtgatctagtgttttcctttcccccatttataggagagggaactttattagcttttggacacacatatatatcagttttaaggattaagtacaacatcagtagttcttacccggctctcaagtgtattgagttgttatattttctcagagaatgttaaaaaattagtattgccatttgtggaagcatttttctcttaaaccattggtcataatggtgtttacttacttattctctgaagtactgttttatagagaaagtaaatctaggatagaggcttggtaagtaatttcagacttgatagcacatgaaccttataggtacgagtgaattatgaagcctcactttgcagtgttgttttgttttgttttgttttgtttttctcaagtgtctttcttgcaactacttgttttatcttctgggtgactttaaaatattaaactagcttccctttagtgcctaagttatccatccaactcctgcttctcctagcctccaaattctttcagacacgaacacccaagttgcctatgactcaattaccggctgttggaaaggaccatctactacgagggcatgtcctgaatcctagagtctggccaagaataaaaacaaaaatctgtgtttcccagatccacttctggctgtggtttgacctgagatctaccaagcaagatacaaagtaatttggtaattgagattcccagttctgaattcagatttaggctctccctatctctgccccagtgtcaccctctcgccatttcataccttcctgcttcacttcagcctacacgccagtcacaggcctcttcaccagaaatcatttctatcccatcattcatttgccctcaagaccgccattcatgtggactcaccttccctaggcaccacagcccatgtacctgcttcatctctagtcagagagctctttctgcgtttcctcacgtgtggctctggcctggcttgtttttccctatgtctgtattccctccatcttgcaacaaccagctcagattgtgccttttccacaaaggctgtagtatccacagcaaaccaaaaagcatggccccaagagttatattgtagttaccccatgggggttatcaggagaaaccttccttactccaccactacctccactctctacagctgacttctctccccctttatggtttagtcttgtttcccaggagacatcatcagctgcttgagtatagagacaggctttacaatttttctgtattccctgagctgggacgatgtgtagcacagatgctcaataagtacttgcttgttgattaatcacggtaatgaagctatttattggtcataaaccacggtggggtttttgtcttcaagaacttgttgctttcctcttagaaggaagaggctggccacagtcaccattctgtcctagacacttagcataacattcacctgcttaaatgaaaggagtaggaggacagatggacatgccctcaagaaactggcacagtgcagatggcagcaaatcctctggcagagcacctgggagctagagatcaattctgatggacaaattggggtgggctttaatatgcatgggattggaaggatggagctcacatctcaacaagcacaaatgtatgtgtggaaggtattccaggtagggctaatgggtccaataaaagcatcatggattgaaaggattagggatgtcagtcacaaagcagacccaagcatggggtcaggggcaggatagcaggagacagataggaaaggctgatgagacagatgtgggaaaggtcacagtgaggctgaaattcagtaccaattgcgcgttcgttccagccatgttacatatggtgggatcaaaattatgtggcataaagatgagccctttttaattttgaaattgatgtgattatttttatagtaatttttaatacatagcaaatgatgctgattttccatttacagtggggattagattttatttcaaaagtactttaagtaaaaccatgtgaatagctttaaaaaaaaaagctggaccaggctcagtggcccatgcctataattccagcactttgggaggccaagacaggaacatcgcttgaggccatgagttcaagaccagcctgagcaacaaagtgagacccaccccatctctacaaaaaaataaataaaaaaatagccaggcatagtggtgcccatctgtagtcccagctactcaggaggctgaggcaggaggatagcttgagcccgagagttcagtgctgcagtgagctatgatcgtaccactgaactccagcctgggcgacaaagcaagcgctgtcccccccccaaaaaaaaaaaaaaaaaaagaaaaaggaaaataaatcaagttaatagtagtagaggctgtaagtcaaaaatcatggtagttccctgcagccggaggtttggaatgcacaaatatggaagtgggaagactccatgtggaaagtcacccaggccaatgactccaaagacttggggatggttggagtttggcaactgggaagccatctgcgaacttagagcagctgttgtcctggggtggctgcaagtcagatgcacacagcagcttcaggagggtagggggggttttgtgtgttttgtttaccactaaacaacagtgtctggctcatagtaggcaatcaatacggaggcgtgaatgaataggtggaaggtatgaggtgaggtttttatttccacccatgacactgacacccactgggccggtggtggggcgcggctgggagcagccggattcccacgcccccacttgaagtgagctcataggagacacagcctcccttcaggtgaaggaggaagaaagggagggagggaggtaggctgcagtctctgcctctgatcttataccaaggctcttctgttttatattgtcctttataaacaacaccacagggacctaggcaccttagtgtactccagctgaaagtggccagtgaagaggcctgggaggagctgtggcatggggggaccacataccccatctcaagggacagctttaccctgcttctgctcatttttgtcacatgggaatgcaaggtcatatgtgccacacactaggaattttcaaaagatgtaaaaaaaaaaaaaatccacacattttcagacgactgctgctgatttttttaattagtgcctaagttaaaatgttaaagacaccacaacagcccactatagagtttgtgacctctcacctaattcttttaacttaatgccatcacatctccctcgaggatttgtaacacctagtgttcctcgtaacatttttcccagtgtgttattctagtcatttttctgaatccacaataacacaattggtgtcacgttcacgtgccctgtagcgccagttctgaatctctcccctttcttcatcctatcacttgttctccttttctctccttagggtctctccccttgcagctaagcctggcttaagctacctaggactttgaaacatgcaaaggcccgccacctgaattcctgcaaatcctggcctgatgccctccccacttcccctctgtctcgagtgttcaccatgcatctccattggtttctaccatctgtcctgcctggactccaggcctcaaatctcttttcctgctgtcaggtggaaccccatatccaagggttgaggcaggtcctccaggagcccagcagggaacccccagggtggctgggagcctggcccagatcacagagccacaatgcccaccactgccccaccatgccatttagaatggagcctttgatacattggtcacattcacatgggcaaagagattacccatggaccatgattgagacccttcctatcccccagactcagcagggactttgtgatcaggccatttggtagctgtaagtattaaaaggaaaccttgtatctagaaggagatagtctcagcaagccatgccttgtcctgttcagcaggccagtcatttacagactctgtatgttgatcggcatcctcacgagtacattgtgtttcctggattgttttctttaccagcccctgccatttcccaggaagccagttttgaaagcctgtttgcccgcctcagcattcctaatgaagatgtaaggtcttacttgctttggggttacaaattctgatctcatttctgccatttgcaggctgtgtgctcttgggcaaattactctgcctccctgagccccagttccttcctgggtaaaataggggtaagagaaatacttcgtcctgaccgtatcatcaccaagtgtcaaagaactcttagctcagtctgtgattgttttgtcgtcaaattatggtccacatgccaaatccagcacacagcctcgtttggtacagtttgcaattaagaatgtattttacttttttttttttttttttttttgggacagagtctcactatgtcaccagactgaagtgtagtggtgcgacctcagctcacagcaacctccgcctcccaggttcaagtgattctcctgcctcagcctccccactagctgggattacaggcatgctccaccacgcccaactaatttttgtatttttagtagagacgaggtttcaccatgttggccaggatggtctctatctgcccagctcgtgatctgcccgcctcggcctcccaaagtgctgggattacaggcgtgagccaccgctcccagccgtattttacatttttaaatggttgttatataagtatctatatactcttcttgattttgcctcttgacccacaaagtgtaaaatattttctgtcctgtcctttctagaaaaagtttgccgacccctgcaccagaaaatgctggaagggctttccgcccctggtttgtgactgttcctttggtttagtgcacacccacagactgtgcttcaatacctttcaaggctttctctcttttcaggaaccgtccccctggtcggaggactgcccgactgttagtaggggaaaccaagttcctaagaggctgtgaatttcccacactctgtgcaagttgttctgagggactgggctgagttcactctctacacttccctgtcccatccccgagacactcactgtgcgaactcacagttgttcattccaaagagttagcaagggccttttggaggctgggtgttgtcataggcatttcaggggttacaaagatgacttgctcgggaaccgccctcgggaatttccaatctagttggggaaatgggggtacccatttgtcgccagtgtcgggaaacacagtgtgttctgggacctccaaggagtcaaggtgtctcacggggcgtccgtgaggcctcaggcccctcagcttgggctgcatgttgtgacatcaaggcgcatcaaatctccttcctgctggtggcctagggcagggatgcctgtattctggcctccccattctcagttcctgtggcagttgcagcagcctgtttccgggtctgttgcatgactttcagagactgatgctcactggcctgcgtgggatttggagctagccatgacaggcacatagtaggctgccctcaccagctgccttgctccccttcccagcagggctcagcatgtgcctcctctccatgttattgtaaaaaccgcaattacttttgcaccaaactagtacttcaagtgaaacagtgagccatcagtctcaggcagccaggatgttcctcaagatctctgcagcccaaagaaaatgtcctcaagacagcggcacctcaatcaatttggcaaaggaaaaatattttttcattcaaaaaaaaaataagagtctgggcgcggtggctcatgcctgtaatgtcagcactttgggaggctgaggtgggtggattatttgaggtcaggagttcaagaccagcctggccaatatggtgaaccccaactctactaaaaatagaaaaattagcttgatgtggtggtgcatgcctgtagtcccagctattcagaaggctgaggcaagagaatcgcttgaacctgggaggtggaggttgcagtgagccgagatcacaccactgcattccagcctgggtgacagagtgagactctgtttcaaaaaataaaataaaataaaataaaatatgagggcctaagcagatgttctgagcttacatagcttttcagaaacaaaaactgcactcacagctgctgttacatattttttactttgacattttttgtgtgtgcattctgacatctttgaagttgctttttttcttgctatgaagacacagttttcatccacgtcttactccttgttcaagaaccagtggccactcactaaatagggttcagacaagctgttgaaaagtcactttgacaaggatgagggttcacgagtgactaaaccatttcttcaacagattgtgatttgggctctctagccatgcatagtatacagggcttgtgggagcaactgtcctaccaaaggcacaaaaagtgattcttttaggtctacagccttgaccttcttgtgagagccaacttctttgttcatgtcagacactatagtccatctgctcactactgtactcccaaagcccagaaaagtgactggtgctgagcaggccctcagtatgtatctgatgctgaatttattcatcagatatttatggaacatcagaggaggaagttggtgggcatataccgctgactgaggcctggttcttgcactggaagagtgctctccagggaagaacagagggatgcaaacagaaagtgaccatccgtgtgaatcgtgccataaggaggcacctgggaaagtgtgcagggcactgaggagggtgggacagaggaggtgagacttaaggggcaccctgaaggagatggaattgagcattccaggcagaggtcatggcctatgtgtagacgtggaggtgtgaaggaacctgacccagttcattcagcactgccagaaaacagcacgcatgtccagaggacgcagatgaggctgggcagactaagagaagttgggtccatgcacatgagaaattgggctgtgtcttgagcttgatgggtttattggctgtgtgtgtattgttaaggactattctagcccggcgaacagtagtaactgaagggagagtggggttccacccgggaagaagacaagttagtgaatctgtgtgatccagaagaaagatggaaagatccccaggaaagaagagccagcgggcaggtctgagagatttgagagaggaagaatctatcccgtgactggccggtgcctaacaaagggatgccattgctccacacagacctgtttcctcctcagtcctgccatctcacttctttttgacatgactcttccagaagtctatatggctggactggaagttcatagcatggtgagacctgtgctcatcattacaatagagaaaacaaggttgtattttaggtatcaggcaaatagacaatccaatcagtatgctgaaaataatatgcttgaattagatagcttattcagcaattaaataaatataagttcatgtctacatctgctgactgtctgtagcaccctgatgacttatggaagttcaaagaacgattatgagggatattccctgggcactttaagccctttgtgtatatgccttgtctatctgtttgtctcattgtgtgttccttggtgacccctctttgcactttatttttaatttccatgaaggcaggaagaggcaggcgtctgatggtgcagagcacccgagaagagtgccttgtgctctggtgagcttattaggcactttccagtgatgtgattactaacttgaaaaagacgttaagcatcttcatcaaacaatgtgtgcctttgtgtggccagtagttttttcatttttactgggacagctgttctctcaaaaacagttctattataaacaacttgcaatcactaacagactttctttgcccttacactgcctctgggatgagctttactaaatggtagggtgtgtatcatcaagcaggtgaacctccttttttacacaattgtgtgttccttactataggaaagcaacattttgaaaataaaacaccattctaaatgtgctagatgattttccaaagtaaagggtactttaaattagaaaaaaaaaatcactttggtatgtcttgttttaggcataatgggtgcatgagtgttttccattttttattccaaataacacatattaatcacaagaatggaaactcaaccatgagtcgaatttgtattagtatcctttccattcctctccgcctcctgcagtgtgaggctcttagacaccagactcaccaaagtacccttgtaaggcagctgttctcaaagtgaggcccgggcacccctgggggtccagcacacttgtttctggggatctgtgaggtcaaaaacatttttgtaaaaatagcaagatgttatactgtcattcttttatgagcatgtagtacagtggagttttctagcggttacatgacatatcacaagcatttgaattcagaagaaaatgtgaaaatctagctatcttcaattacactagcccttaaagagcttttggaagatgtaaaactatgctttccttctcaaaaacttctgttttggaaaatatagtcatttcataaaaatgttatttatattattatgtaatgggtttgttattgctattttaaaatgaattaatgaataaatttaaaatttctgattatttctaatatgataaatattgcttaatataacccatataaacaacagtccttgaggttctcagtaattttttttttttttttttttgagacagagtctttctctgtcgccaggctggagtgcagtgggcaccatcttggctaactgcaacctccacctcccgggttcaagcaattaccctgcctcagcctcccaagtacctgggactacaggtgtgtgccaccacacctggctaattttttgtattttagtagagacagggtttcaccatgttggccaggatggtctccatctcctgacctcatgatccgcccacctcagcctcccaaagtgctgggattacaggcatgagccactgcacccggccggttctcagtaatttttaagagtgaaagagttcctaaggccaaaatgttagagaaccactgctcggaaatacagtgccatatgcagtaaaactgtcccagcttgttattgagattgggaaactttctaacaaagagtaaaaaggatgtgtaaaatttccctaatcatgtagcttaggcccatttcgactttgatttgtggatgtgcaggaaaaaggtgaaggactactttgaaaccacagaatcttatgaaaaacataacttaaaggccctcaactttgggggaggagagccaaccgtgattgcaagcctttttttgtggggacacccaagcacactttgttttcctctccctgctggtacttgccaattgtgctgtgactggtgggtctgtgagaccgcacaggtcatccttcatctcttcatgcagtgagtatgttttcctgagcaccttcacggggcctgggctggtagaaattcagacccagtccctgtcctcaggaagccaaaaggcttgcacaaggaaacagtcagcaaacacataagcgttaagtgaacagaatcattactgattttggaaagcgatgcaaaggaaatgaacggggtgatacgacacagtactttggaagatctgaaagtaaattcatacaagatacctggcaaaggcttttctaaggaggcttcatttgagcggagatggggatgggggttggaaggaaggagaaagggaagagcggttccagcagagagacctgcagaggccctgcagaagggcatggcttgctggcagtgtggtgaccaccagagtgggtgagcaatgatgggtatgagacattgatggacaaaggtgagattttacagagcactataggcgctggtgaagaatttgggtttcaatccaagagtgatgggaagtgatctgagggcttttcagcaaacggtggagtcatccctttctgctttgtaaagaccagcctggcaactgtgtagggaatgaactagggtagagaagcaactggtgagtaggcaggagaggaggcagagagcacccaggaggctctgggcatcatcaagtgagaatccatggtgtgcaagggcaataggcagaatggacaggtttgagatctaatttggggtcgaacagaccagactcactgatggaccaagggtggggatgaggcaaggagagtgaagaaatatgacctctgttttttattagagctgcttttgttttctcaaatcattgcaacaaaactctgcaaggtaattagcatcatacctattatttagagattaagagaccagagggccaataacgtactcatgggttaatagggccctgcgcagcatcaaaacaagtcagcaattactgcagctgccccgccccatctgtggcttcctttccctggtggcacgttccagtttactgctccagtccaggcagtgacaccaggtgagggcctggaaggaaggctcctcaccctccagcaagtcagggctgttagctggtgtaagccaagtcactgtgcctcgtcttcggtgtctgagaaatgggtccagaggcatctgctggccatcagcccaagtgggattttattgggactggtttattcacgtctcaggtgtgtctcggctccctgagaaagggagcattattcttcaggccccatggcacgtctcagcaagggacgtgggagtcctccccggagacagttaaacctttgtaaaatgaaacctttgtaaaatggtgaaggctctggaagcaattgtgagaattttaaacatcgaccattttcgttgagaaaaaggtacctgtgcatttcgttcaggcaatggggcaatcatttatttaaaaacaaagtttttagaaaaggtgtcaggcttactcagcaggacagaggctgaaggaggagagaagcaaggcagcaagaaccaaaattcttaaatgttgtctgttgtcacctcccaagtagaatctggcagctctctgctttcttcacacacaacttggggcacagcttcagaggtctaggcaggtatggaacatcagatacagatccgtagtaaccagtgacagtcagcccagccatatcatctctgaaatatctgcagcatctatatggctgaggggatggcatgaagctgactgcttctcttccttccagttagttgggcagcccttcaacaaataactttctgcttttggaattgaaaatgcatttggggaatgattatctgctttctcacctgtagggcagcctctctccttataacccctagctactttgcatactcatggatatatcctgcaatttaaatttttatattttattcatatgtggagtattttccctgcaactttgtaaagcactaaatattatatgaacattattcaaaacatgtcctttccataaagtccgtttatatgccatcattatctgcagcattaaatacattttatatcatcagaaattttatgatatatttaaaaatgaatttctacctagccgaaacacattagggattatcctaagagaccttgctaaaaatgcagtcatgtttatttgtaactgccagaaaatagcttgcaaaattgttagtgtcttttattattccctaccactggagcacttgcttgttaattagagaaatttcaactgtcatagttggcaattatagcttctgtatcattgtctgttatgaatagtcaatgagagctgattaatatgcatgagcagcagtatatatagcgtgtgcattggaccacaatccagctgccagagtcactcagaggagggagtggtgtgcgtgtatgtctgtgtgtatgtgtgtgtgtgtgcacgcgcgtgcatgcatgcatgctgcgaggggaggaagggaagcgtggaaggggggagagagttgttgtctagcctctgagagcagcgccaatgtgaagcgttgcagtcgcttgactcacctgaggctctccaaggataccttcaatgcctgcactgtaagggagctgcttttcccgggtgctggcgagaacggaagccttcctttgacgtttttctaaacatgggatgcagtctgtgcagcctgcagaagcaagaggagcagtacaaattactctatgaagtttgtcaggtaacaccctgcattttattccatagaagtgcataggcacccacctggccaagtgtaacttctaggaaaggtagtggggatttttatgtgtgtttttgtgcatattttgtgttctgaaagacgcagcctttctgacttttttgtgtattttctcttaagtctgttataaaattttccatccagtggcactttggtgcctgcatttgaaaatataaatagatgttgatggtcataaaatgtgtttcaagcagtcttgtcacaaggctccttcacaactgacctctctccagagtgtcgaactcaaagggtcaaagagtggtcatgcaccctttgaacaagttagagaagacatggatgatgattaatgctagcaaggttttgtctgtgtttacaaatagttataaggcgctcctttcagtacagcccaagccctctgctgacttggttcttttagcaattcttgtagtgggacatatggttcaaattggtacttctcacttgccatttctgtacctctgtctgtgaaatttttaagaacttcaaaagcaagtgacttgatcttgggtgctgtcattcacatcagatgacttgtatcttctgagtcattgtgagcaacatgaaaatttcagttgagatgaaatgggatatttacgatacaacccagataatttatcttacatctttgtcaaatgttttatttttaaatattcaagtcctactcttaactaggaggtttaatactgctgttggtaacctaccttggcaggtaaggattttctcctaaaatcattcttcaaatgtgtcttggcagtaataaaaaaaaaataatccagctaaggttttctttttagataagcactttaaaagaaggttgttacagcaagtgagaaacaaagggtgtgtgtttcttgatttataacaatcaatggcatattaatatattttttaaagagccagagtttttaaaaaagaatttgatttgagtgtcattttttgcttaggccaccagggggtgatatgcttaaagagacacagggagacgcggcaaaaggtgggttggctgcctctctggacaaaacctaaagataaaatgaccctgggtgaacaaaaagtatctctctgtctgtctgccttccccactgagacagagagagggtcaaaacaaaccttttgaggcttgctactctccttaggcaaggggtacatatcttacaaaaaacaagcatcttaaataagtcttgtgaataaatacatttccgacctgtgacttcacactcaggacttcactggacttaagtccttttcaaagcatttgggagacatgttggagatctcgggcaaaagcgctttcaccactggcgatctggcccccatcccttgtgtgatcatgtggtgaggtgtagtcctcagtttgccaagttatcccactcagtgagctggggagttctcagtgagtccagcacgcaggcaggaaacaagtggaacagcagacgctgccatttgggcaaggtggttctgttacagacttttgacgctatatttgaaatagctcaacatagtaagtcaaaaggtagtttttaaaatttgccttttaaaaatgttttgctttttaccatcaatgcacataaaatatcattcagcagtcacagttgtggatgtattaattacactggcaccctccaaaaagtaactctactacatctctggcaaatctaagtgaacctgtcttttattcttctgtatcatttgtgctcagtccccccagccccacccccaaacacacacacacgactgcccccaaaagagggagcctggattctgttgtttgttttttactaggtgaatttatgtggaaatacttctggctgaagcattgctcagtaaattgctgataaatgacttccatctggaatatacttggtcagcaatttaggaagccatgcagatttattttcaagaaactcaaactacttttcagacccattacccttgtgccaactaagtaaaatcccccctgctcctattctttgggagtcctgaaccgtagcataaaggaattcacaaaacacttgcaggaattaataattgcattctcgctcttattatgcaaagccttattagggcagagaaattaaggtttccataaattacagttccagaaggtccggtgcgtctggcttcagtaagccctcgtaacagcagcacaaagaggatcaaatattccagggctcagactttatcctttcctcatccagagataattcaaagagatgctcttcattagggccattggcaagctgcctacagtttctttttgggggctgctgtgagcttaatgatgcagaacaatggctttgcctcttgttgcacacatacctcattgtacctttaatcacattagaaaaacaacaccaccacataaagttgcctggtcattaaagggcattgcaaagagtgcagacgcatcagtgattggggccatgcattaaaagatgcaccaagacatttagggacactcaaacacttctatagggaggaagcctcctgcctacctggggtcgtaaggtcaggtcagacaagtatagcagttctttatgcttttatgataactgtggtgtccaggtggtgggggttgcagggcagtgtgaaacgtcaagacagggcctctgcctaccagaaatttgaaatttaacagttgcttcatgatttggaaaactttagcctgtcttgagtacctttgagtactcagaagcactattaaggtgaaaggacagggaagtaaggaagatgctttaaggttgtcaaggagtacagtctcctacttggataaattaattggcacaggagatctcatgttctgggagtaatgggatagggagcctcacagctcttgggctgtggctggaatccagctaagggtggttaccaggtgttggggccagggagtgggagttgggggtgtaaggatgggaaagtctgtggctctgtgggtttgatgccagtgactccagcacaggctaagcaccagccttgtttgtagccatgtactgtcaagtcaaggggacagccagtctgtggatgctttgaggagggtcttccaatggaggccaggaagaggggaacagagtgccaccccagccagtatcatttactccctccacctcttctaacatcgaccagagactttttgtaaaatggtgaccttttctaatttgatgaggcaacaaggaaataattctgattgggagttaagcttcaaactagaaattatgagtagcacattgtcctaaagtctgcatgcacattttcaggataaggaaaacttatctatagtcacaggactattcattactgacagccacagcattatttattgtgcacttactatgtgccggcacaatgctgagtgtcagctgtgcactttcccatcagatctgtacacaagcatgaagagataggtgatactgtcatccctatttcaaagagaagaaactgacatacaaaggaattatagtgggactgggagtcagatctgcactataattcccacatctgtgaattcttttcttgtataaatcattttccagcattgtcaatgaatgaatgatgatcaactttatagggaacctgcgggtcagtttccaaaaatcatgcttgcctttgtggggctaacataaagaccttggtgtctcagacaggcccaggtgctacgtggtacctcctgagaaaggttcctacggggttgctggtccttcatacctggaaagggtgatgtgcagagaaaaatgagctccggagtaacacagagttcccactggcttatcaggcaacctgaagaatgaatgatttgagaacgctgatgtccttttgcctctcagtaataacaggaaacatcacataagattaatttgtgcctcttatggcacttgaagttgttagctttgagaagcaaaaactttaccactaactgtgacctgccagaaaactatagatctgatacagatttgtgaccctttatacatcaatctcatagccagttggatagaaaaacacagatttccaaagtaaatactaatcagaatcaagtttatggagaagtctggaaacttgactttgcacaatcctgcttgcatattagctagatgcagtactcagatgagtttactgctgtagagcaaagagactctgcatcagctgagagtcagatgggtcacggttcgattaagtatggacccaattaatgacggttaattggatgaacataaacttgacctccacacagcagttttgaacctggcaaaattttcctgcaagtaggagtgtgtttgcttaaacagcctattaattctaaaagctttgttttagaagcagctttacattctgaattcatttaggcaaagtaggtatggaaaaagaaagctcatcttggccaggcatggaagctcatgccctataatcccagcactttgggaggctgaggtgggaggattgctcgagcccaggagttcaggaatggccagggcaacttgatgagatcccatcgctacaaaagaaaaaaagaaagaaatttaacttagccaggcatgatggtgcatgcctgtagtcccagctactcaggaggctgaggtgagaggatcacttgagcttaggagttggaggctgtagtgaactatgctggtgccactgcattccagcctgggtgacagtgacagagcaagaccccttctctgggggaaaaaaaaaacaagcccatcttctcctcccaccttgacaaacagggccctttattgaatatggagccagcatatggctgagaaagtcactttttaatacatggccgttatttgtcactaactgttgttttcttgttaattaacaatggattataaaccacttttatgttgattctgaaaagaaacgacctagggtgggaccagagattacctctcttctttcagtttgtctcctcttaagacacaaagctttagaggaccataaaggagttttccttcctttcccttaggactagggcttgatacccaccgtcctagcttaggtgtccttctgaagtattccaaggtgccctgcacttccttccaccttgtttccatatatatgttaatttggcctcccatgttacactgtaaactaggaagtctcatcaccactgttactctcagcacatggttggttgaataagttggattttgtagtgtttgttaggaagagtgaggagcaagaaaagaagaatacaaatcaggaatttagaaagagaactaggtgttgaatgaaatgaccatggtttggaccaaggaggtgaggatgtggaacagaggggacacaagacattcatttttcattcattcagccaacacgttcacccgacccaccaagtgctgagaaccgaggtgctcacccacttgctcactggctccccagtgcccttggaattcagtgaattaactgtggctcacagagccctgtgagatccagcctcttctgacctctcccataaacctcctgccctgctcatctgccctggtcctgcaggcctcctttcaagacccagaacccaccttattccttccttctcaagactttgcagctggctgttcctttctgcctgtaagttagttcaccaattcatctttgagctcagcttaaatgtccctctccctggaggcctgacctgacctaagaaaatcccccgacccactctaacctctctgtgcaccgctcctgtattttgttggcttgcttatcacctgttttcaaccccaacctcctggacaaatgtcagccccatgaaggtagggactttgcatcgttctctgtgaaaccccaggtcctggcacataactagtaactgttcaggatgtgtttaccagattaacttctgagtgagaaatgtatcaagtggatcccactttggtttgggaagggttttaccgtgacaaatgagtccatatccctggtctctaatggtttccacagatacagctgcacgttgccatgaggcagatggtacggggtcacaagggagaagacagcccctctctctgtgttcctgtcacccacctgccatggcatgcagaaggaaacatatggaatagtgaaaaaatccagctttaataaatgagttctcttgtgttcattaataatgcaggaagaggtcatggttaaatgtgggcggtggtgggggggtgggtaatgcacaaaagaataccgtcaacagttcggggtgaaggcacagcagagccccactaatcctgcattctccgaccagtgtggaattaagcagggaacagccttcactctctgaagcccacaaagccagtttctggcagtgccactgtcatttatgtgacaggcgtcataacgttggtaaaatgtagtcgagctgtgctgcggaacagctggtgctgccctgagaaatgtcaggaatgaatgtgtcctgcctagagtgacctgtttgcctacttgttcatcaagggcattttgagttgtgtattcattggtgaacttcagggaaaggatcccttttccatctactaattgcctgcctcatgggataatttttttttccaaatacatttgatgatattcatcagcttgtgataaagaatatgccaaaattatgcggaagtgaaagaatattattggcactaatgttcagttgtgctgcatgctggtcttgatttgagtggcagtaggaagcaaggacagcttttgactgtggaagagtctctggaagtttcttttaagtcattagttctcagagtagggtcctggcccagcaacagcatctgggaacgtgtttgttagaaatgcactttctcaggccccgccccagagctactgaatcagaaacgctggggtggggcccagcaatttgtttcacaagggctccaggtgggtttggcgcaagttcacgtttaggagcctatgttctgtattaaatcaaaaatgctggaagagggaggactgctaggtgacctaagccttctgacagattttcttgagtctttgtcggatgagtaggcagcaaagaagtcacatctcagacacttagatgtggatcaaaaatttagccatctgttggttaataccaaaaataaattgttttgtttgagaacttttttcaagcaaatagttctgtaatatctagtttacaagtagaaaattgaaggttattgaattttgtctgtaaaggagagagaatatataaaattttcagatacatctgatattcatcagcttgtgataaagaataagctgaaatagtgcagaagtgaaagaatatcattggcaccagtattcagtttgtgttgcacactggtcttgatttgagtggcagtaggaaataaggacagtgtttctgactatggaagagtctctggaagttgctgtatatacatgataaatattatgtatacattatatacataatgtatacatatgcatgtgtgtatatatatatctcaccatattctttctctgaatcactccaggctccagcattatcctatatcctcctaaacaagacaccccctgctcctacaaatactcccttcccagtagtaaataagaaagtaacctgattaatttccaataatgtgaatgatgatgggtagaattctcctgccggaagagaatgtatttttaagaaggaccttattacccaaatgaatctgaattggcagaattcttgtggaaataagtttgagcaggggcctctttctgatgagagctgtatagctatcaccataatgataggtcatgatttatagacaccacatctggggggctttcaggttacagcctgtcaattaaacaacatcattggtcaatctttagtgtacatttctagaagtcgatttttttgtatctgaggatgaccatttttaaaagtcttaataaagattgcccctaaatgagtctgtctgcgtaatacccaccagtgtataagtatccgccttacctcgctcttcaccccagtactcactgggtgagaaggggattctctttttttttttttcttcttatttgcctctttggtgttcagcttgtcaaggtgacagactggtaaaggatggaatcctgtttttaactcacaggattatatcagtcacaaggtagaaaaattccgctagggcagtggttctcaaacttgaactggcatcagaatcaccaggagggcatgtttaaacactgtgcgccacactttacccctagactttggatgcttccggcctgggaatcaccctttgaaatctactcctctaggataatcattattatataagactaagactgatgatggctgggcgcggtggctcacgcctgtaatcccagcactttgggaggctgaggcgggtggatcactaggtcaggagatcaagaccatcgtggataaatggtgaaaccccatctctactaaaaatacaaaaaaaaaaattagacaggcgtggtggcaggcacctgtggtcccagctactcaggaggctgaggcaagagaatggcatgaacctgggaggtggagcttgcagtgagccgagatcataccactgcactccaacctggacaacagagcgagactccgtctcaaaaaaaaaaaaaaatactgatggatgagtggatgagtgaaaggattggggaagagaaggcatttatgtgcctcttcagttctactagtgtcaaattgctttccatcattatggtagagaagttcgtgttgcttcacatccctgccaacacttggtattgtctgacttcttagttttccaatatagtgaatatgaagcggtatctcactgtggcttaaatttgcttcaccctgactatgaagttaagtatatatttatgtatattggccattttttagtttcttccttgtgtgtaaagtgcctgctccaactttttgcccatttctctgttggatttttcctcttctctgttggatttttcctcttcttccctggttgtaggatttggaaaaacatagtctggataccaacccctctgatgtaagtgttgtaaacatttcccagtttgtatcctgtctttgcatattctttttttttttttttttttttttgagatggagtctcactctgtctcccaggctggagtgcagtggcacgatctcagcttactgcaagctctggcctcccgggttcacgccattctcctgcctcagccttccgagtagctgggactacaggcacctgccactacactcagctatttttttttttttttttttttttttggtagagacggggtttcaccatgttagccaggatggtctcaatctcctaaccttgtgatccacctgccttggcctcccaaagtgctgggattacaggcgtgagccaccatgcctggcctgcatattctttatcatgttttctaatgaaccaaatctcttaatttcataaagtcaaatatatcccttttcttttggtttgtgcttgttgaatctttgctaggaaatgtgttttctctctctgagtcagaaagatatttacttatattttcctcccaaagttttatataaattttgtctatcacagttacttttttatatatggtaagatgttagagtccaacttcattttgtataaatacagattttctggtatatcttatagacaagcccatctcttcctcgtcacggggaaatgccagtttccctctgtggttggtaggtttaacaggcattcattgtaacattctttgtaattccatacgtgtatcttagaaattttaaaacttatttgacatttaagaaaatattaagaggagacccaagaataaatatcttttattaaaagcctccactaccccaaattctgaaggaaagtaaatcagaaatactaataaggggaagacggagtgggctggctgtaaacatctttacaaaaagtacaaaaagccacttttaaaaatatatatataaagcattcttcatctgtaaaaagattttctcaaactgtaacatttgttgtaaaagaagacacatctgtaagactacagttagaactaatgtttttataaacacatttcctaagtttacatgtttctagctaaataaatcttaagcaaaaagtttatctttttttgtgaacaaacaacacatgaaccaaatacggcaaacaaatgcttactattcacagcactaaaccagtgaaaacagaggtaatttgttagacatctgggagaataacagttttctcccagtgcgttaagcagtttaccataacacagacacattcctgttttgcctcacatgacaattattcccctcccttgcccaaaagtgtcagtggttgtggcacataacattagaagtgacatgcactttaataaagtaaaactctaaagaatatgaaccaattttcctttatcaagcagctgttttctattttgggagtctcaaaacagagaaattactatccttcataacaatatttcagttagcagcgggagatgaaaagcagcagctatttcccctcagaatcacaatggtattttatattcaaaattaagttccttttatctagttaggggatgactggcaggaataacttgtaatgcacatactgtacattttatatactagttactatatgttgcagctaactgcctccattgataagttcctatctggactaattccttaataagagatacctctgtttcctttgcttggtattttctcctttttatttctctctctggcgactttctaaatccaagatttatagcattggactgagtacctggaaacttcccagtatttaaagtttgagttgtttagcatgtctgtctaatctctccctccccagttaaattaacttgaactttttgttccaagttgcgccatggattggaacaggaagtagtggctgttccccaaagaggaaagggagggagtcaaccaccactgagaaattgaccaaaagggtccatgcatcctttttctcaaagttgtccatgaagtctcagaaccaactctactccatatccaaccatggttaagaaagccaggggagggaggacacagttccagtgttgtattttttatccttgaattaacaagtgccaacccaaattaatatttcagtgattttttttcctgtcctcataagaacaaagataaatagcttttgagtgttacttatcctgcacaggctttaaatgcatgagttatatccaaaagctcatgtatttctcacacagccccttaaaagtatagatacagttattatttccatttcacagatgagacagctgagggttaaagtagttgacaaagcagcctggagtcacacagctggtaagttgcagagacaagatcataacacaggactgtctgactccagtgactttgggcaggctccctcactcatcctgtcactcattccattaaaagacattagtgggcatctccctctagtgttctggaggaatgttccagtgtagtacaatggaaagaaaagtccctgccctcaaggggcttacattctagagagagatggggtcagaagttaaatactacactgctgagaatataattacaatgtggggtaaaggctctaaaggaatgtggttctactgcagaaacatcatataaagacccaaacaagaaactccgcccagttttctcctctgtaaaatggaagtacttgaccaggcacggtggctcacgcctgtaatcccagcactttgggaggctgaggcggggagatcacgaggtcaggggatcgagaccatcctggccaacatggtgaaaccccgtttctattaaaaatacaaaaaaagagctggtcgtggtggcacacacctgtagtcccagctacttgggaggctgaggcaggagaatcgcttgaacctgggaggcggaggttgcagtgagccgagatcatgccactgcactccagcctggcaacagagcaagactctgtctcaaaaaaaattgaagtagttttgtagctttagcagttaaattgaggtatcaaggtgatatcttatatcttgctcaagtggaagttcatcctgttttgttaaagcaggagaaggattccatttgcaagttaccacagtctagaaccacctgattgtcttaaaggcagcatttagtgagtgcctactatgttctccgggtcatatgctgtgctgagggacaggttaaaatagccacttgctcacagtgttcatgtcctacttcagaggacctccctctccctcagagcctcagttgtaaaaggggaaggcttgggttctttttatggctctgccattgagtgaccccggaagagtctctgggcctctctgaaccttaaactcttcttctgaagctcaggaatatgagctgtttctcctagggtgttaggagtgtccaggtgagctttaatgtgtgtgtgagtgtatctggaacccgtatggcacagtgtaggctctttatgtgggcatatagtcagcacttcatatctatgggttcttcatctgtggattcaaccaactgatgatcaaaaatatttggaaaaaataattccacaaagttccaaacagcaaaacttgaatttgccacatgccagtactatgttgaattcccatgatgtaggcattgtattaggtattataaataatctagaggtgatgtaaagtatatgggaggatgtagttggtatgccaagcctacaatagcaattaggacaagtatatggccatgtgatttaaactatatgggaggatgcaaatactctgtgtgccattttatatcaggaacttgagaattcatggatttgggaagatactggagccaatatctcatggatatggggagatgactctattgtctaataggccaatctaggggttgaaggaaaaagccagcatttctagagaaggtgggggcagccaggcttccaaaattgggtcaaagagggtcatctttatgggttgaaagtctcttgggggacagttaaaatgatgggaatagatccagaaaggtcaacttatgtggacatcttcagagatcattggtgctacatcattttcttgaaaggaacagtggagaataagggtttcaacagaagtatgtaaagccaaagcttcttaaaaacaatatatggtggtggaaatatgcagtacttttagggaaaattctcagattcagtatttgttcagtagggtatttattggacacctccagtgtgccaagtaggggcatccactggcaggactgcagtggtccaactaacaaggtcctggtcttagatggaggaaaacatccaccaagttttatcacacagatgaaaatgcaccagcgcagccagcacttggggtggccagtgccaagtgcaaggggaacaaaacagaggatgggacccagttacgatggccaggctgggcttcctgagtcatctcaatatggagcagtcagtgtcagccaggcatagtctccaagacagaaggagtcatggatttctaggaaaagcatttcactgataatactttaatgtgcatctgtgtcctacactgtctcgtatccagagagggccatgtttctaaggggctatcccaagtttgacacatattcctggagctaaagcaagtgaaaacacttaggaaagtatgaaagctctgtgtggatggtggtgtatgactctgcaatgtatattttaaagaagaaatgttttggaaagtcattaaaaatgttaaccacatccccctccaaactaaaaagctgatgaagggaacatattttcaaattacacatttaaaaacatatatgtttatatcaacaaaagatagcctatgttagacccagatatagttgatatgccaagcctgcgatagcaattaagacacgtatatggccagaaatgtcctctggacatactcagcggatggtaccgctgcaaaacacgtttttcaatgagctcatctgtaaggcacgatgaaacgaggtcaaagaaaagcttagagagcttcatactcacagttttaaactcaactgagaaaagatttaaaggaaaaaaaatccctgacccaaacaaaagcagggggaaacttagtgttgcctaaagcaactaaagaaaaacaccgcgttctcctggtggctgttctctgccgttgcgtgtgcaggggatccgtatttttgcctccagcatgctcatttctgtttctcagacccacacaccattttgctgagacaaagctgcaagtgcatttccacccagctgggcacacttgataactacactgatgcatcagaactataaatgtcacccccgtcatctccttgtaccctctgataactttactctttaaaaacttgttaacatcctttttccagccttacatttgacataatcaaagtcatgtacatgaactcccctctctctctctgaaaaacccctacgtttcctcaagttctaattgcattatcaagtgttttgtttggatcattaattccttcccagatgatttgctcctggtaggtttctagcaaattctacccatgtctaataaatcatcttacaaaatgctgcaggtttttctccgtcatagggatctagtccacacgctaattgctgtgcccctgtgaagttttattctcctacctctcactaaaagcaacccctttagcttcattgttaaaactctaacaattcgacaacaaagaaaagatttcagaactgtgctttggccaggccaagtccccagagtcatttcaagcttgctgagctggaatatacccagggttattctgtcatctaaacaaactttctccaggtgaacgcaggcaaggcatctgtctcttctgtgtcccctgttggacctgggagtcagggagatgaatgatccattgtcctgaggcaacactaccatgtaactaacctgagaacaagaaaatgaagtcaggaagttttaactgcatagccatagggtggggaaggacgggggcccagttcctgcttccaggatgtgataggattattggggctggagattgtggagttgtagctacaaaggctgtaaagcattcatagaagaccagatggggagtgatctgaaataattcagaagggtgtaagtaccagtctagtgaggttcctcttatattaaaaatcaacattatctaatttcccagtttctacaggtaaggaaattgaggtccagaaatgatcagtagtttcttcagatgcaagtatactattttgtttactttatcatttgattcccagcatgtatcaatggactcacctatacatgaatcttgcagtgtttttagcccagttcatactttccacaaacatgtttatttctgttcagttctccaaaggtattgtgggcctcctatgtataagtcaggtgttctgtgcggctaagataaggtattaacccaccattcttatttttaaaaatgtaatcacaaaaagcaaggatcaattattataatatggccatattttaaagcccttctgtgcctgtgaagtcgagagggtgagtcattttatttcccattttacaggtgataaatatcttaggatgtcattattattctttttgtgccatttgtaaatcacatttataaatctttgagaaagaagtacacacttaagtttacttttgattcatataggttctaaatcttcccaatttctgtgtcttccaccgtagatgtctccactgttagttattcctgctccttttcattggttcttcttgcaaagccaatatttccagaaatctgcaccaatttctcacagtgattgcacatttcaatggagatagatagcttggagacagtttatacattctactgataaaagttgtctctggttgcatggaagggtctcagcaaactgagaatattttggcaattcagtagatagagccagattcattattgcacataagcactcttcagtggaatattcatacatattacaaattaagtttgagctgatagggagggtttctttttctcttataacttagtcaacacagcagaagagaggcaaatattttctcctctagcctaaatttcaccaagttgagcaataatttgcaattaaaatacagaattttgacaaagtttaggacaaacataaagttagtttttgtgctttaattctgtatgtgaactagataagcaatgaaatggtatttccccgcacgtgcacacacagcatagttctccagaatagttcaattgtcataactcagtagaataaaatacggaccactgctcctcactctaagaaagcctgagcagcaagggctgccctgctaactgcaggcttctattcagttttccttatggggagaagcaagagggagaaaattatcaaaatttgcataatgaaaatgaagaaaatcacccatgataatgccactttgaactgttgatgttccttaacttacgatggagttacatcttaaaagtcaaaactaaaaatcatccaggtgtggtggctcatgcctgtaatcccagcactttgggaggccatggcaggagttcaagaccagcctggccaacatggtgaaaccccgtctctactaaaaatacaaaaaaaaattagctgggcctgatggcgcatgccatcaggaggctgaggcataagaatcgcttgaactcagaaagcagaggttgtagtgagccaagattgtaccactgcactcccgcctgggtgatggagtgagactctgtctcaaaaaaaaaaaaaaaaaaaaaaaaaaaaaaaaaccaaaaaaaaacaaacaaaaaaaaaacctaggcaggttaaagatggatatggtttggattttttaatatggttctaaaaacaacgtgggacagttcatgtgaagaacagagttttaagagcaagtgggtagagcttcccccactggggctagggaatatgcatccctttttgcagagagtttcagagatacaagattcagtggcttttctagccagtcacagaataaaccattcttccttctgcatccaaccttcctgtggggggagataaatgattccagagtcttaggaagcaaagtttctagaaataaataataccccaggttagggtaagaatagtaggcagtgtcctcaacatccacatgtacttgtgagggaagcccccaagaaggaacagtgacttgcgatccagagcccattacagaaagactatgtcggtatggcgtgatctagtagcagaacaattaaaattctcaagaagcccaggatctatctaagtcctaatttatttcaagcttttgaaatttagtgtttgcatttgctttgtcttgagacctcacacgtcaagtattttagcttaacaaagaataatgtacttggaggtaagaggccaagttcaagctcccaaactactatttagtagctaataacccttaggcaagtcacttactttctggagcgcttacggtgggagggctacccttcctgtcccatgtcatcctaattttttctaatctcttcttcacacagcagccaactcccatgatcatgtctctaaggtacaaacagaaggaaaaacaaacaaacaaacaaaaaaaacccttaatcttgtggattctccaccctcctcttaaatcatctcaaaatcaaagtcttttttttttttttttttggtgatgaaagtacctaaaaatctactctcttggcaaatgtccagtatgtgacacactattattagccatagttaatactaaaaaaatgaaaaaaggtaactataacatgatggatatgttaatttgcttgactgtagtaatcacttcattacacatatgtacaggtgttccttaacttacgatggagttacatcttaaacccattttaagtcaaaaatgcatttaatatttctaacctactgaacattgtagcttatcctagcctcccttaaatatgttcagaacactttcatcagctgcagttgtgcaaaatcattaaacgcaataataaaattttgaatatctcatgtaatttaatactgtactgaatgtgaaaaatagaaggattatgtggataccgaaagtgcagtttctattaaatatgtatctctttcactgtaaaagtgaaagatcataagtcaaaccatcataaattggagatcatctgtatagcaaaatatgctgtacatcttaagtataaacaatagaaaataaaaatattttttaaaaacaaagtccaacctgaagcctccaagagtcagcatagcctgcccttgcccatgcttccaggcttaacgcatgatagtctgcaccccactcacgtgcaccagcagcccatcagttgtaccaggttttctcctaccacaggacctttgcacatgcctttccctctcctctcttcctccccacttaaatcctgccctttggattggtgctctacacctgttcctcaggggacctccctctccctgccaggttttctttccttctctcagtagtgggattcctagcatccttctccttcaccagactgtcaacttcctagggacagcttccatttctagtcttgcccaccactatattggcagccccaggccgtgtgctgagcatggagacattcgcaatcattatttgaccaataaacaaatgaatgagccattgaatgtacagtgccaagcatactgcatggtacgtagaaaataacgcggaagtgttaagcattgctagagattcaaagaagcaaaagatgattcctgcaataaagtggctttagtctttgaagagtatttcaaatgcatgccatactctttagtttatcgctgatgtagaattatttttaaatgctgtctaggaaattggaggcatttgagaagatctgtcataatttatttagaatgttgattatggacaagccaactaatgattactgttataggaaaacaaaagaaaaaatagcccattctatcaacattcactggtagttttatattcatactggcaccaggctcttttaaactgagttgtttgttttgaaccactaaaaccatggtttaatatcaacagcattttcttccaaggatcctatcacaatcaatttaatgaaagtttttccacatggtctgtaaactgcaagatgaactagttggctatgcaggagccaaaattaattttgatcaagtgatacacatcataattttatttctttggatagaaaacaaaacaaaaaaaaagaacaaaaaagatgccaaaccactctttgtaggttacactaaaattctgaaacacaaatccacaagacccaggaaattctgtttacagtgaatcaactttagctttgatttttcctggcattcattggtttgttacctgacttttgtgtttaaggaattttcatagtcttgtaataagaggaacaaataaagtataggacattaagtccaatagcatttttcaaaatttgctttctaagattcaggcgcttcaaaaaatgtgtgatgttgcttgttttcttgctgctcagagatttctctgactctgagacatgactgacattacttttgtcttaactgtactatttttttatgccattccatcccaggggccttagacgttgcctataggacatttgtagggcaaacacattgagacaacttagtaagaaatgaattgacagaagaaaatcaatttccggtaggttagtgaagatccacaactagtgtttttctccatcctgcttgttaaacataccattcccaaggtgagttcctgggaaaggtcagtagactcagctgacttggttctcagggtaaagcgcacgtgcccttgccatggcatgcaccatgaacgttctcctttggcaagtatccttctcactggaacatcaccttccacctccgggccccacctctccctcttgttgatgactgccccttttcactacaccctcacatcttggcatcctacagtcaccggtgaacacctcggcctcctttgctttacagcccaggtcaggtaacagcactgccggctgtgctgctcggtggttagaacacgcatttcgaagccaggcagacctgggtcacatccccatttctactttcataagctgcacaacttttaggaagctgctcagcttctgaggtggtagagataacaccacctacctcaccagtgacatccttattctgaagacgggatgaaatcatgtgtgtgaagcatttattgcactgcccgacacagaacaaaaacccatgtgtggcgttcagtgtcatatccttgaaatggctcctcccatagacatgactgcaatataaactgcttttcatgggttttcttatgtgacttatttggagtatggtttttactgaaatttggcagctggactttttaggagcccaaacctaggctagtatttcccgaaaaagatagcgtttactgagtgtgctatgagccaggcgctcttctaagctctttacaaggaatcttcacaaccctgtttatagatgaggcacaggaagaggctagaaaatttgtctaagtgtgacagttataacaacagctgacattgggcactgtgccaagagctttactttaattacatcattcaggtatcacctatgaagcatgtacttaaatattcctcatattctatcgagggcactgaggcacacagagatggagtaatttacccaaagtcacacatctgataaatggcagagcacggacttagacccccatgtgtctcaccctggagccccagtgatgcccactctcacccagtgttactgagccttcctcaccactttatcaatacatggcacattgattctgcaaatcaatgaggataataaatagctaaccttcactgagcacttggtatgcactaggcatgaaccataactactttctatgcagagcctaattaattccagcaacaactctgtgagttaggtcctgctgttaacccattttacagagaagaaaactaaggcatcaagagatgaataacctgctcaagatagcacagctcacaagtgctacagcctacttgaaccccaggcaaacagacccaaagctttgcaccttgacaatggccctcatcagacgtagaactcctgcctgctcctctgcatcttcatgcagcatccttaaggctcctctaattttaaatgtaaatgactatggtgacacaaaatagaaaacaccattaaacgctctttttaactccgtgtgataacaattccattgatggaggactcttcctgtcctttcctctgatgactagaggcttgagagtagaaattttattgtagccagccttctagactctgatgaaaacagttaacaaattcaagtttattcaaggtatttatgagaccaatatgaagtttacaccagggagaggaaatggcataataaagcggccttcataaaggcttcgggcatgacgcttgcaaaaacctaaccacaccttcctccttcaatttgtggctgtatttgcctttacagcaagagataatgccaagggatcattaaatgcaataacattgacgtgtaaaaaagaagcatgtcatcttctatattgtgaacttaaagcatgcctctcccaattcaaggtgaaagccaccagcatcttaaatgaaatgtctgcagatgcgcagatgccctctgtgtctctcgtttttgtctgcgaaacagtgatagtagctgtacttcccttgtgtgaggattacatgagtaaatataggtagagtgcatagaatagtgtctggcacagaggaagtgttgtaccactgttgggtttatcatgattaaagtgtcaaaagctccagcattttatttgaagtattccggacactcatatataaaaaggtgagcaacgaagcacggagtggctgatagcgactttcatggactgttcaaccaggaagtgctctgggagacaccgttttcaagcccttttgctatagagggagctgagtcacccagcagccccttctatgtgtccagggctgaaatgcaggagtctggaggccagatcatcacctgctgccactatggtggactcccgacctagtgaaagccagaagcaggaccaccaccagcccatacgagcacttctgcgtgatttagaggaaggcttctcttcctctggatggacacggcctctagcccactgccctacttgccaccttgcctttgctcacacctcagcctacacatccctaagcaggggtactacagagaagttctaaaacagagacagacagagaaatcagttatccaagaaaagccactttgcatgttgtgattttctgtgaggtctataaacttgttatttcttgtctctttcctctctgtcatttttcacttgaaatggccccaccttgtcacttgcagtgcagaaaccagagacagcaggagagcttggccagagccacttggttattttgcaaacactccaagaccttctggacctcattttttcattctcgacaaagcagaggatactgtccttgatactatttttatcctatcaagaaatggtctagaataagcttaagagcaaaaccacttctcactgaatacttgtgtactttttactggagaagaccctcaagttgcaaagaacttaggagatgtagaagatagggagatttggctgtagaaacagcttgttgccaagtacttgccattggctttcctataatatctggagctactgcttcaaattatcacctgtaaggtgatgcaaaaatgtacatgttaatttttcgattcatactggttcagatatactgtagcttaatggacatttggatgccattgcttgaaatgagatttcatgtgatgataccaaggtttccaaaggagatactaaggtgggattggtatctgaaaagaaagtattttataaaagtaagtacatgtatgtttttaacctctaagactcatctgttttactaatcagaggctggtagccagatgtattctacatttaggaaaacagtaaagaattttaaaatgtgagacacatcagttagacacaaagacgacttttctaacaagaaaattacccaagctataaatttatctgtgcaggatgcttgaaatggagtaaggaggggatctgatggttgtaaaaataccaaatctagggaaataacatcaggatgcatttagaaaataccatggacaaactgctgaggtcccaactagaacccaacacatccatacatagaaactgacagctgtggcagtgccatctacagatctccatctctgaagtagacgtactttcctcagaaacacgttaatttgaacaccattcattcctgaaactcacatttcttcttaactgccataatacctgcattttagataagttgccttcccttctccaagccctagaggagactataaatttgaaataaattaagacagacaggagttgcctaaatgaaaaaaagacttttttttatccaacctaaatcagggcttgaaaccttttacttttcagtatatagtgtattatcgtctattgcttccagtgaattctatgttttaattagtttgaaaacataggtgtgatattttacagaatgaaatcactccccctgtatttaattaaatgaaccctataaaagttggattttagccaggggcataatttatactaggctgaatttaaaattgcattcgtactttatatgaggtcatttgcacatgtaatagaaatagaggtgactgtgatatgctgaacctcagaaagcaaatgtcccccataaataggtacttagtttctaatttggagagagtatagtatgccttttccaaatactacattctaaaatatcctgaactgcttacgattaagttgtagaaaactttgaaggctctctgggactctgtgttttgaaaggtgctactgtatgacaatagtttaacccatgatatttctaagtagaccgtgaaaaccaagcctctctctggtttatgggcccggctagcattccatcgtgtgtagtctctgagtcactcgatgtcttggtaaaacgccacccataatgcattcatctttccatttcttaagtgattcccatgtgttgtagcttcatttttcctccaagaacttctttcagtgacattccgtcagccaagaagggaactggtctcactaaataagctcagtaaattcttgctgaatgagtgaatgactgaaagatagacagatgggtcgtcagtgaaatttacctcccaaatggaaagctcgccagctttgtgttagttctcaggaccaactggaaaagacagctacaagtacctcctaggaagagcaacagcaatgttattccggcccaaattgaacccggaaggaatggttccatgccctcagcataattgtctgtcttgtctcaggagaccttatgctaaaggatctctttaaggtcccttagtgtcatgtcatatttgcagcagggatgtttgccttcagactaactgattggatttttgccataattgcacctaagtcccaggggaccagccagagccttaggtgaataatttaagcatttaatttataataaagtttgcaatcagcatttcttgttccaaaacattccatttacttggttttaaagctgcataaactgttttaaaggcaatctgctcaattgggcaagttaatgatattgaatttgaccgggccaaacgtcactgggtgcatcccgtctataatcacagccatcatcaccactgttttgtgtaatgtagatgcaatgctaatcctgagaataaaagttgtcattctcggttggctgacggcgtgcaccggagtcatcatctcgctaagagtctcagtgatgtgattccaagatgacagtgtaataagtgttatgtgcacaaggtaattcaaaacaaatttggctgcaaaaatggatcgtctaggatagtaaactcccgccttgtctcatcatcttttaagagaatgtaatgatccctaaaataccttgtcaagaagctcatgtggcaggggtcaagtcctgtaaaatttttctgttgcacccccccccctcctccaagaatcccaactcgagggctgaaaatatccatgtgcatattggtaccccagcaacacacaagatgggcagggagcttctgggaagtcaagaagccttacggcatacaaatgtctcttaagaacacctcactaggctgggttttgcttctttgatttatagattgtttcctcctgggaaaatgtgtctcttctactacaggatccccacgagcactggagtcttagtaaattcttattattggcatttaggcattaccagtaagttatctcatctaaactttatattaccctaaaaagcatgatgctatatttattttgcagatgagaaaactggaactgagaacagttaaattgcccaaagcccacagccaggattccaacgctggcttcatcccacaattgctgtccctgcacactccacctctgagctgtgaaaaaggaggaggtcatctggcttgtggaggggcttatttgaactgtatttgattgaaaactgcatgggctactaaaattgttttcttgggcacagttgtcagaaatgcgtttctgtggaacccagctgtaggcaggggggacattcttgtgtgggatgacagggcatttctcagtcaccccaaagtcccagttctccctttggggttgctactgctcttccctctgtaacctgggcagtatggatgctgttgtatcaatgccgtgtaacagtacccaaagctggacagattcagaacagctttcctgctttttgtaattgagtatgcctcaacacagaggagctctttgtagccaagaatgcttttagctttagactgatccaagcgggtccttcatgcatcattttcttggtaccatttaaacatccactcaatggtactagcatttggtttataaaaatgtatccaagtaaagcaatagttgccatcaccttgctataaaaatgaactaagatgtaatcctaatcagagaaggattttcactaattattttacccacatagaagaatgtctctaggaatgaatgagaaaacatttgtgcctaattttacaatatatctatgtgatatttacactttttaggatgttttggactgtaggtagttaatatccaagtcaaatgacctaaagtataaggaatgtattattgaatataacaagaattttggggataagacgttctaaacttggttaattcacttattcagtgatattattaggaccacaattctctcatttttctactctgccatcctcagtgtgttaagctggcctctgaggccagctccccacatggtcccaagatgctgccacaagtccaagaaagcatgcagatgacttgtctagaggcaaaaaatggccctttcctatctcatgtcctagtttagtcctagtttaaggatggacaaaacctcagagctccctagcagctctctcatcccatccaaccagccagaattatactgtatacccatgtctaaatccatcacgaggcaaaaggaccaagaccaccatgataggcgggagcccatcacaatccacacctcaaatctcccccagagggaaagatataggatctggtagaaaggtaacaaagagttcttttagcagagagggagcattggggtgaggatgggtgcgtgctgcccaggcagctgacattgcctgctctagtgtttgtaagaattatgtgtctctaaaaagtgtaaactcataggttcctttctggacacaactagaagatgcctggattctaattccccatcctctcctcacctagcttagtgttcctcttaagaagaacaggaagtcataaaggaaaaatatgccatagtaagaaaatcccattcttattcctttttggcaaaaggcctggtatttgtatactgttaaatagaagaagaacaaatttgacacatcttgtagcacccactcgaaaatcctaatatctgaattcattgtgggtataactaacgttggtgcaagccattcccagggaataccaagggcagaagaccagcgtgactgggtggtattgaccacagccacacctcctaagggtgctatatgttgcattaatttattctcagcaacaaatttgctgtagcattgtaaattcctgtattatgtgactcttggtgtcacacatttaatgaaagatatggctcaaatagtccggccccagcatgaattccacagcaccccaagttgtttttcatccccatctacaccccattccttcccatgccaagccctcagcattctagggtctaagcagggaagcacttaccaaggtcacttgggatagaaagctagaaagaattctttcttgtcctttcattcttttctcaaagggagaaacatggcaacagtcgtagtgttaaaccctgctttccaagtcctccaggatggggaatttaaaagtttggtggttcagacagttccttatttactggtgcactcaagtcattttgtgacccagagttcttttctgccgaactccctcgtgatgtaaataaattacttaagtggattgaatccaaatcattaataacctccactggcatgattcatttgggcttcattacaaggaaagaattcaacatctatttctcaacccaacagttgtttacaacgcacttcagcctaagagttgttgtccctacagggccagagtgaaagggtttgggggaaaaaaagagaaaaacagctttacaaccaatacttatgttctgcctggacatagggaaactgaagtgctctgaggatagacctaattgtcagcatgctttgaagtccaagatactaagggaggaaaatgtatatatgccaaataggaaaaggctgtggttcagtgttcattttgacatttataaatacatgctaaaaacatgcacattgcaagagtggactattaatctaagagatttaaactcaggaattgctatgaggagtgacttgaatgggtcagtgttctccagaaaaactttgagaagctgagcaacttctgcagccatgtgtcctatggaatatgattcctataccatcattttacatttgctttttaaaaaccaaccaaaccacttgaggaatactataatattaaaatattgtggagcctgatacattttatgcagtccaatcataagatgttaccagactttctgcatataaccacctgaacatagttcctttgttttatgggggaagggaaaagagaggataaattaaatcactggacttccatctaacttggaacgactttgatttttagaaataagactctgatttctatttcatcttatgtcagctgttctaaagatagctgggttgagtgagttttgattgtaccatttgggagaatcctggacaccgcgtccaacgttctgacccagcataaactagtaaggtcctctcatgaggtttgaggctctagggagggagatgatcttactttcagtcctgccaacttcacaggactatgatgagagaactgttgagaggtatcttcatttaagtcatgcagcagacagtagtcactcaataagtgcaggctttgaggatgcagtaatagcaaagcactgcacacagtgggaaccaaaacagcaattaagccagcggtcacttcccccaaacgctggccatttgaattccttctccataataacttgccatatgccgctatggcctgaactgtcatttacttaatattttcaatggactttttaaagagcgaaaggattattaagaggaaacttcatattacttccatgaagggaagactggtatcatctgacacaaactggaaaaatacacactattaaaacataacaatgtaatgaatttctagttagctattattgcctgataaaggctcggagcctgaggctggccttttctttcacaggcaagattagcaagtgatgaaattgtgttaaagacattccacggggaagctaagccttcccgctgtgagatttattattgcatgccagatctgaatacctccaaactcactctctttccaccaggcattcttcgggaaacctaaacacagagaactgaagttctctgacaccaccacctgcttctttcttttagctgcttacacatgaaagcaggcaattcatgtatttgtccttccgttttctgctttattctaaccttgtcccaccctaaatatttttccacaggtcaacggcagagacttatccagagcaactcatgaccaggctgtggaagctttcaagacagccaaggagcccatagtggtgcaggtgttgagaagaacaccaaggaccaaaatgttcacgcctccatcagagtctcagctggtggacacgggaacccaaaccgacatcacctttgaacatatcatggccctcactaagatgtcctctcccagcccacccgtgctggatccctatctcttgccagaggagtaagtaacctaatcttgaacccctaatgcattaagaagtatttccaagttggtttctttctcttctatgtggtgaaaaaaattaatgcaccctatagttttcctccaagttgcccatgtttaactttattgtttatagaggcaataaatcgaatcctgctcaaaaccgctccgacatattaattactttattataaccctggagcggacttattcaaattatatcctaagaacagaattacttacaaatgttgtaaaagttgtttcagaataaaatgtaatcaccccaaatggtaatttgaagatcctgcagttattactagggaatgttgatcattcttttaaatagacaaaaaagtaagttgtgtgtgtcaagagagccctggaggttgtgccttctgctttcttgggtctcatttcaagcctggatccatgtaataagcccgcacatgcctcatctaagtactgcatcaaccaattaaataacagctgcaactcagcacgccacatggatttctttacacacacctcttctctcaacttatttctgccagcgataaagagtccttcagaggcttcaagtcagacaaacctgatgctcaaagtgatttctagttgtggaacttgggtaacttactttgttttgtggggctgtatttttcctatattaaaatggagataacagtatcaatctcttatcattgaaggattaaatgaaacaatatgtgggaagtgctcatggggcatatggtaagcactcagtaaatggtaccagcgatcaccgttaatttagtgggtgatgtaaaatattcaggaaaaaatgaagagcaagacactttctgtgatagactgctggcccccaaggtgtccagttcgacatagcttttaacatagcttttcaaggccaggcgtggtggctcacacctgtaatcccagcacttcgggaggccgaggcaggtggatcacaagttcaggagattgagaccatcctggttaacacggtgaaaccccgtctctactaaaaatacaaaaaacaattagccaggtgtggtggcggtcacctgtagtcccagctactcgggaggctgaggcaggagaatggcgtgaacccgggaggcggagcttgcagtgagccgagatcatgccactgcactccagcctgggcaacagagcgagactccgtctcaaaaaaaaaaaaaaaaaaaagcttttcatgtgtgactttgcacatctgaggacacagcctctccagctgatgttagggtcgcccctgtgttttctcatctcagctccatctcggatcagatcattgacttgatacattatttcaaagggcattttcacctcttacaggagaatccactgggtaatacctgttggattcctactagtaactcagtagctggagtgagcacatgtttcctatggttcagtcaagttctggataaaggcttgcccttcatcccttggtcttagtggctagctgtcattggaacccaggactaattccccaggcttgacagagtaggtttggcagcagctggtagcataaagacagaggacagggcatccgtctcacattcactcacagtgtgcacatgtgcaaagaactattatctatctccttcatttctcatgactgtccctttatacagatgaggaactgcagactcaccaggttccactgagctgatggaaaggcaggtcagtcagaccccgactcccagctctgaaccacagtaccctgtagtgacccattccatcctctggaacaactggctgattcactgagtatgatgatccagaccatttatctgacgttacagaccaaactgcctcacattattgatgaagcctttaaggctacttctgactcttaaatgttgacctgtcacagtgatgggccttttagaagctaaacctgtaatttcctcttaggtctagttaacatgacatgacttatcccctgggggcgacttgagaaatgtcagaagagtccagaggtcaggcctcttcaggttctggctgcaaggtcagacaacagcaagagcgtgtgtcgggactgaatggggaatgttaagttgatgcttgaaagcccagaccttccaacagtatcctcagtactaaaagccctttaagtgcaggcagtatatttgcctgatgggtccagaaaattgaaagccagcccttgtttgaatggccactcatgtctgatctgttgtttcaaaactaagtgcctgggagggaagactagagcccattgattgctgtgctgacctttgaggacgtgaaggtttgggtccccagccaacaatcagaggctgaagctttgcatctggcaccgtggactgttaagctcctttcaaagctgctgatggagtatgttatgattcccactgccttggctccttgaggttgcattaatgacgtttccaaagatgtcgtgagttctgtggactgtgttttgcatatgttgtcctagggaaacataagcttccagtctcctagcagagtgaatgtgtgtgtactcattatatgtaaacatatacacacagatgcacttatgcctacatgtttgtatgtgcatttcaaccatgtaagtgcatactgtacgtttgtgatatcaaacatattattgtgggtaacattcaaaaagacacggtcctaggtaacagcagaacagtttcattctcagccttttgaactgatctcagaggccagcacatatcttagactgttgcctgggctcgagcctagttctctgcagagataaaatctaacaatgaagcaataagcagtaaaatattgtcctgtttcctgcgtagagatggagttagaaatcagtcacgctgaatcacgtgactggcaggctccgggatgggctctgcaaacaacaaagcccatcaggcttgcactttgcatcttaagtccttcaggaggaaatgtactaaaggcaaatggtaaaattaggatgatggaggtcctgaccgtgctgagagccccatccagagggaagtgagtcatgaaagggcccacaccctgggaattgctactgtgccactggcctgacaatgggtgtaagaaaaacagatactgacaacggaagaagggctgtaaagatgttgcatctcttttcaggcatccctcagcccatgaatactacgatccaaatgactacattggagacatccatcaggagatggacagggaggagctggagctggaggtatgaagaacatccttgtctcattttaggagtcattattaagaacacagaatgcctaataagttctctataagcataaattagtttacggatgccgatggaaagtaacaaaagcagaaccacttttactgatgccctttgaaaggcacaactgagattcttcttccttccttggaaacagagcttaataatcaagtcccaaaagcagaaatgtaaactttttttaatttgaatcacttaaaagttaggacagtaaatcctgttgtcaacctttgaatccacataatccatacattcttgtaactaacataagcctcctcaccttcctcccttttatgtcatcaccactctttactcaaaggcagatggctcaagagtaggtggataaattacttgagtgaatgctagcccgccctaacaaaagggtttgttcactgcttcacttgcttcaagtttgctaacattgatacagaagaaattaaacaagtctgcaactcttcttaagtgttatttgaggccacacaggaataaagattcaagatgctacataatgtcaaataggtctctgttaaggtttaaaatatttagaggacaccaggttgccaacagagttctacttcccattttccttttattaagggtgatagaaaatacagaaaacactaacttgtataatatatttatattttggggaaaacacttttatatttcaatggggtttcaaaaaatataacagcatttttgaaagctgattttatggaataaggtaaaaagacacctgatgttgacaggtaagcccttgggtaccatcaaaaggtcacccaggaaaaatcgaacattttatccaatttcatggctaactgttgtgtaatctatgctgtcctaccaatacttctgaagttgaattgttcagtggcagtaggttctgtgcaaggacagaagcagtcaaatagtagaaaacagctatgttcctcaacttaaagttaccaagagttctcattccaagacagaagttaaaaatcaataattgtgtgcaaacgatgacttcactgatggttagccagatacagtcaaatcaaaggacttgttgccagtggcatgactgactctgtgccagttttcagaaatttaaaattttccctaaatgcacctggtctaaacagcaatggccagtattctcactataaaaacttgactgtttctgcttgctgtcagccacttaccaaagcgcttgccatttaacaattgttccagaaaatgtagttttgtcattttcaaaaatcaggattctgcctcttatttagtgtcctatcaccccagcttcagggctgtttggtgaagcagccgtgactccttcaggacacttgttccttaatttgttatgtatgttccttccaaagggggttcataatgaaatacatttgggaaatgccagactgaagacaacgaaacagatttcttggaggacttctgagaatcttgactatctacctagaatcccctgggggagtgggcagaatttcccccacctctctggccaagtacctgtttatatttcctcagtctacagttctctggaacactgttggagaaacactgctctccaaacagagggctatttcgtaatctttatgggacgacactgctttttgatgatgtaattgtggcaaagtagagttcttttaaaaagctgtaaagtgtttcagaagctagagttatgaagtagtagagactttgtagtctttggtatttagttaaacttgactttgtagcagtgggttctttagttctttttttagtttctaatacctttgagaatctgatggaacctacagccccccgctctggaaaaatgctcctgtctgtgagagcttgcatatggtttcaggagattcactgagcccccacagtatctgcccaatttgggccattctgccttacagtttttccttatacctgactatcaccagaactcttacgtgctttctatttctctttaattcgactcaacttatttaaactacggtaattttattttaaaggaaacactataccactgcgtcaagcagaaagtcagcatccattgccttaaatagaaaatcccatacaattaaatacagtggacacaagccagtgttatttattaaatcctggtgctcaataagggtgcctgctgagggttgggagcctggggccactacatcctgccttttctctaaggagattagctagtattaaagaagtgttaagactagcccagactgagtctttctcctcaaagcatgaagcacctgagagcatcctgctttcagcaggagggagccactcagaaactgttccctagaaccctgttgttcaaagtgtggtaggaggaccagcagcctggctggtcaaagtagagttctcacctaggagatgtgggaactacagaaacttggccccctagatcttcagaatcagaatctgcactttaacaaggttcctaggtacctcggtgcccattaaagccagaggacccctgacctacaggccacagacccagataaagcagcccaagctatcatttcctcttgttctcttgagtcacaccagcgaggcttttgtggtgcctttcattcactgcagtgtcgagatgtgccgccaagtcacgaatattgtccacactgtccctgcagtgtaacattatcagggcctaggaacgactgagcccctcgtaggcatgtgacactgtgttcctaagactgcttctctcttttcatgaataaaagcagacacaacgcaggtgtttagaaaactagtctggtattaatattttaagctagaccttggatgccatcagactttatattcgtgtttattttcaattctgttcattttattgtctcttacattaaatatactgtttggccctagaaatgcaaaatcacgaagtcaccactctgcctgcccttaaggagctcacaagccattaggaccattagacattagcttttcgtttcttcttaaacaaccagaataagggcattctccatctctagcccctttgaatggttaccctagagtactctgagtccatagcagccaggaagtcttgctttaacattttgtccacagcaactcagatgtcaccaggtcatttctcttacctaagtaccttctcataaagtgaacctggcagttttggacagatgtcgtcctcagtcctgtggtggtgatggctcaggcctcctaggctaggaacatatcagctaaggcctactgcagccactcaccagaagggtctctccactagagaacagtagctgcgcctccagcattgctctgtttcagaggtgtgtctctctggtcagtcagttcaagaaggttaattaataaaccccgcatgctgagaaatgagtttcctcaagtgggcccagttttcagggagactggcacatgcctgtcatccctgcttctacacgagatttcttagaacagtcgcagtctgccttctagattccatcctgttttgttctaactcttgggttcaattttagaaaaatcaggctgttatttaagtaaggggccaatctcaacagaccacttatcatctaaattgaattggactaaagtcagcgccttccaaagaacagctagttccatggatattatatacgaggaaaatatgtatgagtgtgttgagatattattaaagcaaatgcacagagaaaaacagatggttctggccagacgcagtggctcacacctgtaatcccagctactcgggaggctgaggcaggagaattgcttaaacccaggaggcggaggttgcattgagccaagattgtgccaccgcactccagcctgggcaacagagcaagactctgtctcaaaaaaaaaaaaagaaagaaaaagaagaaagaaataaaagaaaaacagatgttctcccttttaaagtacacaaaatgatcatatttaggtaagtgtcaaatctctgttattatgagactgcttagagttaaagggattacacccagtgtaccctagggttgagcagacaaataattacccataaattttcaggcactgaacacctgctctacatcttcctgtaggcaattaagaaagaaaatacatgcccaaagaaggcttttccttttgtctattgttttaatttcccaggcgattcatcagtagcatcctatgtaggctgcgaaactgctgtcacctgtattgtattctcaggatgtgtcacctgtattgtattctcaggatgtaattctgagaccagaaaggaaaggaaaactacaatttcaataggagactaaaatgctctccaaacctggtttcatagaggaagctaagtatatcagaagggaaccaggattgacctggagattatgcaggatgccccagccagtctagaatttttttctttagcctttgaggcacaggacaaggaatagatctagggaacctttcctggtcagccccatcctggattgaagtggcttcctcattacttttcctgtgtaatcagggtctttgccattttttgtactatgcctgcaaaccaggacctacctcggcctgcgtggcagtgccccagatcgttacatgcctcaatcttttcccaaatgtcatctctccagaggatcttccctggctactctctgaagcatccctatgccaccagtactattatttacttttttttttgtttgttttgagactgcgtcttgctgtcgtccaggctggagtgcagtggtgcagtcttggctcaccgcagccgcctaggttcaagcaattcacctgcctcagcttcccaagtagctgggattacaggtatgtgccaccatacctggctaatttttgtatttttagtagagacagggtttcgccttgtcggccaggctggtctcaaactcctgacctcaagtgatctgtctgcaatggcctcccaaagtgctgggattacaggtatgagccactgcacccggcccattatttacttcttgtctttcttccccactagaatacaagctccctaagagctggactcttgtctaactcatttactgtatattccttttgcctagaccatgtctggcatatagtaggcacccaggaaatattttttgaatgaaggaataaaatgccttgttaccctatctcaaacataaggtccttgagggaaaatgcagtctttaaagatatttctgtatcccacatagcaccatgactagatacagaaactgttgagataacttaaatgtgcacagcaacctggaccagtaagttgaagagttatgctttagtggccagtcttcctggaggtggataaagcattgaaattagtctttgagatcccctttaattaaggtagctgatgctgcaacagagagtttgaatcaacaaggtggaatggccctcttaatactcttcattggaatatcgtttcaatttcctctgaaatgtcaggcttaactgttcatttttatcaacagtccatctagaccagtaagcaacaagataccagtaacaggggtagctgtaatccagataatgctactacattattcataccagtttgattaatagtcttctttgaaatcttatctccatcacagacagataacatattgataacttctatgctttcagcaatatgcttaattgtgtaaaactagatgagagtcacacagaaatgctgagaatttacaaaccacccagtaagtttgaggaattttactttccactgagccccaaaatactgtattttgttttaaaaccacagaatggctaagtttgtcgaagttcaatgacttgctcaaggcaacctccctcattacagatggagccaaactggtttttcatttggatcatcctgccttggactctcaagctcattcattcaattttattgagcacctactgtgcacagcatacaaatctagacactgctttcattgcacaattcatcattcagctactattgccttactgtaatctttataagaaaacaaggtaaaccataaatccgtacagatccagaggcaataccagctcttacactgttgtttttcaagagcttctgaaagcctattatggatcactctgtgcttaactgtcagcaaccagattcttctctgtgatgttgaaccatcccttgaaaattaaatgaccaaggctaagtggtatcctgtgccttctaaatgaagcttttctagcttttgtttagagttcctaagaagggccagagataaggcaaggaaatattatagcccacaccatcctgtctcacatccacgtcaagtaaatacctagagtaagctccagaataccctttgcttttttattattggaaatgtgcttcaccagcatttgttcatccaatatcactcatcctttgataacacagaccacttctaagatagaaaactgctcctggagtgctgcccttgaagtagaacactgccattcttatgtctgttttaaagatccagctgagaatgtgactgtccccatgacggtttgttctgagaggatttatgatgggtgttgaaggctaaacgcagcattgggctctacgccattctgctattgtgagggagtatgtgttctaaaatgaacactaactgggaacagaactattaattggaccctcttctctcccgtgcaaaaatatcaaactgcatttatggagaatcgattactaatttactaaacacaggtgaggttagtggcaacgtataaaaagtgtgtaaggaaggaagcgtaagtggttcttgattcagatgaaaatatcttaaagcaataaatgttttgaatatcttctgttgcagcctgaaactttgttctaagaaagttttctccctgattaaaaaaaaaagtcataaagatttgttggaggaattgacagattcagaaggaaaaatgtacagaaaaatcatgattagcaacatgaacaatgtcaactactctgtagcttaacagtcctccaaatctctgtcaatcaaaatactgacaaaagatagaacagaaatgcttttcaggttaggttttatcaaaactgtattctaaaatctcgtgatatcaggccacctacatgtttggtagtaggccaaataaatctaatcgttttctacataacagagcgtcactatcacattctttaggagtctttttcttgcttgaatacaagcaagaaatacaagcaaggaacgaaaatactcataccttacacctctcaaatggaacactcaaatctagaagtgtattacagagttgtgcttgtcagactgtactgaaaagccacaaggaccaggttggctggtttgtttacttttcagtctgtctctaaccaatacacggtcctactgtgtgtgactgtgtaactcaccccatctgcgacgcgttcaccaacacctgaactggtctacaccttgtccagtgagacaagtctgctaatcatgcccttggttatcatgacaatgtccagctgctatagaggtttctgaacacttccctcaatttctgtgctcacctcgtcatgaccaggaagcacgctttgagtagcagtagtagtagtagtagtagtagaaagtccagtagaactgtagaatcttctgtacttccttgaaagatagtcaccttggcggccagccattcagaaaaagttgcaacttgaattatcaacatttcttgtctttctcatttttcttcctacaatcttcccactgctcgctctctctgcttgggttgcacgtggacctgtttcagcaagatgtgtctcctgcaggggtagcactgggcgagctacatctgtgcagttggacctaaaccgtcgtgatatttcgttgattcacactaaccttgaggaaatgtcaaaactgaaaaagtgttccctcttatgcatattcaaatgaagtgtaccctaagagagacagggggatgtgtttgaaacataagaggatgatgtatgactagtatatttgtggaaacataagaggatgatgtatgactagtatatttgtggtatgcaaattggttattccaaagtatttggaaacccaagtatttaggcttgctctcattgttaaatatgacccttaaacccacttaattatcagaaattaatggggtttcatttaataagaacttaccatattgctagagctataattaggaagctgttgaattaattaacatattggtgttcagaaaataatcttagtaagaggggcactgaaatatacccactctgccacaaacaacttcttgtgacttcagggaagtaaccatacctgcatgtaattattatactactggtgaccgtggactttctatggggcagtcaatgtgctaagagctcttgtgtgcctcatgttggtgactctgggaggcaggatggcaggtactagtgaggacacggaccttagatataataacaagctcatgatcgagctgctagaaagagggagagttgggatctgaacatctgtctttacagttccaactcttccccaccacattataccccatatatcagcaagacagactgctgaaagtcgttaagatcatggcagtcctcacttaaaaccttttgatgggttcccattatgttgaaataaaatcttagctactcatgctggcctgtgggccctgcccggtctagctctgccacctggccaccctcagcccacttctctcttccttgaacatggggctctggccatgctggcctagggcttttgcacctgctgttgctccacctgggaagtgtccgtggcgcctggcacccgcctttcatcggggaaagttcaagaagtatcttccaaataactgctttgagcttctccgcatagacagctgcattctccttccccgctaagaagacccttgagagagaccacttggaaatagtccccagataaagtggcacgaagaccccatctcagagcccctccattctcctgcttggtgagcagataacactaaaaattagaccaaaggatctaccggagaacttatcacgtggcccttcaaataggcttgcagcttggagctacaaaaacttgcacaagtcattggcagagtgggcgggggagtgacttagcctggttacactgagagccctaggatggcaccctaaggctccaacaatttccaaagttctgacttcattctgaagcacagactaactggcaaatacaatagcatgtatcccacatttgggctcactttgcttttctcttatttaatttgcagtaatagcggctgaaactaatttctcaactgtaaatatcacagctgttgtggagaacattaattgcacgctatcacattaccctcctttcttggatcaatttatgtgtaatctgtttgcaagttctatgactgtgaatattaagggaacgcaatgtgaaataatctaaccaaacacattggaaacatttgtactgaaatggctgggtggtttggggtatggaaatattcttgtttgtggcagacattgaaaaagtgtttttgaaaagccctgccccagaagtcttgacgctgagtgaaatatgggtaatttttctttgggggatcaatgaaataactattttcaaaatgactttatattgagtgaaaggtcagaaatgccgtaggcattgatcctgtgtccataatcactttttgtttagtaagttaaccggccctacacagttgaatgcaaagaaatccagttcctcatttgaagataatatttttaaagcatttgacatcccctcaactcgcattgcctgctggagtctcactgggaatgcctttctttgtctaggaagtggacctctacagaatgaacagccaggacaagctgggcctcactgtgtgctaccggacggacgatgaagacgacattgggatttatatcagtgaggtacaaaggctgattttgtttttctaactatcgtatcaagaccaaaagggttttttttttcatgttcaccaaccctaacccacctcatcaagatctctttggaaagacacaaattattctgtccccctcatcacactccatggcgctgcatctttccacggaggttaagttctaatgccagtacttatggcaaaattacccttgagaagcctgcaaatcagccataaaatggagccgtttacatggttttgtgtgtttagccccaagggaagagcagattcacatttcccaactcgtgttcattgagtggaatggtggatggaatcacttacactttttaaagcctctctctctctctctctcacacacacacacacacacatttttttttctcttggtggagtatatatagttgacttcatataagttaaatgtgacttgtatgtacttatcaaactacatagatgcacgctgttttgatcttccttgagaagataatacaaatcaactgatttcagtatggaaactttacagtgcacacccatccttgcaaacacagaaacccaattttgtcaggaaataaaatttgtcgctacagaatgatctactagacttaataattatctctttggttgtatgtcattcaccaagcttaagttaacccatcctttctgcatttggggacatccctccccttaccagtcccccttgtcccaattatatttcaattttaaagttattttccaaattttaatacaagtatttggtataaaataaggtatagttgctagtccacataatgaagggtatcctttaacctgttctacatcattgatttgattttaattaccatgcatgcaacaaaagtcagctgtgcctcctcagatcagcagagcctgcacacactgctgtgtaacagggttgctacacagggatccaagaaccagccctagaaagggcttagaagcagatcagctcatgtttgcctctccttgcacgacactaagtcttgtttatttctgtgcaaaacagaaacacaggggtgagcatgactgtgttttagaaatggttttgaaagtgctgttgcttattttcatgcatgtctgcgtttgcgctgagatggtccatgtgtgtttcagattgaccctaacagcattgcagccaaggatgggcgcatccgagaaggagaccgcattatccaggtaagtccacttccaaacaatggcctcatgatgggcctatcactaaagaacaaactggttctaatgataggtctagggttgaaaatgcagaagcggttaaagaacagggatcacaaacgcagatgtgtagtgaggccagacaagttaaactaattgtgaggctatctctgagtcataagacgcaagagggagtggtgaggactgggacaaactagatggggcatgttctctccaaagagggccttgcaaaatttgagccagttctccttattttgtttcattctgtttggatcaaaacaaacatcagtgagccaaagtcaggccaacagtttacaacttgtgaactaaaataattctcgttttagatttctctgaaagattaactttggaccaagcatttcagaggctcgtccataaaaggggaacatttttggcaaatttagcagcatcgattgaaaagtcttagaaattttctgactcaacatctaaccatcctggaatcgcttctaagggtcattacttgacctcgagccctgttgctccgtctagtccaaatgagaccattcatgtctcttttggctacaaccttctttaatctcacagaattgaaattcttggcttcattgtgtccacaaggcttagctttctacctcttctcatccgtatcctctcattcttaatccactgtgtttttctcattgcatacctcaccacaggtcattttgattttcttcttccactgcctactctgggtttctctagccttcagccagaacctgtgctgctcaggatcgcttgccctagggaagtgacccaaaccttcacacctgaagggtcagggtcctcagcatactgcctcttttttttttttttttttttttttttgattgctggagttttccattaacctttactactgagaatggaagcactcagaggtactccaaggaatcccctaggttccagacacaatcctccctgcctccactgtgtcacagcaagcccatcttccttggtaattgagggcaatcactccaaccaatagagtcaccccttttgctgcctgttggctcactagtgtaaggaggcatatggaagcctccacttccaattcagtggaaccattgctgtgtcccctggaggcggcgttccaccaggactaagacctccagaccagcagggctcaaagtcaccaggacatgcaagcaaaaatcctgcaagagggttaatcaagtgtgatagtgagagtgtcacgcccacttgaccctccgcctggcccaaagaagtttaagtgtcaaactggggacacaaaacaccatgtataattctattccattttcttaacctcagtttgctgctttttcttctatattatccaataatgtctacatatactcctgcctgaatattatgtctaattgcttccatgttccctctgcagagcattatgatttttctcagtgccgtcttctggaggtccagccccttctgttcacaccccacacatcacagtcacctcatgaactatactcatggaggctcccttatagaccagagaaactgcattggtctgagcaagacctttccttcctaacatcagtattcttttccagctacacggaagttgtatgttctaactgtgagtgggtgacaaatgcaggtctgaaataaaatagaatgattttgcaccatctaatcatgctatttgtctccccactctccccaccccccctttttttttaaaagattaatgggatagaggtgcagaaccgtgaagaggctgtggctcttctaaccagtgaagaaaataaaaacttttcattgctgattgcaaggcctgaactccaggtaaattggcttcctacagatgaaactgggtctatatttctaaaatcaaaagatccccaggcctgcaaaagagcacctgagtattggctgcgaacttgaaggtgctttgttccctggaaatgtaatcaaacttgctgtgattcagaattcactttatgagttagccatttaaggttggttagatgcccaccctggcatctatactgcaggcccacgacgttcattaatgcagggatcatagggaaggaaaaggaaacagaattgaatggaaaacacaaccggggtcacgtcaagacatttgacttcccaaggcctgacatatgttccagccttgatctgtgcaggtttcatttacaatagcagagtatggggaattaaaacttgctctttcaaattaaaagaaacattgaatgataaataattaaaactgatatgaccaccgaataagtgctaggccctccgtggagcactttacacacaggagagccttcccaggagatggaagttcccagagattcaaaagttacccaggaaaggcccagaaggagggtgataaagcagggaggggttcaggcccaagtaatctgattcagaaacctctgtgttgtaataactccttccacaggaggaatcatgaactcacccaggtggcactcttgatccacttagaatggctccagcaacacatctagggcaatccagtagtagatctctttaggtatgtgtattagtccgttttcatgctgctgataaagacatactcgagactgggtaatttataaagaaaaaagaggtttcatggactcacagttccacatggctggggaggcctcacaatcatggtggaaggcaaaaggcacgtcttacgtggcagcagggaagagagatgagaaccaagcaaacggggtttccccttataaaactatcagatctcatgagacttattcactaccatgagaacagtatggggaaaactgcccccatgattcaattatctcccacgaggtccctcgcacaacacgtaggacttatgggagctacaattcaaggtgagatttgggtggggacagccaaaccatatcagtatgaaacccgattgaaaaagccgagagacagacagtggcatacggggcatctgattctccacagatgggagcctcatgagctcaaagggaacttcagcaatcatctcacccacagtcacagactttttcttaaagggccagatagtaaatgtttgacttgggtggccataccatctctgccatgactgctagactgtcactctagtgcaaaagcagccatagacaattatgtcagcgaatgagcatggctgtgttctcattcaactttttttattattatttataaaaataccaggctggattcagcccatgggctatagagtgccaacttctgaatagttcactcttttttgggcaaggcagataaaggcctcttaaaagtgatatccagccaggctcagtggctcacgcctataatcccagcatgttgggaggctgaggcaggaggttcacttgaggtcaggatgaggccagcctggccaacatggtgaaacccaatctctactaaaaataccaaaattagctgggcatagtggcgcattgcctgtaatcccagctactcgggaggcagaggttgcagtgaacctagatcgtgccactgcactccagcctgggagacagagtgagattctgtctcaaaaaaaaaaaaaaaaaaagtgatatcttgcccaagccaaacagctagttactgtatcagaaagaactcttttcacactgaaaatcatttttctatgggacctgttaaactcgtgtctggtccagcaagcaggtggaccagctaaatctacctgaccctcctacacaggtgtcctactgcactgaaggtagctgagatggatgaaagagtttcaccctgaaaaaaaaaaatcatggatattaaagacttccccagatgtagtgtagggttggaggtctgtttaatgtaagggttggatagtttcctgacttaacagcaaatcattgggcagactgcattttgatgactcttggaggaagccctagaaatattttcccccaaggtaatgtcatttttaaaaaaacataaatgaacatgaaaggaaacttctaaggcatgtgttggctgctcttgcctgcagctggatgagggctggatggatgatgacaggaacgactttctggatgacctgcacatggacatgctggaggagcagcaccaccaggccatgcaattcacagctagcgtgctgcagcaggtaacgcccacgcaccagtccctgacactctgccctgctgagctggaggaaaatctgcttcctccatctccctttatggtgctaaagaccatcagaagtccatccacctggaaggcagcaagaaaacagcctcaagtacttttctatttgagcaccagaccagtgaaatgcaagctggtactgtccctagctaagcttttaaatctaagcaacattgccaaagcaaagctgaccttctgataatttgtttggaaaacatatgcgttggcattaccatagattgcaaaaagccatgttttccaaagtaaagcaatcccctctgtttaacaggagctgcttggagctctctagctccctgctatgctactaccattgtcagagtcttaatgagccacttattgagtccttattgagttgaacaaggacctttatacatccttctacctgtgtactgattcatttaacagaatcattgagaatcattcattgagataaagtgactattatcctcattttacaaaactgaggacaagaacaagaataagtgacttgcccaggtagatacgggtaggtgtagctaaggcccacgctattgacgtggtcctactgtcagatgctgtcccttggccttagaaatgtacagcctgccctatccagaaaccgcaaggaaaggtcaaacctgagtacctgctgcgcaggcctccctcactgtgaccctttgttcttgtgtttatgcagaagaagcacgacgaagacggtgggaccacagatacagccaccatcttgtccaaccagcacgagaaggacagcggtgtggggcggaccgacgagagcacccgtaatgacgagagctcggagcaagagaacaatggcgacgacgccaccgcatcctccaacccgctggcggggcagaggaagctcacctgcagccaggacaccttgggcagcggcgacctgcccttcagcaacgagtctttcatttcggccgactgcacggacgccgactacctggggatcccggtggacgagtgcgagcgcttccgcgagctcctggagctcaagtgccaggtgaagagcgccaccccttacggcctgtactaccctagcggccccctggacgccggcaagagtgaccctgagagcgtggacaaggagctggagctgctgaacgaagagctgcgcagcatcgagctggagtgcctgagcatcgtgcgcgcccacaagatgcagcagctcaaggagcagtaccgcgagtcctggatgctgcacaacagcggcttccgcaactacaacaccagcatcgacgtgcgcagacacgagctctcagatatcaccgagctcccggagaaatccgacaaggacagctcgagcgcctacaacacaggcgagagctgccgcagcaccccgctcaccctggagatctcccccgacaactccttgaggagagcggcggagggcatcagctgcccgagcagcgaaggggctgtggggaccacggaagcctacgggccagcctccaagaatctgctctccatcacggaagatcccgaagtgggcacccctacctatagcccgtccctgaaggagctggaccccaaccagcccctggaaagcaaagagcggagagccagcgacgggagccggagccccacgcccagccagaagctgggcagcgcctacctgccctcctatcaccactccccatacaagcacgcgcacatcccggcgcacgcccagcactaccagagctacatgcagctgatccagcagaagtcggccgtggagtacgcgcaaagccagatgagcctggtgagcatgtgcaaggacctgagctctcccaccccgtcggagccgcgcatggagtggaaggtgaagatccgcagcgacgggacgcgctacatcaccaagaggcccgtgcgggaccgcctgctgcgggagcgcgccctgaagatccgggaagagcgcagcggcatgaccaccgacgacgacgcggtgagcgagatgaagatggggcgctactggagcaaggaggagaggaagcagcacctggtgaaggccaaggagcagcggcggcggcgcgagttcatgatgcagagcaggttggattgtctcaaggagcagcaagcagccgatgacaggaaggagatgaacattctcgaactgagccacaaaaagatgatgaagaagaggaataagaaaatcttcgataactggatgacgatccaagaactcttaacccacggcacaaaatccccggacggcactagagtatacaattccttcctatcggtgactactgtataattttcacttctgcattatgtacataaaggagaccactaccactggggtagaaattcctgcctcgttcaatgcggcaagtttttgtatataagataagtacggtcttcatgtttatagtccaaatttgcaaaccctacaactctgggtgtcataggtctattttaagggaagagagagaaaaacacccttactatcttggaaggcaatattaacaaacagagcttttttcaaatagcaattgtacttttctacctgtacccttttacataaagtgtttaaatttcagaaagatcttttattaagcatactttcacagaataacttgtttaaactatattcatataaaaaagttaaacacgctttttttcctgcctaaaacacaaatacaactgccagtatgtatttttaatggaaccctattttataatggtacgttactgaatgtgtttcatatgcgtgaccgttaagatattatcatttaggtgaaggtttcaactcaaaaccacccaacccggtggttaacgatttaatacatataaccaaaccggcagcgtttagagttgggatatacatttaaacattttcctggttaaggttcccaagagagtgtaaaggttttagcagaaagcaaaatatcttgcatctttatggaagtttaaagcatgtttgcaaatattgcagcccattgaaagaatttgcatgtacaggaaagttgtggatggagacggtttgtggaattttaagtgctcattgtagtaaacttttgctttgtagatttgaaggtacagacttatacaggcaagttcacaaaatcatgattagttacaaacagtaaaatgaagttaaaataaattattattttct

SEQ ID NO: 37820 - DNA, 55427 bp, Homo sapiens
gggcctctgattcatctttattccctccatcatctagacttgattttatttgtaccaaggagatgcgtgtctaatgtttttctttcttctatttctaggagggctgttggcctgctgctgtgctgctgaacagtatgcagtcctttcgggagcaaagcagttaccacggaaaccagcaaagctacccacaggaggtacacggctcatcccggctagaagagttcagccctcgtcaggcccagatgttccagaattttggaggtacaggtggcagtagtggcagcagtggcagtggcagtggtggtggacgacgaggagcagcagctgctgcggcagcgatggctagcgagacctctggccatcaaggttaccagggtttcaggaaagaggctggagatttttactacatggcaggcaacaaagaccccgtgactacaggaaccccacagcctcctcagcgaaggccttctgggcctgtgcagagctatggacccccccaggggagcagctttggcaatcagtatgggagtgagggtcatgtgggccagtttcaagcacagcactctggccttggcggtgtgtcacattatcagcaggattacactgggcctttctctccagggagtgctcagtaccaacagcaggcttccagccagcagcagcagcagcaagtccagcagttgagacaacagctttaccagtcccatcagcccctgccacaggccactggccaaccagcatccagctcatcccatctacagccaatgcagcggccctcaactctgccatcctctgctgctggttaccagttaagagtgggtcagtttggccaacactatcagtcttctgcttcctcctcctcctcctcctccttcccttcaccacagcgttttagccagtctggacagagctatgatggcagttacaatgtgaatgctggatctcagtatgaaggacacaatgtgggttctaatgcacaggcttatggaacacaatccaattacagctatcagcctcaatctatgaagaattttgaacaggcaaagattccacaagggacccaacaggggcagcagcagcagcaaccgcagcaacaacaacacccttctcagcatgtgatgcagtatactaacgctgccaccaagctgcccctgcaaagccaagtggggcagtacaaccagcctgaggttcctgtgaggtcccccatgcagtttcaccagaacttcagccccatttctaacccttctccagctgcctctgtggttcagtctccaagctgtagttctaccccatctcctctcatgcagactggggagaatctccagtgtgggcaaggcagtgtgcctatgggttccagaaacagaattttacagttaatgcctcaactcagtccaaccccatcaatgatgcccagtcctaattctcatgctgcaggcttcaaagggtttggactagaaggggtaccagaaaagcgactgacagatcctgggttgagtagtttgagtgctctgagtactcaagtggccaatcttcctaacactgtccagcacatgttactttctgatgccctgactcctcagaagaagacctccaagaggccctcatcttccaagaaagcagatagctgcacaaattctgaaggctcctcacaacctgaagaacagctgaagtcccctatggcagagtcattagatggaggctgctccagcagttcagaggatcaaggcgagagagtgcggcaactaagtggccagagcaccagctctgacaccacctacaagggtggagcctctgagaaagctggctcctcaccggcacaaggtgctcagaatgaaccccccagactcaatgctagtcctgccgcaagagaagaggccacctcaccaggcgctaaggacatgccattgtcatccgacgggaacccaaaggttaatgagaagactgttggggtgattgtctcccgggaagccatgacaggtcgggtagaaaagcctggtggacaagataaaggctcccaagaggatgatcctgcagccactcaaaggccacctagcaatggtggggcaaaggaaaccagtcatgcatcacttccccagccagagcctccaggaggaggagggagcaaaggaaacaagaatggcgataacaactccaaccataatggagaaggaaatggccagagtggccactctgcagcgggccctggttttacgagcagaactgagcctagcaaatctcctggaagtctgcgctatagttacaaagatagtttcgggtcagccgtgccacgaaatgtcagtggctttcctcagtatcctacagggcaagaaaagggagatttcactggccatggggaacgaaagggtagaaatgaaaaattcccaagcctcctgcaggaagtgcttcagggttaccaccaccaccctgacaggagatattctaggagtactcaagagcatcaggggatggctggtagcctagaaggaaccacaaggcccaatgtcttggttagtcaaaccaatgaattagctagcaggggccttctgaacaaaagcattgggtctctattagaaaatccccactggggcccctgggaaaggaaatcaagcagcacagctcctgaaatgaaacagatcaatttgactgactatccaattcccagaaagtttgaaatagagcctcagtcatcagcacatgagcctgggggttccctctctgaaagaagatcagtgatctgtgatatttctccactaagacagattgtcagggacccaggggctcactcactgggacacatgagtgccgacaccagaattgggaggaatgaccgtctcaatccaactttaagtcagtcggtcattcttcctggtggtttggtgtccatggaaaccaagctgaaatcccagagcgggcagataaaagaggaagactttgaacagtctaaatctcaagctagtttcaacaacaagaaatctggagaccactgccatcctcctagcatcaagcatgagtcttaccgcggcaatgccagccctggagcagcaacccatgattccctttcagactatggcccgcaagacagcagacccacgccaatgcggcgggtccctggcagagttggtggtcgggagggcatgaggggtcggtccccttctcaatatcatgactttgcagaaaaattgaaaatgtctcctgggcggagcagaggcccagggggagaccctcatcacatgaatccacacatgaccttttcagagagggctaaccggagttctttacacactcccttttctcccaactcagaaaccctggcctctgcttatcatgcaaatactcgggctcatgcttatggggaccctaacgcaggtttgaattctcagctgcattataagagacagatgtaccaacagcaaccagaggagtataaagactggagcagcggttctgctcagggagtaattgctgcagcacagcacaggcaggaggggccacggaagagtccaaggcagcagcagtttcttgacagagtacggagccctctgaaaaatgacaaagatggtatgatgtatggcccaccagtggggacttaccatgaccccagtgcccaggaggctgggcgctgcctaatgtctagtgatggtctgcctaacaagggcatggaattaaagcatggctcccagaagttacaagaatcctgttgggatctttctcggcaaacttctccagccaaaagcagcggtcctccaggaatgtccagtcaaaaaaggtatgggccgccccatgagactgatggacatggactagctgaggctacacagtcatccaaacctggtagtgttatgctgagacttccaggccaggaggatcattcttctcaaaaccccttaatcatgaggaggcgtgttcgttcttttatctctcccattcccagtaagagacagtcacaagatgtaaagaacagtagcactgaagataaaggtcgcctccttcactcatcaaaagaaggcgctgataaagcattcaattcctatgcccatctttctcacagtcaggatatcaagtctatccctaagagagattcctccaaggaccttccaagtccagatagtagaaactgccctgctgttaccctcacaagccctgctaagaccaaaatactgcccccacggaaaggacggggattgaaattggaagctatagttcagaagattacatccccaaatattaggaggagcgcatcttcgaacagtgcggaggctgggggagacacggttacgcttgatgatatactgtctttgaagagtggtcctcctgaaggtgggagtgttgctgttcaggatgctgacatagagaagagaaaaggtgaggtggcttcggacctagtcagtccagcaaaccaggagttgcacgtagagaaacctcttccaaggtcttcagaagagtggcgtggcagcgtggatgacaaagtgaagacagagacacatgcagaaacagttactgccggaaaggaaccccctggtgccatgacatccacaacctcacagaagcctggtagtaaccaagggagaccagatggttccctgggtggaacagcacctttaatctttccagactcaaagaatgtacctccagtgggcatattggcccctgaggcaaaccccaaggctgaagagaaggagaacgatacagtgacgatttcaccgaagcaagagggtttccctccaaagggatatttcccatcaggaaagaagaaggggagacccattggtagtgtgaataagcaaaagaaacagcagcagccaccgcctccaccccctcagcccccacagataccagaaggttctgcagatggagagccaaagccaaaaaaacagaggcaaaggagggagagaaggaagcctggggcccagccgaggaagcgaaaaaccaaacaagcagttcccattgtggaaccccaagaacctgagatcaaactaaaatatgccacccagccactggataaaactgatgccaagaacaagtctttttacccttacatccatgtagtaaataagtgtgaacttggagccgtttgtacaatcatcaatgctgaggaagaagaacagaccaaattagtgaggggcaggaagggtcagaggtcactgacccctccacctagcagcactgaaagcaaggcgctcccggcctcgtcctttatgctgcagggacctgttgtgacagagtcttcggttatggggcacctggtttgctgtctgtgtggcaagtgggccagttaccggaacatgggtgacctctttggacctttttatccccaagattatgcagccactctcccgaagaatccacctcctaagagggccacagaaatgcagagcaaagttaaggtacggcacaaaagtgcttctaatggctccaagacggacactgaggaggaggaagagcagcagcagcagcagaaggagcagagaagcctggccgcacaccccaggtttaagcggcgccaccgctcggaagactgtggtggaggccctcggtccctgtccagggggctcccttgtaaaaaagcagccactgagggcagcagtgaaaagactgttttggactcgaagccctccgtgcccaccacttcagaaggtggccctgagctggagttacaaatccctgaactacctcttgacagcaatgaattttgggtccatgagggttgtattctctgggccaatggaatctacctggtttgtggcaggctctatggcctgcaggaagcgctggaaatagccagagagatggtgagtatgagaaatctcttaccagcttgggatttttatttcatttggttccttttcttgcatgtttttgttcttacatgtcacatgattattcctccaaattaaagtgcctatgcccatgtgatggacagaaaatgaaataggtaatttggaagatttgtatagacttctaaaatcgtttttcattttttgaaatgtataatgcttatgaagcatattattatatttcaagtttcttgggccacatcttttctaacgcacactttccagttaggatatttattctttggatctgtttcataacttatcctggggcagatcatcaacatcatcatcttcatttctttctctcctctattgaatgttctgtttcctgaatcccatttcttcctcattcttaaagtgagccttcatttaagggcgtgcatcatcctttagtagttttgtgagaaagggtgtgtgggagtgtaaaaatgttgagatcctatatatctgagcatgactttatcctagcctcatgcttaattgagagttggctaggtgtggaattctagattggaagtgatttttctctcactgtcttgcagtcgttcttcctggtttgtccactagcttccagtgctgcagttgagaagactgccattctaatttttcatcccttgatgcatgttctgtttttcttctggaaagtttgaggatcttctccttttccctagggtcttgagatgtcaaaatgataggtcttgactaggtcatttcatggttgtgttggctactctatgagatcttatgtacgctgatgtctttcagttcaggcaatttgtcatgtggtagttctttgaaaatttccttccctctattttctctgctctctttataattcctgttaatataaggcattttacctcctggattgatccgctgtttttatcttttctcctctgttttatgttttatctcattatctttttgttctgatttctctatgctttcttcagctttatcatctaatcttttttgtatgtgggttttgttttggttttgttttgttttgttttgttttgttgtcactcaggctggaatgcagtggtgcgatcacagcttactgcattctcgaactctggggctccctggtacctgggactaaaggtgtgtgccaccatgcccagctaatatttatattttttgcagaaacaaggtctcactgtgttgcccagagtggtctcaaactgctggactcaagcaatccttccacttcggtcttctaaagtaccaggattataggcatgtgccacaagccacagtgcccagccttctagccttttatttacttattttttttcttgatattttgaagagctttttttttctctgaatgtactgacttttaaagaataatcagagcctagttgatggctataatcgtttctcttgctttttgaatacattataacgtattttttgtttttgtttttgtttcagtttcatgcccttacccaggctggagtgcagtgatgtgatgatggctcactgcagcctccaaccactgggctcaagggatcctcccaagtagctggaccacaggtgcatgccagtacacctggctaagttttttactttttgtagagacagcatctcactttgttgcccaggcaggctggtctcaccacctgagcttaagcaatcctcccacgtcagccttccaaagtgctggaattacaggcgtgagccactacacttggcctgtactataatttttaaaaatctttgtctgtttcctattttctctttcttgttagaggttcttcagatgtcttgatttttttttctttattgagatggggtttcgctcttgttgcccaggctggagtgcaatggcgcaatctcagctcaccgcaacctccgcttcccaggttcaagcgattctcttgcctcagcctcctgagtagctgggattagaggcatgcgccaccatgcacagctaattttgtatttttagaagacatgaggtttctccacgttggtcagtctggtctcgagctcctgacctcaggtgatccgcccacctcggcctcccaaagtgctgggattacaggcttgagccactgcacccagccttgatttatatttttaagagagaaagagatgttttaaaaaatgacttgaagctctctgttacagtatgggccaggcttgctagcctgtagtcctctccgtagaataataaggcagccagccagcatatgggtcttttttctgagttgagttttcccagaggaaaaaaaaacatttttttttttgttccagagaaaaatcttgagatttcctgtctagagatgcaagcttggctgccagcgtcctaaaagccaagtggagaagaggatggtagggttgtgtgggtggggatatgggctcatgattcagtgcgcggactttgacaatctcccgcctgttttcagtggatgagaacagttacctggttgaactgggttaaggatctaactcctcttagaaactttgggctaatgctctatttttcagccccatgttgcacccccacttactgaggcctccccaagctctgtgccctaaagtggctggctttctgggggctcctccactgcactcatcattactgtctgcttccttgcagtgcacagaatcactgtcactcacttcatctctcatgtttccagcttcccattgctcatggtgtcatgagtttatcttgcaagtttatccactttttcgtgggaagggatcagatggatgtacaactgtatgtttagtagtctaccatattatttataaccttctggcaaaaagaagtgcccatagactatagtaaaaattatattgaatgtgaaatatatatttgaaattagaacattttaattcagtcatgcaaggagcttgccctttactcttatcatgtcccctatctcccaattacggtcttttctttgtgcctccttccctgtctccattattaacatcacggtgaaactccaagtttgaggtagaagattcacttcccctaagaagtttatacacaatgacattttaaaatgcaaagatcctaggaggatgtaacatttaagaccctcaagtacaaaattctttagtcaaatttgagcgctcaaaataatccgttaatcatcctcttgtcaaagttgagttcttgcttcccaactttccttggaaagtcacagtatttggtgggttttttgttgtttgttttttgagacagaatctcactttgttgtggggtttcaccatgttggccaggctggtctggaactcctgacctcagatcatccatctgccttgacctcctagagtgttgggattacaggtgtgggtcactgcgcccagcctgtttattgctttttgatgtgcatatgtgtatgtgaccatctgacagtgttttcgttatttcaacatttattattaacatatctcagcccagtttttttgtgtaaacttttaggtgttctatagcaataattgataatcagtaatcaggctaaatcttccccagcaaatctctagatcctgtgtctcaattcaggtcttgggccgagcatgatggctcacgcctgtagtcccagcactttgggaggccgaggtgggcagatcgcctgaggtcaggagttcaagaccagcctggccaacatggtcaaaccccgtgtctactaaaaatatgcaaaaattagctggacatggtgacaggcacctgtaatcccagctactcgggaggctgaggcaggagaatggcttgagcctaggagacggaggttgcagtgagccaagatggtgccactgcactctagcctgggcgactgagtgggattcaatctctaaaaaaaataagaaaaaagttaggcttgttgtctctttgagctgatgtaccactatcactataagatccgtttctagcttttatttacctagcttttattctacttttctcagtgcactcaaggacaaattaaaattacactaacttgccttttatttaatttgacagatgatgtttcaattgtccaggatactttgagtctagttttatcttactaggttttagcagatagatgcattcagttttggtcttgcttaatgagcatgcccttaatcctatcatgtaagataaagtcacatatatttcattagagatccattttggcctatgtatttatcaggtgttttgacaagcacgatgttatattaaaatattgggaagtcctcaagagacattgctcctctccctgtgtcacactactctgaaaattgccgaaaactagaacatttctatatttaaaaatggtgtttacttcccttcctttttcccttcctttttcccttcccacaagtgtgggacttgtgaatctattcatttcagcacaagtcccctttgcttctgtccaacattgaccactgtttgccttggtataattgtgtatgagaatcacaatgacctctgacatgaatgatattacagaggtaattgcctctgaatgggtatggatataacttggtatgtacaaatcacctttgagacattaaggaatgccaaggcgtgcagggatgtgacagaaggtagatctggtggccatggatcccttgaggctggatagccctactagtgggggagtcggggagtctttgcttgttcccctctcatagaaggtgcccctcccaaatttttccaaccccccttgggaaacttttaatcttttttttttacctgacagtatatgttaactggttttaggttaatttttattttctatttttatttttattttgagatgagtcttgctctgttgccaggctggagtgcagtggcacaatcttggctcactgcaaccacctcctcgtgggttcaagtgactctcctgcctcagcctcccaagtaactgggactgcagtcatgcaccaccacacctggctaatttttgtatttttaatagagacagggtttcaccatgttggccaggctgatctcaaactcctgatctcaagtgatccacctgcctcagccacccaaagtgctgggattacaggcctgagccactgtgcctggccaattttctttaaatttctgaatcaatatattaaagattatatttagggttttttttccttgattttttgagacagggtctcactctgttgtccaggctggagtgcagtggcatgatctcggctcacggcaacctccgcctcctgtattcaagtgattctcctgtctcagcctccccagtagctggaattacaggtgcgtgccaccacacccagctaatttttgtatttttagtagagacgggatttgaggatgttggccaagctggccttgaactcctgaccttaaggaatccaccctcctcggcctcccaaagtactgggattataggtgtgagccactgcacctggccagtttaggggcttatttttaatacaagtttaaataatggataattatttacttcccccatctaacagactcacatctttcttaaatttactttaaattgtgatggaaaacatgatttggaaaatataaaatagattgattacattatgaaaatgaaatcacatattaaaacatcaaaacagccaagtcagaaaggtaggctctctagtttaactgtaaaatagagccaccagtctacatgctctctaaattctcaactatatgttccttgaaggtggtcatttccagggcctggcaaggcccccatcctggtgaaggctcccttcaactcctgttctctgctcctaactccagtacctcacccccacccctacctgattgttcttcctctgtgcttgctacaactgccctttctcacattcccacactccctttctccattctcctctccctcccagccccctctctctggcaagcacttgctttttgttacttctgctgggacccatcttcatttctcactctctaggcggtggcgccctgttcccatggctttcagtatatagcagagacttgtatctaatttacctgtttttcttaacactgtgtggtatatctttttatatcactgcatgatgacattgacactaaatttccagagaaaaggttcattttctttcaggatttcgtccaaattctaaggaatcaagtgaaattttcagttttgaattttattgcatatattaccttacagaataaatcatgacaaattgaaggactcaaattttactacgatttatttcttgactttttttttctctctagaggtagggggatgatgtggggagcattacacttgattttaaagtaaaatttataaggagtacacgattctttggccaaggctgggcaaggtggcttatgcttgtaatcctagcactttggattacctgagcccaggagtttgagaccagcctgggcaacatggagaaaccctgtctctaccaaaaatacgaaaattagccagtcttaatgacctagtctcaaaataaataagtagagaaaaatattcaaaaaaatcccaaaggaccataaacaaaaatattgataaacaagccacaacacacaagttattatatgttaattactcatccctgggatgttaaactagttattgctaatctgttaaaagagctaacagcaaatagtatgtaaaagcaggcatccctttcaattcaacaaatatcttgagtctctactggaaaaccagttgaaatgtgaagttaaactcctgtcagggaacttgcagggtgactcagcctcagcctcggccccttagctggtgtgtggttagagaagctctatgtcaaggcttctgaacttcatgcaggaaagtttgtgtgattctgcagaaagcaatgccttgccgcacacaggtcctgcactagggcttcgatttttccaaaagatacggcttgcttcatccaatactgtttcaggaaaatggaggttcctcctccgcaccccaagccaaggccaatttcgcgggaccctcaaggcttgctactgcagatcagattcgtccaatttattggaaaaacgtatgagaagagaaaatcaaggcagctaaacacttgccccggaaggtcctggcttttgccgttctcctcaacagctgtgtagaggggaggcctgggtgagagccccagagtcacactgcttcatatgaattccaggacttgttgtttccttgcgaggtcactagctcaagtcacttaacctctgtgcttcactgtccttaccatacaaagtatgaaaactgacagcacctacagtaaagaggtatgttaggaggattaaatgtgttgctctttggaaagtgcttagagcagtgtttggcacatttcaacagttaggtggtttcagaggaaatgcaagctgcagactggtgaccgccctcagatggtgtcctccctcattgttgtcttagtaaagatgtgttcctgttagcaagctcactcagtactctatagcttatgttgtagttccatcatagtgcagctagctcatcttgccaggggtgttcagaacttaatctctttgaaagttgtccttggtggaaataaaaacattatctcctttttactcttgttggaaactcaagtttgctgcggggggaagggtggcagggtgtgaggtatttcaggtgcagtattaatattatgtcttatgaaatagcatcagccaacacgaacacactcaggaattatatctctcaaaagacagaaggcaaaagggagggactaaaatctaccttgcatgttaagtaaaagcattaacattctagtgagatgacaaagttttgatagcgattatctaaagcgaaagaaaagaatctgcctggtagtaaagttgggtttttttggtttggttttgttttttttttgagactgagtcttcctctatcccccaggctggaccgcaatggcacaatttcggctcactgaaaccttcgcctcccaggttcaagcaattctcctgcctcagcctcctgagtagctgaagttgcaggcacctgccaccatgcctggctaatttttgtatttttagtagagacggggtttcaccatgttggcgaggctgatctcgaactcctgacctcaactgatccgtctgcctcagcctcccgaagtgttgggattacaggcatgagccaccgcgcctggtctaaagttgtttttttaagtaaactttttaacatgtcagcactaaaaggcccaaaataattaagaattctgagtttgtgtggtgtatccacagaatgattcaggacaaatacttccctatagcattccacctcctcccctaaaacagtgaatatactgagaatatgtgaactccagagggcttgtattagtccgtaaagaaatacctgaggctgggtgatgtatgaagaaaagaggttgaattggctcacagttctggaagctgtataggaagcatgatgcctgcatctgctcagcttctggggaggcctcaggaaacttacagtcatggagggaggtagagggggagcaggaaggcttcttgcatggcaggagcaagacagagtgaggtgcgaggtgttgcacactttcaaacaaccaggtcttgtgagaactcagtatcacaggaatagcacccacatgatccagccacctcccaccaggccctgcctccagcattgggtgctacagttcaacctgagatttggtgaagtcacagatccaaaccatatcagggatctattgtatttgaaggatttagcctttaatttacgggcagtgcaaaaccattagtgatttctaagcgtgtaagtcacatgtacaggtttgtgttttataaaggaaactcaggaaataagtagggagacatcagaagcagacaggtcattcgagaggctgtgggattaatttgtgcaagagctggtaaggaccgagtatgtggtagaaacgggagtcagaaggattggatggatctgagaaacgttttagggattcaaagttgatagacttttttttttttttttttttgagacgaagtcctgctctgtcacccatgctggagtgcagtggcacgttctcggctcactgcaacctccaccccccagtttcaaacatcctcccaggcctcagcctcccaagtagctgggattacaagcatgtgccaccatgccgactaatttttgtattttttagtagagatggggtttgaccatgttggccaggctggcctcgaactcctgacctcaggcgatccacctgcctcccaaagtgctgggattataggcgtgagtcaccacacccggctaaagttgatagattttaaacactgactagatgcagcaggtttgggaaagtgaggaggcagaggtcaaggatgaagttgaggtttctagctccagcaagtcagtgggcgaggtgaggggtcatcaacataccaataacagaaagaagggttgaagaaaagaaatttaggtttgcgtttaatatgtattagacaagaaaatattagatatgaaggcagttcagcctaatatacatgtttagataagtcaacactagattctaatacagcattttaaataactgcttgctttttatttagcctttcaaatagatgtaaactgataaatttttaaatccaaattgaaagaaagtggagagaaaaataggaaatcatgaggtctgtgtcatgtttataaaaaaaaacccagagaatcccaaaaagataccaaaaaaatttaagctatcatcataattattcctaaaatgtaattggaaggggaaacagaaaggataacttgctgtttgggcttttttttttttttggacagagtcactcttgcccagtctggagtgcagtggtgcgatcccagctcactgcaacctctgcctcccaggttcaagcgattctcctgtcaccacatctggctaatttttttttttttttttttttttttttttttgtagagatggggttttgccatgttagccagtctggtctcgaactgctgacctcaggtgatccacttgccttggcctcccaaagtgtcgggattacaggcctgagccaccacacctggcctgtttagacttttaaaataattttcccaagatactgacaatgtggtgaaaaaccaagactgtatttaattacactgagaaagagcacatgtcaaacatttttatgggcctgaagaaaacctctctgttgtgcacagttgtaccctatttcctcagtttcagaatgcagcctcgtgcctttatgcactgaattgaggctaggcaaagtgctaccacatgactctatggtgaaatgggctctgaagtgggaatcgtcgctctgcccataggaaggagcaagaaacatgggaaaaggcagaagaaaagaaaaattggccacagggtttagatgaggtgctggcaccatctgtgctggtcagggttcccatttgaactcctgagtcatgaaaaagatttacatattatttacataaagataacagtattattcttattgtaaaactaatggaactgttcgtagaagaatgccgcaatcctgataacccaacatatctgactcttctagattttgtccatgtgctgattatttcactagatataatagtataatacagttagcttcccatattcatgggttctgcattcttagattcaatcaacagcagattggaaatatttggagggggcagggcgcagtggctcacgcctgtaatcccagaaccttgggaggccaaggtgggcagatcacctgaggtcaggagttcaagaccagcctggccaacacagtgaaaccctgtctctactaaaaatacaaaaaaaattagctggacgtggtggcgggcgcctgtagtcccagctactcgggaggctgaggcaggagaatggcgtgaacccaggaggcggagcttgcagtgagccaagatcacgccactgcactccagcctgggcgacacagcgagactgtctcaaaaaaaaaaaaaaaacttggaaaaattccatctgttctgaatatatacagacttttttcttcttgtcattattctctaaatgagaaagtataacaactttgcatagcattagctacatcatattaggtatcatacataatctagagatggcttaaagtatacaggaggatgtgcttagcttatatacaaatactgtgctattttatataagcgacttgggcatccgtggagtttggtattggcagaggtcctggaaccagtcctccatggatgccaggaatgactgtaatgactgctaacatgtactgaatgctttctaagcactatacgtgaattaccacatttagacctcaaaccaaccctttctggtgggtctcatcacactccaggtgagatttgaggtccagagaggagcttgcccaggattcaaaccttgtgagtctccatcatcacagtgtagatacaagtctgtgttgctttttttactttattttgtaattttaattttcattctaatctgtgatttcttttttcttagtttagcgtgagtataatgtaatttattcaagtaccgcacttttattgaggtggtttccagttaatttactactttctatggagcaataagcatttttatttttcgatttaaagaaaaatttatggctgttgaactgctaggtcaagaagggccaacattgttatggtttttgataggcattgtcttgtggtttaatcaacaaagggtcataacaaggcatgagcatccatgaggacaggtgagcctgtttactgctacctcagtggcattggaccttctttttaaacttttagttccttttcatttattttattagtgatattaatgttgttccctgttaattttgtgtttaatgtccattaattgttaatttggaattttattattctcaatttgtttttctgtacctatttctcatagcctgaatcacttctctggaaaattgagatgtatggaactcctttcttcaggggtgcccctaaattaggcattagtagagctcttaaaaagtttctcatcccagccgggcacggtggctcacgcctgtaatcccagcactttggcaggccgagacgggcggatcacaaggtcaggagatcgagaccatcctggctaacacggtgaaaccctgtctctactaaaaatacaaaaaattagccgggcgtggtggcgggcacctgtagtcccagctactctggaggctgaggcaggagaatggcatgaacccgggaggcggagcttgcagtgagccgagatcgcgccactgccctccagcctgggcgacacagcgagactccatctcaaaaaaaaaaaaaaaaaagtttctcatctgtaaattagatgatgatagaggactgtaaaggataaaactaactttgctggaaatcaagtagcctccttggtggaggctaaactattcctggaagcttttgagttgatgtggttttaaaggaagcaaatattatgagctacctagcatcagccttagaattgtgtcctcatgtgttggtttagtaaagataaccctcctgtctctaaacttattggtggaaattaaactgaagagaaaattcagccctatctgatgctgtccacgtaaacctggtaatagtggagtgattttggttgtatgcacttaagagctgacacttaatttgaagatgttggcagcatactgctgtcagttaacgtgccttatgaaaatagaattgaagaactgctacacaggcagatagacaataccagggtcaacagaataacaaatttccagccgaactcaaatctgaagtggtgctagtcccttctgatggactagcaccaccagtgggacctgggtgccctgacattgttcagcggtggaggcatttcatctctgttatgtgtttctcacggagcagctagtggaagtttctagtaaaatgtatattcatctaacaagtctcaggcctattcattgtggctggctccctaggggtgccatgtggttccagactttgaaagctgtgattgtgaaccttaaatcttagttcagacacatgtcaggtgaaggcctctggtttgcttgaaagttatttttgttttttcatacaaagctggttgctaggataatagtgtaattcattaggataagtgataggacagttcccaaattattctgtttgcttgtttctaggtagggttctttattgaagtaataaaaatatactaatgctttgaaagggcaacccctcaaaaatgaaatgtatttgtttgctgatataagactttgtgtctccctcctcttcagagagcaggcctgggcattttaatccactattatttgtgaaaagcacatcgatttaaaaccagctcacctgtcacctcattccccaggcagcaagtgctgcccagctgcactcccattttacctgttacaccacttagcacccatgggtcaaatcccccaagtcactccaatagtggcaggtctgagtgcctcctcactgagggtaggacagacctctgagaccttactgactcagccttccctttgcaggttacacagacccaacagtattcagagcctatgcctcccagcacttatgcaaatgcccagctaagctggagctgctcttggggtgactaccagcttatctgattgtcgtcctcaccagataggctccccaagggctgagttggccccagagcccaccctaatgcctggcatggggggtgatcagtgcagggtaaatttgtgactgacaggttctttaagagacacgtagaagcaatgtaacctccagtgggaagaggtgggcctttggatgccatttaaatatgtatgtttaaaagtatgtaatattgagctgggcatggtggctcacacctgtaatcctggcactgtgggaggccgaggcaggcggaccacctgaggtcaggagtttgagactagcctggccaacgtggggaaaccccatctctactaaaaatacagaagttagctgggcatggtggtgggcacctgtaatcccaactgctggggaggctgaggcgggagaatcgcttgaaccgggaggtggaggttgcagtgagctgagatcgcgccattgcactccagcctgggtgacaagagcgaaactccatctcaaaaaaaaaaaaaaaaagtatgtaatattggaaataatttgtgaatatgctggtcagaattttaatctacgtataaaaatttaaggagatgttaaaatgtgttttggtagtgagactgatttttgttttcctgttatagttttggggaaaaaaatgatgagagatggatgaccagcagcattcttaatttcttgtccttgtggttctttgtaaggcagaggaacaggttttgccttcattatagagggcatctgtatgaggctttgttgttcatgagtttcagtgtatgtctctggggacaaaaatgtgagttgccactgggtgaatgtagtgccacctgaatgttgaaaaacacaactcctgaatcaccaccaaacctgttcttcctccagggtctcccaagagaacaggtttggtggggattcaggagttgtattttgttcatgttaagtctgagatgcctcctagacattgaaatgcacaatgaccatttcagaatgaaggaatttccagtggatagtttttagcaggtaaaagcagccccaccttatgttcagtgagcacttgtgtaagtgctgggaggcatggtctatggatactgtgaggtctgtgtaagtgtggagaagctacacctaactcggccaaagggagggctgagtcagtaaggcctcagaggcctgccctccccatgtggcacttggacctgccactactagagtgacttggggggtttgaagcgtgagtggcaggggaaataggcacatgtcaagaaccacactctgctgctttgccagtctcctccaccatgccctgtgaaactcacagtccaccaagagcactctcttagttctctgctctgaacaaccactttgcctggctttctcagtaacaccatctaccgctacccccgcccccaccccacactctcccaggcagaagcagagtcattagtatttagccctctcactgtgggccaagtgacaacttgttccttcactagggtacatcaggacagggataagcgttaagcatccctggtagagacctgaggaacattgtgcaaggcggccggggttgttgatagtatctgtatcaactactaatgttttagtttcgcctcctggcagggcgagggttttagcagtgccacagaaaccgttcttcattgaagcaaatcatctcccaataatggaatctcactaacttgctgacccagcattctgttctctcagacctacctcatcccttcccacctttggaaaaaagctccatttaaggtgaatatgccaacaaaaaatcttgttgctcagctccagaagattctctgtttaagatcttccaaattagctgtagagaaccccaggaaatgatccagccacataaagactcacttttcccacggacccccaaggagctctgaaaccaccagcaaacacccagttgttgcctttagctccttaatttgacttgggaactctgaaatcccttagtcattggtgtattttcagacaatttcaataatctgaccagtcccatcctctacttgttgcttttttctaatctcactcttgaaagaaaagtcatgtgatagaaccaccttttattatacgaccaccacactgcccagagacaaggcccaaaggagagcacagaggctcttgaatttactggacggtctttgttggcaaagagtcataattatagaatcttttaggtcatattttatccttcatccagacatctgtaggagttggcttcttgggaaactataacatcacttagcccctaagctgaatttcttaacctgtaaaatggagttaataactggactgccttgtcaaggtgttggataaatgaaatctgtcctaacaatagacacttaaatcttgggcctgggcatggtggctcacatctgtaatcccatcacttcaggaggctgaggtaggaggattgcctaagcccaggagtttgagaccagcttgggcaacaaagtgagatgccatctctacaaaaaataaatcagccaagtgcagtggtatgcacctgtggtcccagctactaaggaagtagaggcaagaggattcctctagcccaggaatttgaggttgcagtgagctctgattgttccactatgagtacagtggcacaatcaaagctcactgcaacctcaaactctttggcttgatgaatgagtgacagagcgagaccctatctcaaaaaaaaaaaaaagtgtaggtggaggaggaggagatgtattgaggaattatgcaggatttctaaacttggttatattacttccagatctctattttcttcatggagactcttggagtttccttttctttttttcctttttccttttctgttgaaatgaggattgtactcttgctgagtatcttcctaatctggtaggaatcttctgaaacagaaatgtagaagaaaatttccatatctatgaagatgaattgaaccaatagttctaaaactttcttgaggataagaacctgggatgcttcccattcagtctcttctgggacagtgtcctcagtctgtgttttttaactcaagcttaggaccatgctggtgcaggtggcagagttaccctttgagaaatgcaaaaatcaattctgaaaactgaaggttcataagctagtcacagatttgggtgccaaagtttccattctagtgtggacgtagtttttccttccagtaggtttccaggaagaaaaggccccggtttgagcatgacctgtgggagtgacctgaaatgagatgtgagactatgtctcatgttgttgccaaattaaatgaccccactgaagcttggctgagaggtggcaggggctggcttaggatttgaggaccagtgatcctgtggtagtttcattggcattagcttcagtatatcaagatatcctcgtttttgaaagttcctttctgctgggactctgctatttcctgagcctccagtgtctgtcctgtcaggctgcccctgcctttgaaaaacttgccacttccaggaatagggtggctttgcctgacaatacctcaacctgtttgagaagatggacaggcgagagcgttggtgagatggcagtggctccgggtgcgaaagaggaaggtaatatgaatgcaagtaggaagaaaggagtaaaaatgagaaagacctccagagccaagtgtttggaacagctttggagatttccgcttcagtatgatcttcacagatttgaaatcttgttaagggagtcctattgtggcagcaggtttgtcgtttctgcactgaaactgtaaacatttcagtatgggtgccttgtgaataagcagcttccagtaattggctttctggaagcacagacccaactcctgggtaggatgagccatggagagaagcagcttacaccaagagtcacttccctggagtgtaatttctttaaaaagatgcctttttagattcagaaagcacaaaatgtaatcatttctctttataagctaatccactgtttgagcaaagggtaaaataaaaataagctagtgcaagaccttgtgcaacttcaatttcagtgtttcaaactatgtaagtatttctctccctgtacttgagaaaaagctcttctctttcttcatcacagggctgccgcaggtctcctactcctgctgggttcagccttttctcaggttctctgcttttattcagaggaaaagtgctaatcaatggcttatacctagtcctggactctagcactctgtgcccttcctttctaatttcttaaagggcacaagctccttttaacataggaaaaactccgttagacaaaatatataaggttttcagcacagtggcaattttcttttggggctataaaagaaaccctctgattaggattattttaatggagtatatataactgtagataagataaaatgcaggctgggtgcagtggctcatgcctgtaatccccgcactttgggaggccgaggagggtggatcaccttaggtcaggagttcgagaccagcctggccaatatggtgaaaccccgtctctactaaaaatacaaaagttagctggacgtgatggtgggtgcctgtaatccagctactttagaggctaaggcaggagcatcacttgaacccgggaggtagaggtttcagtgagccaagatctcgtcactgtactccagcctgggcaacagagtgagactccatctaaaaaataataataaaatgcaaactgtgtttcagaaaaaaaggcaagtttggttagcacaaagaaacatcattagtgacacctgtgttggccttctgagttatgagacttcatattaacattataacaaactacgtatacattttgtgcaagagaaaaattactaaaccaggccttcttgagtaatgctttaattttccagaagggggacatagattggatttaacttaaattgaggcaaatggatgtattttatttgggaaattgttttttgttcctcctttgttttgcctccataaatttattaatgcagaacctgaaggctgtaaacccaggataattagagttacagtgttacagaacattaaaaacccacagcaagtggctgatatctgcctaccatatctgcagttgaagttcataccatgtgtgataattacgaactttcttttttgtgggcaccttggtagaaattattagtatcacctgccatattttcacatgttacttaaacatcaataaagtgtacatagtaaagcagatagctgagggtggggaataagtggttaaatactgtgtctgacctgtaaaatacgctctaaatagacaaaaggaacccctttgtgtggcagcatagctgggtttggtttagtagcaatagtagattgttagctttaactcctcctggatgtctgtgctgctgcccatagccttgcagacaagcacagacggcctttgtagtttcaagggaccatccattccacatgggactagagagtaacaaaatgactagggatcagtgctggtacttcctgggaagtatgtgcagggtgtgtgtgtgtgtgtgtgtcagtcaaggtcttgccctgtcatccaggctggaatgcagtggtgtgatcatagttggctgcagccttgacctcatgggcttgagcagtcctcctgcctcagcctcctgaatagctgggactacagggagtgccaacacacccagcaaatttaattttattttttgtagagacagggcctttctttgttgcccaggctaatcttgaactcctggcctcaggcagtcctcccacctcaacctcccaaagtgctgggataacagacatgggccaccttacttggccctgttcaggttattttgccctgatcagtgtctttaagtagcagaagatacccccaccgtgcccttttttcccaactgggtattatccccaatgtattgttgagaaaatcaagacttaaattaacttgcctaggctcctgtaccagtgagagacagggccaagtataagtttcttttagccctgctgctattccagatcagcagcttcagtggacagctccgctccagtgaaaaactccgagaacttcctctccgccccagctttctctcttttccttatttcttgtctttgtttttagactgcctaaatttgaggtaaaaatcaaaaaagatttctgataaggaatatctgaatataaggaaggtacacagaggaattgtcagttaaactaactggaacagtttctttgactagatttgtcgttgttgtcctctactttaggagaagtaaaatgatacggaaaaaaagcttgctagcagggatttattttaaaaagcaagttttaggctatgtcctgggatcactttgataaagcctagtctcttcctcgtgtcttacaagaatactcttaatacagaatcataactctaagacaacggaaaacaatcagtttactcaaaaccctgagctatttactaaagcaggaagatagcctgtgttctataaaaggtttctcgtagttacccataaaatgtcatttggaattaaacccattcctgaccagttgagattttgctctcagtccaaaacattctcttctgtaaatggaatctttctaggagaaagtagcatttagagcaggtgccacgtgtgtgctcacctcatcagaatcctgctgtgctggcatccagagggctccctgtccactgtgctgatttacactgccacacactcaggctcactgcaacacatctcacagaccccctggccatgtgtcagcatcaagtcctgtcggttttaccttcgaagtctatgctgcctcttgtatgcatttccaccaccagtacccaaactcttccatatcatccctaacccagcaacagccattgttggccctgggttcctgcatatcagcttcccaccctctcagagttgtgctccactgtgttggttccctacaccctgcctgcttgtccctccacaaagcagtttgttccccttccccccaggtagctcttactcactctttatgactcaggtcaagctacactccctcaagaatgctttcctgacttccttaactaggttggtggcattaagtctgcgctctgaagtactgtttacatcactgtttaaattttgctttacccccagatcattctgtgagctcctggagggtagacactaggtgaacttttggctccccatttcagcccctgcacacaggcatgcaataaaaatttgtagaatgaataaaaagaaaagattattatacttctgaagtcgataccatcaactcctaagggaacttaaatatcaaagaaaagagccctgagaataaaaggcaccttgatcacacagtgtcttacaacctttagagaaacctgcatgtcaaggggaaagaccagcctgatcaagttcttattaattttcatccaacccatgtttctactttctggacatgcagttttatgctgtggaatcaggattgacacattaataaggcaaattaaaagtcccagagaacagctcgttaggaagtcaaactgccttcttcacattcagtagaataacttacactttatgattctgaagaagcatgggtctggtgtttttactttcgttagccaagggttaccttcacattattgcagaggtcccttcctcataacacagctcacgggtgagaatctggatttttttttttttttttttttttttttgagacggagtttcactcttgttgcccaggctggagtacaatggcatgatctcgctcactgcaacctccacctcccaggttcaaacgattctcctgcctcagcctcccgagtagctgggattacagccatgcaccaccacacccagctaatttttgtatttttagtagagacagggtttcactgtgttggccagcctggtctcaaactcgtgacctcaggtgatccgcctgcctcggcctcacaaagtgctggaattacaggcgtgagccaccatgcccggcctgagaatctggattttttaaagcaacaatggcataaaaagaggtatgtgacagaatcttctggagaaaagacctccttccccagctgcgtcttagacctactaacttctcattatttgtttgctcagtgttaaaatgagtaagtccattgtataaagctgtgtgtattctgaatatgttctttatctgctcaagattgtggctaatttctgacatcctctgtttggtagatgaagtacagaaagacaaagaaggacattcttaatgaaggagaaaagtcctttaatcccaacctttctaacctgatggaaaacatcataactttactataaactgcagacaggctggtcccaccttatgggcacaaagacatcggaagggaaataagggaacgggctttctttgtggatcaaaacagaatccaaggatgtagctgttagatgccgccaaaacggccacactcaagagatttggacctgggtcaggctttctgtgcgttttgtaccacttctggggccagctaccacccaaccaccactcagccacagagacacttattacaggtttataatttgacttgaaaggttttcccaaagaaacaaatacttgtcaggatctgtagcagagccatgttttgattggggcttttatgggaggagaatggtgatctaaatatataattttatttcaaattatgcttgaaagatgatcagattaaagaaagtttgtgtgagtgttttcatgggcttgtattggagggaagcagatgactgggtcccaggaggcagagaagatgaactattgggccctaagtgtgttgtaaggaatagtaccatctgttggacctaagatccacatggcagcagagggtccagaatcagccacagcagattattctagattaatgtgagtagggacaggtttggagaagtatggctaggagcacctggcaggtgactctgatgcaggcagcaaaggagtcattggtttccaggtctgctctccacataacagagggcactgtctgtagagtacaacaggcaagcctgtgaggcggtttttctcattctagttgtgctcaatatgccattttggggcagttttcaatgctttcgaaatcctgctagaatttaatttgtatgcagttgtgtgtcattattagtccccatttatttaacatcttttcttgtaatgcaaaatgctttagaaagctttaaaaatagttttagtttgtattggtcccagataggagaattgagaggggagatacaatgaaagtaatagtaaatagtagctaagaagtgaagtgtccagagacttggccaagaactgaccttccacaccgtcggagatgaaacattactgaaacatacagcagctagacttaccaaaaaaacgaccagcagcaggtgtccagacccatgcagggtctgcttgtttaaggcagattgtaggagagaaattacttaacaaaaaattaactttaaactgtttgtcttaatttaatagactgtactttgtattatatctgattttgatatcagtaattgccaaagtatgacagagatgaatgtatgttttatgtaatttttatttaaaagttctaataattacataactttctagtttgtaaaacacttttatggttattttacacagcagctttaggcagaaggcaaagcaaatactgttatccccattttacagatgataaaattgacctggtgacttttggctttcacacgtgtgctgacaccctcagtttttttctccagtagccctgtgctgcatcatacctggacagtatgcacattagaccaaccacatttattctaaaaagctagtcaagcctggaacttttgtcttaagtacacacaattagcccttagccagtgagtggctggctgatgtttcatactgacatcataattgattaagtgtgtatttaatggattcagtttctgaaactggcacttttgccggagcagctgtaggacataagtgcagattctaaatccatgtaccataacttgagtagcactgagtaaatggacctgagaagaactggacaagtctctgtccctctgaggttgactgggaagccttggtggtactgggccgtggtgcaggtcccagaggctggtgccagagcccattccctcagtctttgtgttaatggcaagttaaaggttctccagccagtctcatgagcttttcatgaagaaacgtaaggagatcgtctagctctaaggaagtaaggaccaaaacacctagggctatgtatgtattgctttggctaacactttgaagtagtctttaagaagcttgataggatgcagagttgcatcaaagaaatgctcacagggccttgaagggtagctccttgtatgtagcccatctagctgccacgtagttggcattgatagctgggaggacagcggcttccatcctagatgtaggaggcataattaaaaggacaaaaaactttttgctggtggccaaaaatgaacacataccttgttccacattctccaagctccaccagcatcagttttgtaactcattgaagagtatcctcattagttgtcttcaggctctcaagtttgtcagacattgcattcattccatcagcccacatttacagtgcctatggtgtgccagtccttggggggtgcaagaacaagtctcacagtttaggggagatggacaaacatgagtaagtaaatattgtgagcatgagcagaagtgtgtgccatgctggataagagccgtcttaggcacagtagtggagggtaatctgcaaggcttgaacaaaaccagttgtcatcagtgtgctataatactactgtgacccagttgctttggtgttctgaggctgctctgagatgctaattaaacaggatgatgattcaggttgctgttatatctcataagaaagagcctttctgtgaatgagcaggcatcaggcttggagaaggctcccttaaagcttccctcagataaggattaaacaacgctagttgactcagtccttgcagtttgctacctcaagtcagcgagccctgcctctgagacagtgacaaagtctggtgaaaggttcaagctctgtatctgggccactttccgttaaaacatgtcccaaaactaataataccttttataatttatttcccaagtttagagtatcaaaaaatgtgaggttcttattagagttctttaaaaatagtttttattcccttccataataaaaaatttactattaaaagattttgaagtttgggccattccttatttttaaaatgtgtcttaatttagaaatcatgcttggagcccccaatgtgtctcattcttcctggggagcagtattgtatggacttacctctgcttggagtgaatgtagtaacactgtggtcaaaaacaaaggacatttagctgtgcagtgactttaatatattatttgtagcataggaggatgataatgcaaatagctactccaggtaaaaagtatagaataaaaatttaattagaaattgtactggcctgggtattgatttttgggtagaagggaaaaccttacacatggaagatactatagataagtatttatattctatctttggcacctggcacctagaaagtacttttcaaatgttggatagttgagtgaatgaagggggctaacaggcgtcatggtatggtatgaagaaagttgaacttggggttcagaagaaaaagaggtaaagttctaagttctcttactagctatgtgatctttagcaggtcactttgctttagcctcttgtttcttctacaagaaaaacagatgtcgaagacagacccagagttccttctttattgatctcctgatgtcacaatttgcctagtgaaattgtaggtttcactaggcaaattgagggagaaatctgttgcattaaagaacctaaggccaggtgcggtggctgatgcctgtaatcccagcactttgagaggctgaggtgggcagatcacctgagatcaggagttcaagactagcctggccaacatggtgaaacctcatctctactaaaaatacaaagattagctgggcgtggtggcaggtgcctgtaatcccatctactcgggaggctgaggcaggggaatcgcttgaacccgggaggtggaggttgcggtgagccgagatcatgccattgcactccagagcgacaagagcgaaactccatcaaaaaaaaaaaaaaagaacctaaaaggaaaatgaacaatcacttgagagtcttgggaaatccccgtgtattagttttctatcattgtcataacaccttaccacaaacttgttaatacagttctgcttacagttctgtaggttcaaagtccaacacaggtgtcttactgggctggaattgaggtgtgggctgggctttggaaaagtccagagtcttaggggagaacatgcttccttgccttttaaaaattctgcagctgccgccctgtcccttctcccatcttccaggccagcagcattgcacctatgaccctgctggcaaatcatcaggtctccctgaagctgacaactgtaactccctctgggggggaatcgtttgcttttatgggcctgtgtgattagattgggcccacctggataacctagcatattcttcccatctcaaggtccttgacttaatctcatccacaaagttgattttgtatatataagatcacaggttcttgggattctgcctaccatatcccaagatctgattgctctgtaggagacagaacactgaatggctctcaggaaaccagtaatccagtaatcctagctcacccagtcattgtgtctctctgggtttcttttttccgcatctgaaaagttggggagttgaattagaccagtggtcctcaaactgcattgtacatcagaatagcctggaggacttctcacaacacagatttaggtggggctcaaaagcgtgcatttctgccaagcacagtggctcacgcctgtaatcccagcactttgggaagccaaggcaggtggatcacttgaggtcagaagttcaagaccagcctggccaacatgttgaaaccccgtctctagtaaaaaaacaaaaagttgccaggtgtggtggttcatgcctgtaatcctagctacttgggaagctgaggcacgagaatcacttgaacatgggagtcggaggttgcagtgagccaagactgtgccactgcactctagcctgggtgacagaacgagactctgtctcaaaaataacccaaaaaacaaaactgcatttctgacaagtccctgagtgttgctgatgctgctgttccaggggaccacacttcaaaaaccactgaactaaactgtctttaaggatctttctctaagtccctaatacagcctgagagtctttcccctttggatgcaatgttataaattaatcatagtggagtttgcacactgcttgccaggttgtggagttgaggtaggaagcaaatggacattgttcagatctaagctccacgtcttctctttcctcttgtaaaccgggatggtgatgaggcctgctgtgtggttgcttttcatgagatggtctttgtagattatctagcatatgtctgacacatggtcatcttgggtcacatttacttagcacttttgacccagccactgttttaagcctgaattaattcatttaacccttatgacatttctatgaggtgagtgctattattagtcccacgtctgtaggttgaggaacagaggttaggagtttggccaagaaggcagagctagaaagtggagccacttaccaggcagttatttaggttccagagcatgcatacttaacccttctacagcagcacccaagtttcctgtaacaaggctagaggtggcctggtcctgggtttgggtgatttagtgcttgacagtgtcatggtaggcccaggtctctccatcttgccactcttctgtcctcagcaggctggctttgtcttcagggctgtcccctcatggtgatactgtggctgccacagatcccactgtctaatcctcacagaggctgcgcaagaaaaattacctgttcctccctcttgtctctttttgagagggtgaaactttcatgcttgtaatcttagcacttttggaggctgagatgggagaattgcttgagcccaggagttcaaggacagcctgggcaacatagtgagaccctgtctctacaaaaacattttttgaaaaagctggatgtggtagcacacaccctgtagtctcagctactcgggaggctgaggtcaggagaatcacctgagcctgggaggtagagactgcagtgagccatgattgtgccactgcactccatcctgggtgacagagcaagacatcgtctcaaaatatattaaaaaaaaaaaaaaaaaggttggggggagtgcaaaatgttttcagaagccctttttcctgcagactttcctaccagaaatgcttgaccatacccattcctaaatggccaccactcactgtgattcatcccccagggtagggagggccatatcttcgggcctcttgagtaagaaagtggcagcaggaggccagatgcgatgaggtcaggagtttgagaccagcttggccaatatgcaaaaccccatctctactaaaaatacaaaaattagcctggcgtggtggcatacgcctgtaatcccagctactcaggaggctgaggcaggagaatggcttgaaactgggaggcagaggttgcagtgagccaagattgcgctactgcactccagcctgggcgacaaagcaagactccatctcaaaaaaagaaagtggcagcagacatggctgcaggttggccaccgatggactacccacactcccttctctgaagttgatagtccttttgattctgagatgctctgtggcactgacaaaggtcgacagagtctagggctactagaaatgctgtgaacttgtccttggtttactccagaccaaatgatcttttctctcttaacaagggtgcgagggcacatgataaacatttactgattatgggcacccagaaggaccttgatcttctgagagcagggcaaagcttttgaaggactaatctcttccagcccttgttcctacctcttttgtctctggaggatgccagagatgatcatccagaatctcagctctgacctggaacaagttattttccctttggtgtctcaagagtttcacgtgaagcattaggagtgcctgccaggtggaatagtgcagagggctggatgagatcattcagtctgagcgtggcgagcgcttgggctttgctgttgctggcgttagtgtagttttccatcagtatctgtgtcgggggcctgagccagctcagtgtaattgcttagggaacacttttatttttcatagaagcaggaacaagtttctgtctcttccagctagtcttgctggttgtgtgcctctgctatctgaagagccagcatccttagtagggtcacatgtggttgagttttatgaatgtgtttgttgctgataggacacatttcttacctgacaggatgagcactcacagcagccacatcacagggctgacagagatgtgccccactttaagaaaacctgaccatataaggaggagtgtctcaattacaaaataatgtctcacttagccagaaattcatggcaggttttctggtgcatttaaaataagattcatgtataaaaataccatttgcacacaggagcccatattttctgaaaagggaaatgtattgggcatttggggtaagtagatcaaaaataaaaataaaatcttcttacaaatacaagaactagaaaccaaattccacttctaattctaaaaggtttatatataactctactaccttaccctctcttaccccagattttcacagcagaagtaaacagggaagatctgcaggccgctcacgatagcagcaaggaaatgcctggcatagtgtgtgggtgggtggatggcgggggtaccagaggcagggctggggaccccactctggcatgtcctttatgacatggattgctcatctcaccctgctgtattgttgatttgagaacatttgtgaggcttggtctaaaacattattgctggatcccttcccatggtgtggtcagtgaatggcatttagaaattgaccagctcatcctgccaccacggactcctctaaccacagagacacgtgctgaggtctaacagatggggaccagggaaggcctggaggagagggccaaatctgggatactgacatgcctgacttttcccttcctttcagaaatgttcccactgccaggaggcaggcgccaccttgggctgctacaacaaaggctgctccttccgataccattacccgtgtgccattgatgcaggtaagaggagaccacagacccttgtccagagcatccaaaggattaggacatacagtttgattctctctgttgtcgttgttttttttcttttcttttctttttttttttttttttttttgtcacttcataaaaaaacttcccacccattagcagcactcatctcccttcccttccctccagtccctggcaaccactattctgttttcttttttaaatttttatgatttttttttccctttaagctctgttggactcaatcctttctatctctgtgggctttgctgtacatttgggttacttccactttttgactgttatgaataatgctgctatagaacattcacatgcaagcatttgtgtgaacatgttttcagttctcttggatgtgtacctgggagtagaattgctggatcatatggtaactctgtttaaccttttaaggaactgtcagactgttttccaaaatggctgccccattttacgttctcagtggcagtgcatgagtgttctcctttccccaggtcctccctgacacttgctgtcatatgtgtttctttttttttttttttttaattgtagccagcccagtgggtatgaaatgttatttcattgtggtttttatttgtatttccctgatggctaatgtcgagcatttttttcttgtgcctattggccatttgtacatcttctttggagaaatagctattcacatcctttgcccattgtaaaattgggttgtttatctttttaatgtcaagttttaagaattatttgtaggccgggcgggtggatcatggggtcaggagttcaagaccagcctggctaaaatagtgaaaccccgtctctactaaaactacaaaaattagccagatgtgacgcgcacctatagtcccagctactcgggagtctgaggcaggagaatcacttgaacccgggaggcagaggttgcgagatcacgccactgcactccagcctgggcaacagagtgagactctgtctcaaaaaaaaaaaaaaaaaaaaaaagaattatttgtaattctggatatgtggtttgcaaatgttttcttccattctctgagttgtctttttactttcttttcttgatagcatcacacaggtaattcaccattggacaccaactgggtgtcctatagtttagcttggttctgatactaagcagagttagtgcagcccctacaggttaagggctcagtcccacaagaccgctccccacttcatataccaatctcaagccctgtgttatgacctgtgtttctgagtgatcaactataaactggggttcccaagaccgcttccttgggtttgattaatgtttaacatggctcacagaattcacggaaacacttcacttgtgtttacccattataaaggatgcagatgaacagccacatgaaagaaacatagggccagatgtgtgggcaggggcatggagcgtccatgctctctccaggggcaccacccctgaggcaccttcatctactcagcagtccagaagccctctgaatccagtagttcacggattttttggaggcttcatcatgtaggcataatcaattattaactcaatcttcaccccctctgtccttcctggagtggggtgggtagagctaacagttccaagctgctaatcacagcttcgtctctctggtgcccagcccccatccaggaaccaccaagagtagccttagaacaaaaagtgctcctatccaggaaattccaagggtttaggagctccatgtcaggaaccaggatcaaaaaccaaatattagaagaaaagatgctcctagcacccctaattgctcaggaatttacacgggttttaggaggtctgtgccaggaatcagggatgaagactaaaatatgtatttcttactctaaatcacagtacgttgtatacatacaatagagtgttgtattttctttgctgagatgatagggggatgttttgcagtgtgttaactgttgaaagaagggaaacattttgttaaagaagtgccatccaatgagtgacgcagaagacttgagttttgactcagagcttcgataacctgggaaaatcacctttcttactctagacttttagtcccttcagtgggtgttttccccagttacttttttggcggcaaggtgggtgttaatttcaagtttattaagttttttacttttctttttgagacgaagtttcgctcttatcgcccaggctaaagtacaatggcatgatctcagcccactgcaacctctgcctcccagattcaagtgattctcctgccacagcctcccgagtagctgggactacaggcgcccaccaccatgcccggctaatttttgtatttttagtagagacggggttttgccatgttggccaggctggtttcaaactcccgacctcaggtgatccacccacctcagcctcccaaagtgctgggattacagacgtgagccaccgcgcccagcgttttttactttttttaatggacagtaattgtagatatggggtgctcagtaatgtttcaatatatatataaaatgatcagacctaggtaattagcaaatccatcgtctcaaacaacatgtctgtgttgggaacatttggtatcttctagtcatttgaaactatacaatataatgttgttaactgtggttatcctacagtgatacagaatactagaacttatttctcccatctagatgtaattttgtattctttaacaaatctctacttatctcttcctttcctttccccttcctggcctctagtatcctctgttctactttttaatacttccgtaagatcagctttttaaatttccacatgagcgagaacatgcagcttttaactttccgtgcctggcttatttcacttgacataatgtcctctagttacttgagcattagatgtatctaagaccatcacccaggcagcccccataatgcctgtggtcacgtttgaggaaaagtggtgagagaaggcagcaagtagcatggtgcttgtcatgtgcatgccccctctctgtgcttccccaggagagaagcagggctgtccacggaggcagccacgctgtccataggaggcggggtttgatttgaatttgatgggaaggggaagagggcgtggctgactgcatgatgggaacaggcgtgaggcataacatacacagagcagggccaacagacttggatcaggtctcagaattcatcctgccccccccttccttccagcgcagcagttgcttgcagctcctgacttttgtttaagcatatgtctccattcctttcacatccttcttgcccttacctcccccttccctcttttctctccaagcttctgtaggagaaacagttaaaaagaacaagagaggtagagaagataatgctgatgccagttagactattacaaaagtgtgtgtattcacacgtacatgtggactgaaaggcagcttgatggccaaggcactatttgatcaacggaaagatagggaatcagaaacagagtgccaggtgtggtggctcacacctgtaatcccagcactttcggaggctgaggtgggaggattgcttgagcccaggagttcgagaccagcctggccaacatggtgaaaccctgtctctacaaaaaatacaaaaaattagccaggcgtggtggcccttgtctgtagtcccagctacccagggaggctgagatggaaggacccaggaggggctgcatgaccctcagttgggccactgcactccagcctgggcaacagagtgagaccctatctcaaaacaaaaatgaagtagccttgaaatgtcagttcagggagtttgggttttagtccatcccttctgttctcttttttcctccaaatgttttcatgttgagtctaaggtgtaatttaccctgggtcatggtctgccatattctgtagtacagctgttaaatccttctctttcaagagctaaccagttgggccaggcacggtggctcacacctgtaatcccatcactttgggaggccgaagtgggcggatcacaaggtcaggagattgagaccagcctggccaacatggtgaaaccctgtcactactaaaatatgaaaaattagccaggtgtggtggcgcgtgcctgtagtcccagctacttgggaggctgaggtaggggaatcgcttgaacccgggaggtggaggttgcagtgagctgagatcacgccactgcactccagcctggcaacagagcgagactctgtctcaaaagaaaaagaaagagagctaaccagttaactaggtatggtggttcacacctgtaatctcaggtactcgggaggctgaggctagaggatcacttgaggccaggagttcaagttcagcctggataacatagcaagaacaggtctgttcaaataaaaataagtttttaaaagagccaaccagttgccttttctcattttcattacctctagttacatcgtaatattgtgttttcttccctgtagtctagtggccaggaaagagggggagcagtaatataaagttttgtttctagttgaaaaaaatggctttttttttttgttttttgagacagagtctcgctgtgttgccccgactggagtgcagtggcgcgatctcggctcactgcaagctccgcctcccgggttcacgccattctcctgcctcagccgccccagcagctgggactacaggcgcccgccgccacgcccggctaattttttctgtttttagtagagacggggtttcaccgtgttagccgggatggtctcgatctcctgaccttgtgatctgcccaccttggccccccaaagtgctgggattacaggcgtgagccaccgcgcctggccaagaaaatggcttttaagtgaaaaaaaaaaaaattttttttgagacagggtctcactgtgttgcccaggctggactcaaactcttaggctcaagcgatcctcccaactagctgggaatacaggcatgtaccattatgcccagctatatatgaggatttttaagtattaagtttttttatggttgattgttagttttatattgggaatactgtgagttttggctctcccagttcgcagctgggtaagaagtggtcccccactgaggctgtgttcagggacacattagggtgtgctgacaggccggtgccacatcccacccgagcacacttcagcaagggcccccctggaggctgcccccgttctgctgatagcctgccttctggtccagcttctaagatgtcaagcagcaaagctcagcctaacatactgcaatgatggaaacgctctagctcagcactctccaatgtggtaaccacaaaccagatgtgatcattgagtgctagtgggactgaggaaatgaatttttttttttaatgtaaacttaagtggccatgtatggctagtggctgaacagcacaggcttagagctaccctcctcaacccaagttcaggcaatatggttgggattttttggaaggggccatagagcactggaacatcctctcctctagtggaagcttgtgcccaggttgtcaccccagcccaccagcagagaagcgcaggaccctcattattagctgaggacttgtgagtaaatggtgtctgtcattttctgttttggggcccatcttggtagcctgcctagttaagctggtagcatctctatttaacagaagttggtggccgcgtgtccagcaagacagaggggtctgggttgggaggagtgagggtagggctgtcggcctctggctttgctgcctctgctgctgtgcactttgctccttcatgtggagacctgggacccagaggcagtttcacaagatgaccatgtcttggtcattgcggtctttttgatgacccaagtcacagtgacccagaggcctgcactgctctgtggggatggacgcttgtattattccacacagtcttcttggaaattgctctctgtgtatgatgtaactttgtatccaggaaacaagtttattgatggacttttctttctaatcataacaaaaataagtccttggtttgagaatccctaacctcccttatggagtaaagagcagtttaacattttcatctctgccttgctgtcaacccacccagatctttaaagagctgttgatgtctcagggaagacttttattactgggacatctccatagaaacagaatctttgtttcatgatctgtgactcctgccaccttcccccccacctgatgttgaccctgcatttctgacatcatggtcagctgttttgtgttgcttgttatgtcataggcacaggatttggctccaggtggggggggttacagtaataagagcatgagctctgtttttttttttttttaattaatgtatttaatgcaatgagccacaacaattaagacgagaaaaaaaggctgtggtagctcattaataattccactgtgcgtaaagaaccttgtgtggagggttttttttttttcttctactctcatgaaaaaacagctgggaattctactttctgcagctctcgttgcagtagcattttaaagctgctatctctgctgcagactttgatcttgctggtgccatcagagccctggatgggtcattaggaaatgccagtagtctgactcctccccgggggacagccgtctgcctcacaggagccagtcccagtgccaagagccccatatttccctccttatggcccaggagcctgagcctacccttcggcaaggcagggtggggctggcaggcccctgtgtcccaagccctgcagtgtgccaacataaggaataacagtagtactggggtagagtgtaggtgaattggagtctgtgtctgctacacaacagatccaaaggacattaaacccttcttgtttttcctacctccctccttgagcccaccatcctcagcctgggagcatgtggatgcatgtgggtatctgaagcttcacagagcttataatgaggagcttagtaaatccattctgcctttgagcttgaagagggaaatgaaagtggccttctcttctgggggttgatgtttgtgtctgcaagccatcttgttgactaggccaccttgtaggtctttttgagcttggatgatgatctcgcaagctgtttactttgacttcactatgcagaagtgctgactgcgccctctggacagtgtaggatggtgcctgggccttgaagaacacagattgagagaccttgactggctggccatgtaggtgcagttgcctgttcagagtcctcagaagaggttttactacacctactgctcttcactcttccctcccagcagggactggtaagaggagaagctcccctgtgccctccaggtttctgagctctctagctgtggttctggcccctgccaggaacgtgaattgtgcttcctgacggcctgtggacatgtatgagaacagaggagggcattgtctgcacagtgttcctgcatgggaggccttgtcagagatggacactgcctcaggcagattgctgtaggagacttcatttccagatgtatctggcattagtttcaagttgtcgttagcgtgcattcatagtgtcttactcttttctgcttctaactcagagggaacgcatttcctaacatgaggcgtgttttattaatggtccatcacagctggtcactgttctgtggccgtgagggaactgagccacctgcgcctttctgatggcaccctttgctgctcgtgtggtccctgtcctcactggtataaacccctgtggcgtaagcgtggcccagccccacgtgtgctgtactgtttctgtttggcccaaactagagactaagccagcatagtgcttgctgccagagcccaggtaagaagagagcatatcccctgagctccagttgtctggctcctgctgtttataaactctctggcagattggagcagcgggagtcttggtcacactatgtacttgtgggttttaaattaacacatttcatttattgccttgctagttgcttgctgggggaggggcttggaggttagtagtaagttgctgagctcttgggcccacggagccaagaaggctgccgcccactctcttagatactcatgggctccaacgaaagacaggctatgatgttccaggtctggccaaatataaaagggtctttttgatttgttttaggataccgggacctgaaaagttttcatgtgtatgttcattgcttattactattgcacttgaaatctgtgggtgcacaggctgctagtctggatctcagtttaaatttaacaaggataagtaccgtggctgcctcctgccatggtgcctgggagctctctgagaatgtgttatcaatatttattaacattctgccaccgcgttttgcaccagtgacctggctgtcggtctccaggagctgtggtgtgcagagtgaactcattaattagatttccttgccctgatccatgcactacccttgtgtgagagctcagctcacctggaggcagatgtgtccttgctgccatccaggatgctgtcatcatgttacaagttggaatgaatcatttttcctccaaggattaaaagcatcctcatgggattttaccttcctctgaagcatttagtgtggattatgtgatttgtgttggaggcttctgtgtctccgtgggtcgtggggcaaaggtgacagtggggctcttgggcctggccacctttctgtctcagacacctgggcattctctgtacagagaagaaaatacgcgtctagattttaaagtgtttttacaaggaggctttggcttgagcctgagaaatggggttagcctagaatcaaggatttttaaaatagcatttattggtgatatcgtgggaatatagaaaagataaaatttaaatcagctgtatcttcttacccaaagagaattattgttacatattcatagatttcctttcagtctttttttttttttttttttttttttttttgagacggagtctcgctctgtcaccaggctggagtgcagtggtgtgatctcggctcactgcaacctccgactctctggttcaagtgattctcctgcctcagcctcccaagtagttttttttttttttaagacagttttgcttgcctaggctatagtgcagtgatgtgatagtagcttactgcagtctgaactcctgggctcaagcagtcttctcacctcagcctcccaagtagctgggactataggcaagtgccatcacacccagcctttcagtatttttttttttttttttaatagtgacaggatctcactgtgttgcccaagctggtcttgactcttggattcaagtgatctttctgcctcggcctcccaaagtgctgggattacaggtgtgagccatggtacccagccccaagtctttttttaatgcgtagaaacattttaataaaattagcacatttatacatttgtacatcctggttttttcaagcagttttgtttcatgggtgttttccataccattaactcttttcaaatgttaatttttaagtgaccgatatccatcatgttaaggtatcatagcttacttgggttgtctctaatgttttcctattagaagtaagtgtagcgacctgctacctttatgtctgaccctgtcaatcccagccagcatgaccacacctatgtccagctgtgaagtctccatctgactgtccccttctgtcttccagattgtttgctacatgaggagaacttctcggtgaggtgccctaagcacaaggtgagtcagaggccccaagagctaccagcagggatgggatcgagggtggctcctcctgaaagacctgaagaccaggtgttggtgggcctcacccacacctgtccccacctgtgcctccggctgttagtcccctcctggccctgggagggtggaggggcatgatgctgaagggagacccgtggcatgggggccagcactcggagtattatgaggatcccaggagaaatgtgttttgggagagggggtgtttgtctgttcattaagagaggtgagaatatctaactcgatcaagccactgatttccacttgaggtgaatagaaccccaattcacaggttggcgtttggtaagtctggttctaggccttgaggcctgtgcaaaggcatcttcccagactagaagtcgagctgaccacaaggctctggggaagctcagtctcttccaggttgtgcttctgcagaagcagcctgatgcacagtggatgggctgtctcgggctccacttcccagtttatttaggaggtggtctcgtggtcgcttcctttaggaaagggtgggaggtaaggggtgaatggtctgtttgtggataccacatatgtgtgtggggagggtgtatatggagaaggagccccaagaaaggatcagaacggagaccactgccacctgatgtttcctgcaggggctgcactgtgtctctggctgaggtcacactgacacctggtggtcactggtcactcgcagtcttaaatctagtagggccgaaagtactagaaggaggttgtccagagaggtctgccctcaaaatgctcctgaaagatgcttgcttatgcttttctttaaaaattatttctggggaagggcggggagtggtcacaggatcttatattctctttatttttacttaatttgcatgttatttttagaactcccctttttaagggtcacattttgcctcagaaaaccctgtctgaatgtctcctgtttgtcggtcaggactgactctgccttttctttccttttccatgtgccactcctgtcctccctttgccctccctgatttctgcactgtcctctcccacctgtctgtctcctcttggttttgcccgtgtcagcctccccttccgtgccctctcccccccttgcagaacaagaccgcgaaaggcagcctcagcacagagcagtcggagcgggggtgaggggggcagtgtgctcgtgggaatggaaaggacagcaagcacaggtgagtcggggccaccgggctccctgcatcctgcccggctcccagcaggcgtcgttgcctctgccctcctgctcgctctatgctctgccaccagcatttcatcctgtggatgacaacgccaggtggatgcagtgttcttccattggttacttagctccccagattatctgtggaaaggagtgggggcttctaaactgtccactgccaatggggtgcagggtgactgttcctgaaggcagcccttcagggcacagctggccaggggtggccttgtgagtggacacaacaggcttttaggtctctttcttgggcagggcatctcttgccagtagcccctgctctttcccccgtctcagaaagggttccagtcaaaggtctcttctttttaatttactacatttctgtaaagcttatggtgtgttttcctttgaaaacaacagaactcttgggttttgttattagaaatcttttttttccagtattatgaaggattcctttttgcagaagtacaaaggaaagaaaaatcctcaaagatttagtagactctagcatctgatttaattttactcttaaaaatctcgaggctgggcatggtggctcatacctgtaatgccagcactttgggaggctgaggcagaaggatcgcctaagcccaggagttcaagaccagcctgggcaacagtgagaccctgtgtctacattaaaaaaaaaaaaaaaaattagccgtgcgtggtggtacatgcctttagtcccatctactcaggaggctgagctgggaggatcacttgatcaaacctggaggttgaggctgcagtgagccatgatcgtgccgctacattccagcctgggccacagtgagaccctgtctcaaaaaaagaaaaaaaattcttgtgattgagttgtgcttgctgtgagtttgtgtgggattattgtggtcacggccctcttggcaggcatctgtgaaaacaggatgataggacttggggtctctagaagctgcaggcctctgagctccatgctgctccttcaccctccctgcgtcactgaggcatgaagggaaataggttgtaaagaaaagaaaaaccaaaatgtaccttgtggcacttgctgctacaggatggggcaggaggactagttgtctcagaaatattcattgaggggtcatttctctcaaatgggaggacttctgtgtcgacctcaggagtttgactcacacagctacgctagacgtgtcccttccggcaccaccatgtgcctgaccaccttctggaacgtgccctcctccttgttaccactactaatttccggagaaggcccctcggctgccacgccatttgagaagtcaagtgggggctgctgagtgccttcttgatagagcgttgagtgtggtgcctttctctttcctcttccggggagtagggctggcagtgaagggatcagagcaaagtggggaggtgggtggaagccattccatgtgttcctgggtcagaggaaccagatgagcaaatgaagcctcttggacttggagtacattgccaccatcagcgagtggctgctggttttccagaacctgctgggcagcactgcctgctccttttcctgggattagcccttaggacaaggcagccattgcattgcgtggttttgaaaggactgtttctgttggccctcctgcatgtccctacgctcctgagggtgtcactgtgccttcccattgtcacccctgtgccagcacaggccaagatggttagagtcaagttctgtaggggaccacgatgcgtattcctggaatgtgtcctagaagacctggttaaggaaagagcttaagtgttttttgtttttgtcctggaattgcatctgtgtttgagaaaaagaaagttcaggccctgggcctggtggacaaatctcctggggattttgttcatctgttcctctctagtcattcttgggccttccttcctagctgtcagggcccttgactctttttttttttttttttggagacggattctcactttgtcgcccaggctggagtacaggggcacgatctcggctcactgcaacctccatctctggggttcaggcgattctcccgcctcagccctcccgagtagctgggactacaggtgtgcaccaccacgcccagctaatttttgtattttttgtagagatggggtttcaccatgttgcccaggctggccttgaactcctgacatcaagtgatcttcccgccttgacctctcaaagtgccgggattacaggcgtgagccacggcgcccggccaactcttgaacagaacaatgagcttcatccttctgggttgaagcacagtgatgaagtggcctcacccattgaagagagtcgtctcaggtccattgaggttgaaccattccattcagctcttggagggagaggatggactcactgcatccagtcctgtccatctgaaatgttttttatgtgctgttcccacaaggcatatagcttttcctggtttcccagttcagcagtgacattgagggtggtcaccgtccttcatttgtggtagaagccctggtgactggggatagaatcacacctctgactaaaggaggactcatcttgggccccatgctggggacagagagccaccattattgggtgccctgacaaggcagggaacagacagcgaatgtgcgtgtgtgtctgcctcctagtgcgccatgttctgacagagtgatatgataggtgctgtgtgactaagatcagactactccatgtctctgtacttcggtttcttctgtaaaaacaggaatagcagtgccaaccttttgagattccattgggaaatgtctctaagtgccagcacagcacactggctctcagcccgttgatctgccatgcctagctgtgggtttctcttgggagttggaggggtcaaggcagcagattggaccctgcagctgtctcttatagcaaaaaatacccaaggcttggggttaaaagatgccgcccctgcctcccagcctgtgaggtatctggtacctgaccctcgccaggagtgcggaggggaaaagtccttctgcaggcccgtggttgcccactgtctctttgtgccaagggggttgccttgctggcttgtgtcattggttggcagggcttttgacagtggagtccctatacccagctcttcctcctgtcgtgaattaaacaaggaggccccagcttgccctaacaggccctgtggtccagcacatgggaagcataaccttgatcagggctaatgctgcatcctggatgctatgtaccctgcacagaacagccatggatggacgctgagcaaggcagggaacggggcgtggcccccctgcccctggagctggacatcacacagtccatttgtgtgtatgcatgaatgtcacattctagagttcccctttccccaaactggtccagaggcagtccagggttacacctccagaggagagcctgagtctgtccactttccttccccaccagccccagcccaggcattgtggctgctatagtgcccgcctccctgccactgctcagcagccaagtgcaatcttcattaggcctccctccagtcctgtcccttctctacgtcagagattcttgtcatcttccacacaaagcccagacatctcaccttgccttccagagccctatggaagtctcaggtgactctccaggcccctggctgcctccagctcctcagggaccaggcttccttcctctgggcttctgcacacacagttccttgtgctggaaacactttggctccccatcttcatgttgaaaacaggctcccatctcctgggtctcagcttaaatcctacttcctcagagaagcctttccctttctaaatccttgtctccattgcccccctcctcgcttgcagccatcctagcatcaccacaatttcagatcatttacttgtttactacctgtctctccactagactgtaagctccattagggcagggaccacgtctgtctttgcaccatcaaagcctagcccagagcggggcatgtaactatgctagtgccaagtgagtctgtgttaaagaaatgagtgcatcccaggccgggcacagtggctaacgcctataatcccagcactttgggaggcgggcagatcacgaggtcaggagatcgagaccatcctggctaacaatacaaaaatacaaaaaattaaaacactaaaatactaaaaatacaaaaaattagccgggcgtggtggtgggcgcctgtagtcccagctactcgggagactgaggcaggagaatggcatgaacccgggacgtggagcttgcagtgagctgagatcgtgccactgcactccagcctggacgacagagtgagactccatctcaaaaaaaaaaaaaaaaaaaagaaagaaatgagtgcatcccagggaaaaaagggctcttggaccctgaccatcggtgcccttaatcagtatagattcagaattaggtttcccttcatatcctccctctctagtcggaattagtgtctgttttagaaatgaggaaatgggctctgggcgaatcctggccagggtgagtggtgttgagatgatgagtttttgctgcagttgggaaaggcaggcttggagtctgatgtggaaggacgcgaggatggcgtcccgggttcaggccacggatgaggccaaaggggagcagaaaggacagtgtgagcgagaagggaagggagggaacaagtgagggagcctgggaaggtgttggcccaagacgaaaccctggatgctggcagctggggagcaaggtgatgttctttaaaagagaattcacagtcttcagcacaggggcggcaggtcgctcctgctgctcaggctggctggcaccagggctgctcccaggctcactgtcggggacccagccgtctctcagccacaccccatgccctagcatacgcagcccctagggcccagttgggaaagccccagtcccacctctggccacgtcgctttgggctacatgtgtcgccttcctgagctttagctctcttgaagatgggggtcaggcagatccacgttactgtgatataatatctgtaaagcttctagcccagggcctggcacatagtgcttagagaattttccttccttcctaatttccctactgaaggaacaacttttttaaagtaactcttgaaaagttagggtcccattacattcaggatatcgtgtgtttgggctggtctagtcatcagacctgaggaacacgaaggctatagagggcagagccccaggctgcaggtgctgaggaactgccgctgcctgggccaccacgcgccccagggaggggcccacaagtagcagctcgcagagccaactggccaggcagaccctggctgctgacatgtgcttcattcttcactggggagctggtgtggggtcctgttcttctgagtaatgagcaagattggggtgcaggcccaagactgctgtgtattggtaaagagggcaaaccctgccctgtcccctccttgagcagagcctggcagggtacgtgtgggcattggccttgattcacacgggcatcctgcagccccaacaagatgacacccttctgtgttcttggaggtaggtgcccattagctcaactgctggcctgcattcccagggcttgcttttacttgtctgtggtgatgttgtgccatggcctctgtgtgtgttcctgcttattggtgttttctgccaagtagtcaggaacctccttgggcaagagcatgtgcatgtacgtgcttgggaacagctcaatcttagctcccgcaggccccagccgccttagcagttctgcgtgtgtgaactttatggaagcagaaagggctggtgacacttgggttcttggggtttgtcaggggagggcaccaaattggtcttgaggaagcagttaggtgagccccagtgacagtcttaagcacagtgattggcagatagcaagtgaaggaggggcaaggctgccaccacttctggcttctggtgaaattttactggactgattcctaggaaactgctgtttgtctttgagacctttccacatcagatggcccatgaagcgttccacagggacctttggtacaatccatctgtcctacgtgggccatcagaatccccttctgcacatgggctggaagaggagagaagccctccagcctggggatgggagacctaggggtctcaggttcctgagaggtcgaaaggattaacatagtccagctctgtctgagcctcagaaaacctgccctccctgttagaggccatgggaagagtgttctttttaagcatgaagaactgactgtgggccaggtgtagtggctcacgcctgtaatcccaacactttgggaggccgaggtgggcagatcagctggggccaggagttctagaccagcctaacatggcaaaaccacatctctcctaaaaatacaaaaattagccgggtgtggtggcgtgcacctgtgatcccagctatttgggaggctgaggcacaagaatcacttgaacccagggggcagaggctgcagtgagccaagagcacaccactacactccagtctgggcaatagagcaagactgtctcaaaaaaaaaaaaaaaaaaaaaaaaaaaagactgtcattagccaagcatggtggcgtgtacctgtagtcccagctacttggaaggctgaggtgggaggattgcttgagcccaggaggtcaaggctgcagggagccaaggcgacagagcgatgtcttgtctcaaaaacaaacaactagctgtgttgactagaggcagctgtgaaactgtcctaaaaggctggacttcgagaagtttcttccacagattgaccaggtactgtaggtttcagtcacaactggggtcctgacactggcaaaaccccaccagctgccccacaagtggggcctgccctgaggtcagggagttctctgctgtactggttcctttatgcactaggaaggcagacatgccctgaggagccctcagagtccaaccccagcacccccactaggtcattgctgcctttaatcacattccagatccagagccacacagtggccctggcattggtctcgggtgtgtcccatatcagcagcacatctgcagaggggcgtgagtgcaggctccctgctgaaagctcccaggggtaccacggaacagcggctgttggtggtggaccctgtggaggctcctggccttcactgtgtgtcccttgtcttccaggtgagactgtggagatgagaaggtggtggacactcgtgatggaatggaaatcgtcctaccgtgcagccacaccctgccctgccccgccccgccccgcccgcgtgcctgcccatgccagcacttccttaagttctcacatcacactcaaaccagtgacaccacaggaaagaaagacccaagacgttggaatggctgtttccatggacacaatctccatagtgacaatgtggggggaggggggaggggtgggatgatggggaaagggtggggggaattaaaagggagggataaatatatatatataaatctatttttagtctggaaagactttgtttaaatgaaaggtgcgctatcccttttgattctgttttaaaattatctcgttaaagatctccaaatttgttccgatgacaagtgaaatttaaatgtgagattgaactgaacaaaccctcatctcatgaaggacggggtgtgtgtgtggcgttgatctttagcctgtctcacaccagttcagaaaacactagacccaggattgaaaaagcaaaccacagcagaaccatccttttgtcattaatttgtctcaaagtgggaaggttttgggggagggggaaatacagggatggtccatgttttcaagagtaggggaatgatgtttaaacacaaaaataaattttttttcatttccagaaacactatttatttatggttttttttttttaattttttctttttgggggtgaaattggcagatgcctgaggtcatagctgtgtcctgggtcactgtggctggtgaggacctcaaggaccccatcaagtgtacacagcagcagcaaaatcaagggatgaccctcctctggggccccctgtcctcagcacattccaggcagctgtgccctgacccacagggacccgtggggatgggaggaggtccaggcctgtgttgccagagctggcagtgtgagctgtaggcagggacggggagggactgtcgctgtgatcagagtgggttaagctgaccaggaacacccatttaacccctttttctttttgctttcatttttataaaggaaaagaggacctgtcagataggcagccccatgctacgtgattctttatgttgtgttgttttgttttgtaaattgtataatttttaaatatctgagttttaaaaaaagaaaaaagtacaaaaaaatcttgttatggccttaagaaggggttagtgcatctttcaggggtcactctgccatggggataaaatagctgtttcacaaacagttttatttaaaaaaacaaaaaacaaaaaaaatcaaaaaatcaaaaaaataataaacttcattttaaccttg

SEQ ID NO: 37821 - DNA, 23295 bp, Homo sapiens; identical to SEQ ID NO: 37617

SEQ ID NO: 37822 - DNA, 135535 bp, Homo sapiens
gcggccgcgggctctcgcggggcggcgacgccgcggggaggatgctgcttgccgcgcccgcgtcctcaccgtcctcccgggccgcctgctggggctttgttgtggcccggacgccgcgggccaccccctgaagtcgcctgccgccgccgccgccgcacctagcggacgggcgggcgggcgcgcgtgtgcccaggagtgcgcgcctgtcgcggtggtgggtgcaggactggacccacgggcccattgtgcgcccgcccgcggcagccaggaccatgtgggtgaacccggaggaggtgttgctggccaacgcgctgtggatcaccgagagggccaacccatacttcatcctgcagcggaggaagggccacgccggcgatggaggcggcggcggcggactggcgggtaaggaccgtggccgatccctgcaggaggggagccgggagcgctgcggcgccgcccgcggcctgggctgcaggctcgggagacgccgcccggtcccctggggctgggcgacccgccctgcctcgttgtatgcgaggcatcgagagtcgtgatgttcaggttgggcagagatgcttctttttttgactctgtcaggcttggggccctcagcgtactgagcgctctttaagtggatatgttgaggagaatgggaaagagtgagtctggggcggagggaatgtattatcccctatatattgaatgcatcattcccttcccctcccccccttaaaaatattgttttccaaatggaaaagagggatggaagaaggttaatttttgctccactttctttactggcaacagcaggatcaggtataaaatgctcttttgtttccagggaagcgataagtaaggaactgatgtggtcatttcctatatgagttatgaccgaagagaatgaatacggaaacaggaatttttttgtttcacctaattagacataaagcaaagcaaattgtctggttctagttgtaaaaataattggctgtataactgcattttaactatttttgctcaatcacttcttccctaaaccccctcccttcaaggtattattgtaattgttgctgaagccatgtcatatcattcaggataataagatcagtcagacccatatccaaagtagtgccatattagaaataatctcgaactcataccatactagagaaattggaccttctccatctctgtgttatttagaatgaacagaactggaatactttttacagtgaaaaagttagcagaagaaatagtagaggtttcactagaaaggagactgcaaaaaagagatgaactttgaccctcctcagagttgagcttatatcaacctcatatatcacctggagtttgcacaataggtaaattgttgctttcaaatgctgtgctatgaaataaagattcttgatatatgtatttacttatgattatatttataaactaattttcttaagattaaaattcaggtgtcatgtggtacaatgtatactggtatgtttgaaggatcttgattctaccagaaaagataaatctgcagagctccagaccccattctggaaatacttactagtgatctgataccaggattttccaggtcattttgtagaagttatctaactctaaatgttaatatgtaatttacatatctaatattggaatcagcccacattgtcctttttttttttttttttttttttttttttgagacagagtcctgctttgtcgcccaggctggagtgcagtggcgtgatctcggctcactgcaacctccttctcctgggttcaagtgattctcctgcctcagcctcctgagtagctgggactacaggcatgcaccaacccgcccggctaattttttttgtatttttaatagatggggtttcaccatgttggccaggctggtcttgaactcctgatctcaaataatccgcccactttggcctcccgaagtgctgggattaaaggcgtgagccacctcacccggcccatgtagtcctttaagcctaggacaacaacacagagtagataatttattgtagtaaaaagagaacatttccttctgcaattaaccctcctacaccttgtaagcattaagtattcatttacctgtgtcatttgtaataggatgtgaaaaattcagggattcagagccttctttttctgcttaacatttgtattgtgttcctactggttcttagagctataactgactacggtccacttgaaatctcatcttgtcatcaatgacttctttcacttaggtaaaattacatcttgtaaattgagaaatcacagtgattgcacttattaatggaataattgaaatcattgtcatgagtaaaagtatttatgacaacaaaggctattttcaagcaagagaggtaaaatgtttggtctaataccttggtgccatgtcaaatgtagcaggaacattttagaaatgttacacaatgtgtagtatattctgattctaatgtaagttcattcattcactaactcactaaatcatttaacaaatatttgttggcaacttctagaagtgctaatgttgtgaagctcaagcctagtagaagacaggtattgatgaaataatcacataaattaaagtaaaattgccactctacagagtcccagcagaaaacagaatccaaatgaagagagatgagtgaaaagacaacttcgaaaaatagaggcatggttatttgaactggtgtaaggcaaaccagaggcaggactctcaggagtccgtgagagctggagccagggaagaggaacttgagcctggagagaagcagctacttgtaaaaacatagacaatagcagaaagggagtggggagtacatgccctgacttctctcttctcccaccctcccagcttctgccactgcctcccatccctggaacccaatagaagccagctaaggaactgggcatggtggtgtatgcctgtagtcccagctgctggggaggctgaggctggaggatggtttgagcctaggcattcaaatccggactgggcaacatggtgagaccttatcgctagaaaaggaaaaaaaaaaaagaatctagctggaaagagtcctggtaatgtagtttcttgggatcagcctcccaggaatggatgggggcaaactgagaatgatcagaacaaatatcataagaagaggaacatgatgttggttagtcccagttaagtgatggggtcttggaggtggaggcaaaggaaagattccttgaggaagtgacgcttgagcttagaactgaagaaagaaaaagatctgcctgtgaggagaggagggaagagtaagtgttagatatcagctgttggagattttctggaagatctcaggacctttacataatatgcattatctggatcagtgtacatgtgtacacccagcaaatagatgacagatgagtagggaaacttgcccagtgtgaactggccagaagtggtctcaaagtgtggtcatcagggagcttggaaagattagcacagaaagctataaaaaacagtgggtcaaagttgaggacacttaacattttttaaaaattaagatattctaggttcctgattccaagcaatatgtataggcattggtgcaatgaagtcttccattgtggatgcatttgattgatttatttaaccccctttgactgagatttcatacatatacataaaattacagaaatcagatgcaaagtgcagtgatctactacaatgtgaacacttggcaaccaacaccaggataaaaaaaaatagaacaccaggataaaaaatatagaacactgctaatgtgccaaaagcccccttgtgattctcagccaatcattgtcacctcccccaaagataaagactatcctcatgcttttttgtaaacacttccttgattttctttgtagtttttccaaagaacatatccctaaacactatattttggttttgcttttttttttaagcaagaaatgaaatggaattatagagtatatattcatttgtgtctggattcttttgctcagccttgtgtatgtgatattcattttgttgctgttggttgtaattcattcatttttctgttctgtgtagaaaactatgatatgagtataccacaatttattcatctctttatcaactgtattgttggtggcccattggatggttcatttgggggcattatggataatgtggctatggtcattttggggcatgtttcttggtgcctgtgggcatacgtttctatttgctctataaacaggagaggaattgctagctcataatgtattatcaatttcagtagatgataccagttttccaaagtagttgtaccaatatactcccaccagcagcatatggaagttccccttgttccatcacatatccttgtcaacactgtcagtctttgtaattttagccattgttgtggttttggagtaatatcacattgcagggttaatttgctttttcctgactgatgaagttgagcatttttccatatgtttattagccatttggaatattttgagatatgattgttcaagtctcttgtccatttttcaaccggattgtcttttttcttactaacttgtagaaatttaaaaaatatgttctgggtataagcctactgttacatgtgtggcaaaatcttcatttgttccttacctatttactctgtaaagaatgaacagagattcttaatttttaaaattccttaagtcctgtttagataccatttccttttaaataccatttcctttatggttaatattttattgtgttctgttcaataagtcttttcctgctctgtggttataaagacattcttatatattctagaaatgtaacagttttaacccccaccttaacatgtacagatcactgggaattaatttttgcatattgtgtgaagtaggggttaggtattgtattttaaactttttgtggacattcatttgccccagaatgatttattgggaaggctattctgtcttcactgttctgtagagctacgtttgtcataaatcaagtacccgtatgtgtgtgggtctgttttgggttttctagtctatgtcttttgtttattagcatattcttgcaccaacaccacactgtagttttattttaattttcttttagattcatgggttacatgcacaggtttgttacataggtaattgtgtactgtacttttatcataagagtttatatgcagtagatcaagttctattatcttgttctttgttttctacaggtttcttgactattctttgagcacaatacagatgctcctctacttacagtagagttatgtttcagtaagttgaaaatattgatgcatttttttaacttaaaatatcctcaatttacagtgagtttatccagatgtgaccttattgtaagtcaaggagcaaaccgaatttgtatagcttccacatcattatgaagtaaaaaaaaaaatttgtaagtcgaaccattgtaagttgggacccatctgtattttagaatcagcttgcaaagtctcaccaaaacaaaacaacagcagcaacaaagatgttaaagctattgagattttgattgacattacattgagtctgtaaataaatttgggcaaaatttttacctttatagtatcaagtcttctgatccatgaacatggtatattcctttatttatttagatctttacaagtttttctcggtgttttatagttttctgtgtagaggttttaagcttcatttattatatttattcctaggtgtttcatatttttttcactctgttgtatattatgtctttttaaaatttcattttctgtttcttttttactgggatgtagaaatattgctgttttatatattcacctgtatccagaatgtagctaacttaagaaatgaattctggtaatttatctgtaaattcttctttttatttcctgcatacacaaccatatcatctgctaatatttacagtttatttcttttttaattcttatgcttttaaaaattgtctttgcctttcttgacaggctaggacctcatatacaattatgaattgatgtggcaattgtacatactcttatcccttcccaggtcttaaaagaaagactttcaacatttgttcattgttaagtatggtgatttttgtaaaattttttttttttaatttttgttctccttgcctgttttcattttattttattttattttattttaaggagttcttattcctagtttgccaagcgtttttgattatatttggatgctgaatttttaagaaatgcttttccatttttatcaatgtactagtgatttttcttttatcctgttagtgtggtaacttatagtaactgattttcaagtgtttacctgaacttgcatttataaagcaatcctaataatatagcattataattgtaatatattcctggtgaattgagcattttatcattatgaaatgttcacatgtatttccagaattgcttttgtctcattcttatggttagaatagatttatttggttagtatttttatggtatctctttttcatactttcactttcaactcttctgtatccttatgttttagatatgtcttttataaatagcagatagttgatttatttcctttttataatgtttagtaatttaattgttttttataaatagagacggggtctcactatattggccaggctggtctcaaactcctggcctaaaccaattcccctaccttggcctctcaaagtgctggaattacaagtgtgagcccccatacctgggcagttgacttttttcttactcaattttgaaaatttttgactcttaattgtattatttagttaatgtccatgtgacttggatttaaatctgctcttttattaagtgctttatactttttctagctaccttgtgttctttgtattttgccttccttgctttttggtgggatatgggaataattctttttaagttacactttttgagactctattagctagaagttttatattcattttattattcttttagtggttattctggacaatacaaatgcatttttgactcatccaattatattattaaccagtactttttttttttaccttttatttttttaaaggaaagccagggtctcactatgttgcccaggctggtctcaaactcctggcttcaagtgattctcccacctcagcctcccaaattgctgatattagaggtgtcagtcactgcacctggccattattttttattttttaaattgacatgttaaatattttctcatagattgcaaagaccatggaatactttaactccccacccccaatttacataccatttgtgttgtaatagtatattttaattcttaacatattttcaacccaaggacatgcagttattactatttttaaagtctgtattcagttggatctctacacgtttaccatttttgttttactttcttcttccctctctgaccatttttctggaatccgttttccactgccagaaaaacatcatttactctttcctttagcgaggacctgcttgtgacagcttttctcagtttttgtttgtctccaaatgtctttattatgctttctttcttgaaggatatttttgttttgaatggttggcacttaatatgttttaagcatggttgagacatcgtttcttctgaggtaaactgtcactctgaattgttgttcttttgtgagtaatatgtcttttttctctaactgcttttaaggttttctctttgactttggtcttctgcagttttaatatgatctagataatttgtgatgtttaaaaatcctgcttaggggtagtaggtgttctttaatatgtctttcgttggttttgtaaaattctcatccactgtctccaaatatggcctttccttcatcccctcatctctctttctggcactccaattacatgtatgttagacatctcattgtatcttctatgtctgttaccttttaagttttacttcattttggctacttttttctgatctctgttccaagttaataactatctccttaactatatttaatctgttcagcccaaccacttttaattatttttttaaattaaatattcctgtttggttcattgtctaattttcagttgttacaattctcaatcttattttttgtctcttttgagcaagtatggttcttgtaaggcctcaattaacttaaatatctcgagctcttttaagcctgttctgctgtctgttttttctcctaattttcattcatgctctgatgtcattttttatgtctggctacttttgattatgaactggaccttgtacttctagtttgtgaaactaatctgaaggagaagataatgttattttctatgagaaaaattttttctgccagttgcaaactaaaatcactaatttttggtactgatatattttctagctgagctctaacttgagtggatttgcctacttaggatttacagttatattaggtcatagccctccatcgtcccaacccaaagaggaaagggtggcatcattagctgccctacctctttggtggtactaactcctatcctggtccccccagtccaggattctgttaaaagcacatccagactctcagcttactcagcagccccttatggaaggggcacatgcctcccaaaataattgttactctaaaatatagagctctcccccttggagcctgtctttttttcaggtatggtaacttgttgctttttattttttgatattttgaaatatattttgtccagtttgtatagttgtcctgattagttgatattggtatagattatcttatctgacattataaggtagatgctattattatcctcagtatgtagaaaaggaaactaaggccttaaagagattgagtgatttaccctaggtcccacacctaataagtgtgagcctatttgattttgtatttattattctttttttttttgacagagtctctctctgtcatccaggcgggagtgcagtggcacactcttggctcactgcaatctccacctcctgagttcaagcgattctcctacctcagcctcccaagtagctaggactacaggtgcatgccaccatgcctggctaatttttttgtatttttttagtagaggagggctttcaccacgttggccaggccagtctcaaacttctgacctcagatgatctgcccatttaggcctcccaaagtgctgggattacaggcatgagccaccatatccagcctatttagtattcttctttatatgcatttatttatttatttatttattttttatttttatttaatagagatggggtctcactatattgcccaggctggtctcaaaatcctgagcttaggcagtcctcctgcctctgcctcccaaagtgctaggattataggcatgagccactgcgcccgtcctatttagtattctttacaagactgatatgctttggctgtgtccccactcaaatctcatcttgagttgtagctcccatgattttcacttgagtgggagggacccagtggaaataattgaatcatgggggcggtttcccccataccgtttcatggtagtgaataagtctcacgagatctgatggctttatatggggaaacccctttcgcttggctcttatttctctctttgctggatgccatatgagacgtccctttgctcttccttcatcttccaccatgattatgaggcctccccagccatgtggaactgtgagtcaattaaaccacagtcttttgtaaattgccccctctcagatatgtctttatcagtagcatgaaaatggactaatagattaattataatggtgtatattaatcttattttcctcttataaccaccccccatttgaaaatctaataaaagctatggactctaccttgagaaaaatgaaagcactccaaaaaattgcatgcaattttaggagtttaatggatctcaggtgaattagaacgtaggggcttcaagttaaaatatctcaagagatggagacagtttctcgttatacaaaatcaaatgtgtgattccttcagtaagctgttctctcagaaatgtgtttgtgtatcaactatgtttagggcgctgaactttacaaagatttaaaagaaaaagccagtttttgttgggtcacattattaaccttgagatgaaacatgggtgaacaaattcgggagatttgagaacataggcatggagatggtaagagtgcagactaattaagtccatatcaaattgttccatctgagttagagcattggactgtccaggaatttgacatagtgcattcagtggagacctccacaactagggagactttccattttataatcaaacaaccaaataattcccagaaatgtatgagaaataacaaagtgatattcatgaagccctgactggttaggaggtgtatgtttttaggataaatgctttcatcttgccagcttgtaagtactgtattagtaaagttgcaactagtagtgcttgtgtatttatttataaatacacagggggttagggatgccaatcccccatgcagtcaaaaatctgtataatttttgactcccccaaaacttaactcctaataacctactgttgaccagaagccttactgataacattaacagttgattacacatattttttgttatatgtattatatactgcagtcttattataaagcaagctagaaaagcaagtgttattaagaaaatcctaaggaaaagaaagtatatttactgttcattaaatggaagtggttcatcataaaggtttttgtcctcatcgtcttcacaaagttgagtaggctgaggaagaggagttggagggattggtattgctgtctcaggtgacagaggctgaagaaaatccctgtgtgagtagatccaggcagttcaaacccatgttgtttaaaggtcaactgtaatacaaaagcagttaaaatttatgttagctcctaatggaacttaatgttataattggtgtcaatgaaaagaatcaaactctgtaaaatatttaaagaagtctattctgagcctaatatgagtgactgtggtccaaggcacattctcaagaggtcctgagaacatgtccaaggtgtccaaggtggctgggttatagtttggatttatactttttagggggatggacataagacatcagtatatgtaaggtgtaattggttttgtctgggcagacaggactactcaaagaggtggggcttccaggtaacaggtggattgaaagattttctgatgggcaattggtttaaagagttattatctatagatctggaatcaatagaaaagagtgactgggttaagataggagttgtgaatagaaaggagtgactgggtaaaggtaaggggttgtgaagactgagattctttttttttttttttttttttttttaaacactcttgctctgtcacccaggctggagtgcagtggcaagatttcggcttactgcaatctctatctcccaggttcaagcgattctcctgtctcagcctttgaagtagctgggactacaggtgtgtgccaccacacccagctaattttgtatttttagtagggacggggtttcactatgttagtcaagctggtctcaaactcctgacctcaggtgatccacccaccttggtctcctaaattgctgggattacaggtgtgagccacagccagggccccaaggctcttacgtagatgaggtctcacaggtggatgcccttagtgggaatagatggcaagtgttttctactcagacctttaaaaggtgctagacacctagctaatctctttaggatcagaaaagtgacctgatctctgttttaatgttaatgctggtcagttgtgcctgaatttgaaagggagaagggtataatgaagcatgtctgaaaacccaccttcccatcatggcctgaactagttttttggtttctttgaagttcccttggctgagagaaagggtccattcagtcagttggggggtcagaattttatttttggtttatattggtgacttctatgtgttggggtgggcagtagtctatagctgtgtgtggagttggctcataatacatattattaataggaaaatgctgctgacaggaaacatgaccagacaaaagcagattttgcttgcttgtcccatgaatcccccccacctccatcccattattattatcaactttaagataattttgttcacagaattccattgtccataccaatttctcttgagactgatttattctacaaagaaaccgtgggaatgaatgcttataatttgtgcaggatttgacatgacatttaacaacttctgggtgtttgtaaactggccacaaaaactaggcaagaaaaaatttactccaagcgtcctagaaatttgaggaatttgaaaggttgaggcagacctgctgctctagggacactgcatatcctttctgctttgccttcctcatgcacagagaggacccactttatgaagagtcagattgtgaattgtgatatggttcccaggcctgaccacaaaagcctgttttgtagttatgtacagaacaggatttgtaattatgtggacctaggcagcttacaatgccaacagctgtggtaggtaccaccttgagttctgagtcttggaggtggaagcccatgcctgcttcatggcacagcagtgtgcagggaatgccacagacaaaagccctgagggtggctctttgcacagcgtctttgtgttctctgcctccctcactgacttctactctttagtccttcacttagtaagcagacagctggattcaaatcacagctccacctgttggacatgtgatttgcaaagtttctcttcctctctgagcttaattcccttatttaaaatgtggcttaataacgttttagcacccgttatgaagaatctgagataagtcatgtaaaatacaggaaacataaagaaccattcatagatgattgtcccatcattgtcctcccttggtgatgatctcatgtaggtattaggaggcaactggctctaattcacagcaatgtgtgagtaatggaagagttctgcagtttacagagacattacattttctgaaggatgctgttaaagcaaatggatatctgtctgatatttaggcagtttgacaacattaagtcaaatactcaggctttttggagaagataatttttgatcagcaaccttaaattgtttctacgtaactccttccatctgtccttccctccttcctttcctccttcctccctccctccatcccttcctttctctctccttccttcccttccttttcctcccttcctgatactgtatgtacattttgaaagctctaccagtaaaaggtagtttctttctttctctttctcctcctcctcctcctcctcctgctcctcctctctcccctgcccctgcaccttctttcttctctcttttctcttctgtttccttcttgcacaaatagtcctctctgagaatggcaaactggaatcaccagggagaggactggagtgggaaagacaggaggaggggtcaccttttctctttgggggtttgtggggagtgtgtgtatgtatagttactagaaatttgtaatttgaaaacatcctctactagtgaaactagagaactgtgaagaagtcaataacccaccttctgcttttctttgttttcttttcttgtcagatgtgcattctaaaaagcccagtggatgagtcagtctttttttttttttttttttttttttgagacagagtctcactctgttgcccaggctggaatgcagtggtgcaatctcggctcactgcaacctccacctcccaggttcaagcaattagcctgcctcagcctcctgagtaactgggactacagatgcccgccaccatgcccagctaatttttgtatttttagtagagacggggtttcaccatattggccaggctggtctcaaactcctgacctcataatccacctgcctcagcctcccaaagtgctgggattacaggtgtgagccactgtgcccggcgagtcattttttaaggtgttctgcaattgccactggcttctagttgatttcaaatggcatgtcacagttttgctgttagctttgttgatgaaaaaatccaaactctgtaaaatatttaaggagatttattgagccaaatgtaaggaccatgacccatgacacagcctctggaggacctgagaacatgtgcccggggtcattgagttatagcttgattttgtacattttaggggcacaagttacaggcagacgtgaaccaacccatgtaaggtgtacattggtttggtctggaaaggtaggacaactcaaaagggagggggcttccaggtcatatgtggattcaaagattttctgattggcaattgattggaagagttaagttattgtctaaagacttggaatcaatagaaaggagtttctgggttaagataaggggttgtggagatcaagatttttattatgtagatgaagcctccagatagcaggctttagcgagaaagatggtaaatgtctctgttttgtttttgtttttatctggacagggtctggctctgccgcctaggctagagtgcattggcatgatctctgctcactgcatcctctgcctcctggactcaagccatactcccacctcagcctctcaagtagctgggactacaggcacatgccactacacctagctaatttttgtatttttttgtacagacagggtttcaccacattgcccagtctggtcttgaattcctgagctcaagcaatccgcctgtctcagcctcccaaattgctgggattacaggcgtgaggcaccacacctggcctgataaatgtctctgatcagatcttaaaaggtgctagattcttaattaaatctcttctggatctggaggagatttggaaagggaaagggattctctgcaaaatgtagatttcccccacaagagatagctttgcagggccactttaaatatgtcaaagaaatattttggggtaaaatacttcaatttctttctttagggcctgctatttctcatgtaatgctatactagagtcacgttggagtttggtatcttcttcctacaaagaatctgttttgtaagtcttcagatctctgttttaatgttaatactggtcagtttttctggaattccaaagggaggagattataatgaggtatgactgacagccctcaccaccccaccctgctctattcttcctaccatggcctgaactagtttttcagtttacttttgaagtcccttggctgagaggagaggtccattcagttggttggagggcttagaattttatttttggtttataggttatttacatattctttcagggaacattagattgctagattttctagttgtgagatccactcaggaaatccattaagattttccttctaactctccactggagatctaagttaggaactttcatttggatgaaattgacagccaaaatgagtgattgaggtataagtctcactcctctctatttattaagccagctttagggcatgtctgggaaaaacactagcacagacacatctgtggctgtttttccaaagaggttttccagaggtttaatatgtttacatttccttaaagcaggggaaggcatgtgggaaaaggggaaggtatgatgtaaggcaatggttacattcctgggacactttaattagtgcctagtgaacctgcattttacataagataaggtgaatgtttgaagagaaagagcgagtaaagggggagttcattatgtagaccctctctgggtaggtggaggaaatgaaccttgtctttctcctgcacccaggaagatgagattgtaattgggtattactggtgtggaaaacactttagttttaggagctagacttagattgttgacctcaagttaaaattgtctgtccctgtttttggaaatccagaaaagaatttacttattaaagatcttttagagcagtccttcagcagatgcctgaggccttttacctttccatgggaacttggctaatacatagtgttaggaacagctattcatttggaagaggcctgttgtatgactcagcctctggactgaagttcaggggtctagagattattaatcaggggcctaaaatcaactcttttactttatatctgggtgcaaggagcacaaagctagatgaagttccatgaggtgatgtcagaaatgcacacccataactgtacctccactcctaccttttcagctccattattctaaggcatgctggacagatacttgctagagtgaagatcaagcagaacattaaggatttggtctctgtttacactgaacaaacaaaagggaactcttgtttatctaattctgtttcttctagattacttttaatgcttctgtttaaaaaaaattttttttttcaatatgatagggtcttgttattgcctaggctggtcttgaactcctggccccaagcgatcctcccacttcagcttccctagtagctgggactataggcatgtaccgctgtgcccagctttaatgcctcttaataaggaaaattctacattttggtaatatgtacaaatgaatttttaaaaattcattttataattagcatagacaatatatagacagaagagctaaaatttgccgaaaatctgtgattcaggcatcctgctgagaactttttcattctttaattgattgtcataataaccttgtaggttagatattattcccctttatatatgaggaaactgagttctcagagaagtatttacctgaggaaaccctggtagcataggcagagcttggatttgtactcatttttgattgagtttagaaaaagaaaaggattaaaatgggatattatttttacaaaaggagggaggaagatgatcttacagtgcatcctttagaaagctaaaggaaacttgggcaaagtgagttccagtcttaaaaattcagttttgagccaggtgcggtggctcagcctgtaatcccagcactttgggaggtgggcagatcacctgaggtcaggagtttgagaccagcctgaccaacttggagatactccgtctctattaataatacacagttggcatggtggcacacgcctgtaatcccagcaacttgggaggctgaggcacgagaatcacttgaatccagaaggtggaggttgcgccattgcactccagcctgggcagcaagagcgaaactccatctcaaaaagcaaaacaaaacaaaacaaaatttagtcttgagtgtggaaatgagggagctagtagagtgaggctgtaccttctcccttctcccatgttttgatgtcattggccattgtttgtcatggattatagttatataactgtatgccagggggaagtgtgaaaactatgtggattttctcaaaaaagttttccagtctttccccattttaaggcttctaagtccagctgtctttgggaccacaatatagagccattccaagatataaaattaagagggcattggacatttgactggaagactagacaaggaaagacttgtttgtatgaatgttcaacaaagaagacaaatattcatgcttattgtgagggtggtcactctcaaaaagttttgtaagccaaaaagtgtctaaaacagatctcaatttagaggtttattttgccaaggttgaggatgtaccagggaaaaggaaacacaagtcacagtaggatctgtgtcctgtgctttttccaaagatggttttgggaatttcaatatttaaaggggaaagagcaagaaggaggggagtaaaaagggagagagaggtaggcaatgaagcaagtggttacattcttaggaggctctgattagtcctcaatgaatctacattttacatgtgaaaagaaagggggggtcaattatgcattcatctcatgctcagcaaatccacatttttacataagataaagtaagcatgtgaaattacagctatctgtttgggaacaaaaggaaggcagtttttgcataactcggttcccaagcctaacttctccctttcagcatagtgagtttgaggtcccaagattttcctttcatagtttctagagaacaagagaggagaaatgcaagtttgacataccatgttgattttcattaatgtaatttgtgttaaatgtcatgaagattttctttgtttaatatctggtttatttttccttgtggacataaaattattattaaagttttcataggatcattacaacgttggctcccaaatcgattttttcttttagcagtacttgaaactggtagcaatttcaggaggtccttgaataatgtgagattatatacaagattggtggaattaactgtgaaggtgtatttttctggaactgaggctccactttttatcagcttcttaaattagattgtgaatcaaagaattaagagccgatatcctaatgtctaacattcctcaactccaaattttccaccaaagcgattttcagggatttagtattgtgcttgcagcaggattactataaattgtaagacatcttatatcatttccaggaaattctcttagcctttcaaccagttgaaaatgttcagttcactttgtattgtttaaacaataggaatgtatcactgtctgtgactacaaaatgataaacatgttagtgcttgtctcttactcttatcctggtacccagatgtggatcccttcaaccacagctcttagtttcttattgtggggaagaccctatggatgtgaatgtgagtgtgtgtgtgtgtatgtgtgtgtgagagagagagagagagagagagagagagaagggagggtgcagggagagagagctattcaggcagagatagacagagagatagagaatggagggagagagggaacagggcatggaataagaaaatggagggtctttccttaatctaggaactgatgttgccctggctgtccctcttcctgcagatcttccgctcaggggcccctcactaggattctctgtaatgtagagcaggggtccccaaaccccaaggcgcagtccagtactcaggaaggcaagcattacttcctgagctctgcctcctgtcagatcagcagcagcattagattctaatagcgccaaccctactgtgcactgcgcatgcaagggatctagattgtgggctccttacgagaatctaattcctgatgatcagaggtggaacagtttcatcccgaaaccattcccacccctgctgcccccacacccttggccatggaaaaattgccttccactaaactgctccctggtgccaaaaagattggagactgctgataaagagcatgcagttctgacaagtgactccactggttgcctcttgctaattctgcttccccacaggggaatggagagaagagtggggtccagatacagcacagtgtgttggcatttcctttttgcactctacaattcagctctcagcctaatcattgtacagttctgattgaatagcatggctaaccctacagatcatactctgctctacttaactgtcaggaggctaatcttcatcatgagaactgcaaacccctctttcttcctgttctctgttttgcagtggggtcacctctagtttctcaaatatggctctgcttgagtgtagccactgatccttaggaagaggatgccatttgccctttgactttattttatttattcatttattttttgagatacagtctcactctgtcacccagggtggagtacagcggcatgatcttggctcactgcacctctgcctcccgggttcaagcaattctcctgtctcaaacttccaagtagctgggattataggcacgtaccaccatgcctggctaatttttgtatttttagtagagatggggtttcaccatgttggccaggctggtctcaaactcctgacctcaagtgatccacccaccttggcctcccaaagtgctgggattacagatgtgagccatcgtgtccagatgccctttgactttaatctgtttatctgatctcacctgttcctctgagcccactgtctccttccccctcactctctccttccccctcactctctccctaataaaacccaattttccttcctgacaacctcagcttcatggtatattctagggaggtatcatgtagctttctttttgtaaatgactcataaatttgtggatcattatttttcagaagcctgataatcttgtcagtatcattccagtttcagggtgtgtttgcccagaaaagcactcggtaacttttttacaacataagtaggttaggttgtatccttgctagaaatatgtataatgagctgtgatccatccccgctttcttagtgccagtaaacactctggttgtctagcaaaagacagctcttatctcttgttgttgttgtcatttcagtttgtcacagggactgtgctcaattggatgttattgtacgccacagtaggtcttgctattcactgtgcaataactgtactaaactttgacatgtacacttttatttttatttacttatttaagacagggttttgctctgtcatctgggctggagtgcagtggtgcaattatagctcactgcagccttgaactcctgggctcaagtgattctcctgcctcagtccacaggtagctgggagtacagacacatacatgatgcccggctaattttttgtgatttttagtagagatgggtctcactatgttgcccaggctagtctccaactcttgtgcttaagtgatcctcctgcctcaatgtcccaaagtattggaattacaggcgtgagctaccatgcccagctgacatatatgcttataaaagtcacttgcagatttttatttctgatgtgcctataacccatttcattaaagtttagatgaacacaggattttataaagtccttagataaatacttttctttttccactcttattcatgagccagatctttgtcttagagagcccataatggttatgcagagtgggcaatagtattttcaaaaagcttagtaaatgtaggcagtttctttagggttaatcatctttcaaagggccttaggaatgtccttcaaacagaatataaatgtcaaagagaatatctctttctgtttgaaattatttgggcaggttgaaagaatttgataaagggaaattctatatttaatctttcattgtaaattatatgtgcaatgaaagagtttaaacatttttggagtttgctgtcttaaaggcctttctggaatgtaaggaaacccagcagtggtgtctgctaaatatgcgaatgtagttcttaacttctttgagactgctttttatctgaaaatgggagtgattcctcctaccacctcacatgtttattgtgagggttaaatgagatactgaaagcaaaaaacattaattaggtttttcaaatttgtgtttattatttttattttagagacagggtcttgctctgtcacccaggctggagtgcattcagcttgatcatagctcattgcagcctcaaattccttggctcaaacgttcttcccacctcaacctccagaatagctgggactacagtacaccccaccatatcctgataactaaaaaaaatttttttgtagagatgggggtctcactatgttgcccagactggttttgaatggctggcctcaaacaatcttccaatctcagccttccaaagcactgggattataggagtgagccaccgcacctggcctgcgttatgtatggcctaatatggtattaggattctgtgttcctcaatgtagttttctcttatcaaagtatccaccatctggctgggtgtggtggctcgtgcctgtaatcccagcactttgggaggccaaggtgggtgaatagcttgagcccaggagttcaagaccagcctgggatacatggcgaaaccccatctctacaacaaatatgaaaaattcgctgagtgtggtgacacgtgccagtggttccagctactcgggagactgagatgggaggattgcttgagtcctgggaggcagaggttgcagtgaagtgctactgcactccagcccaggagatagagtgagactgtgtctcaaaaaaatcagaaaaatccaaaaagcaaagtatcctccatctactcaacaaaatcaggatccgtggcaatggcagtatcaaaaatctacaaagtggccatcagctcggtaatagcatttaccatgtaaggatagtatacatgaaagagccttgtccacatggagcagaggttcattagaaagaaggaaggaaggaagaaaggaagagggaggaagagcggaggagagaaggagggaggaaaggaagaagaggaaaataaaagaaaaatgttgtttacaataactatttggaatggtaagttgtcagcccatttgtttttttgaatctaggtgaaacagaatgactattgcttatttctttggaaatggtatagtgcattatttttatgtcacatatagagttaaacagaacgcataggcagttccatgtaccttgagttttcatgaacctttagattccatataccctgtgaagacttcattcaaggacactcaaagtagaaacaggcagaaaacctacttaacagatatctggaggccatttgtccagactgcccaggtatagtcaataagattatgacttcatggaaatgagtatgtaaacacacataataagaatataatgtttagtttaaagttgtagcggtgtttgttgaaattaatagggaaaatggaggtctaggcattacagagaatcaaatttttgtcccggaaaaacctgaagggtgtagaaaacatctcccagatttctcttgaaagactttttcttttcttgggcaagtctggtcctgacatcagctgaacaaaggagggattggtatctggacatttaataactcttggcatttaaaaaaaaatcacataattattttcaaaggggagtaaggaaagaggcatattgtctgtattgtaaaagtcaaattttcaaaactttaaacaattaggaatattctttattgtgtagatagataccttttcctaaatattttaaaatatgtagttctctttattttttgtttttccaccatggatggagatacagcttatggctatagaggtacatttctatgaacaatgcttgtagttttaattttaagagtacaaggtgataaatggaaactgacactcagctctaacgtcaaggagacagtctgcagtgatgaggactggggaaattggagagttcatgctgtaactgaaatcagtagtcagaagctatttttatagtggcgattgtattgtacagtgtcaccatgatgtatattgttataatttacatatatattatctgttggattgtatcaataggaattttcatttcctgatattcattaagcatccttgaaatttgccccaaagtgttactgattcaaataatcaccctttccaccaaaaaaaaccctggtttcctgttaacagtgaaggaattttagggcttgatggggtgttatgttccttggtacagacagctgtggaagacttgagttctatgttgaaactggttttaacttgtaatggtgtggctgatgttacccgaccaacaccagatttcatttcagttaattaaataagtacttaatgagaggaagaaagaactgagcagtgttttatttaggacttggagaacatgggtgagtaaacagtaacaatgtcctaaatgggaaaggtgttctaatttcccaaaagtcttcttgtaattatatttgagacatcttacaatagtatctggctattaaggcagaatgtatttgcagatttaaatattttgcaactgcccaaagatatccattagtgtttggttttctttctaaataagacctgtgacaggtctctgacaaagacaagcaactgtccatggagacttgatgtcttggaggtcaactggagaagattaaggtataatatctcccatacctctaagtctcattcccatttaataaattaaaaccactgcatattatatgttattcgtatgtttatcaatactcctttgaatttgcattttcaactggtactacttctagggacagcagactagtgagcatagacttatggttaagagcctgacttctgagccgttacctgagtagggcctatgtgggcattgtgcacttagaaaaagatatcctttctgagctatgtcaccagaaaggcacaggcttccacgcagggctggggctagatttcagcaccacccatccctctcatccagatagctttatgcaatgtgcacatcactcagatggaacaccaatataccagttaaggcacattttcttttatggtatggtggaaagaagagaggttttagaataagaaaatttggctttgagaccaaattccaccagcgtgtttttttcatagagctataaagtaaaaaaaattgtatctgctcctcaggagtttttgtgacgatcagatttgtagtgagtgcactgaagtaccctgcaaatgtttggggtgtgtgtgtgtgtgtgtgtgtgtgtatgtgttttaaaactatggtgccattgtgtaggattttagaccaggtgttcattctataagacacgcaacagcttggaaaccatttacccttttgtgaatcaatcattttggtggttctagaaacctttattttatttttatagagacaggttttcactatgttggccacgctggtctcgaactcctggcctcaagtagtcctaccacttcagcttaccaagtagctgggattacacgtgtgagccacctcacccagccctttttccttctttaatgggtagtcaggagacaatttctggatttgggcagtgagactccacataataattagtgatcctaataatatgtaatattaattgagtgtttactgagagcctggcactgtgctgagtgccttacacatgctctcttcttgaccaacacaacagccaataagtagcacttaccatcatcattgtgctgcagaggatggcactgagtgagaagctactcagcaataagtgcttgagttggtggtatgtaaacacaggcagtcttccttgagtctacctgcttaaaccctctgcagcctacctgcctttcccccttgcatttctagaacctcaaaagcaagttcaaatggtcccatggtctgagtaagaatgtggctgactgtctttgggtaaaggacgagcatcatttaacttgagttcattgatgacaagcaattactctctgaatcttcggaataccagctcaaagcatcttcagaatggacagtagtagttccagtagtaagaaggtatatctgcaggattctccattttagagtgcaagtactcgtgcctcatacttgctccctgtgggcctcagctccataccgttgtgcatcaggtgattccatgtacaagcaaattcatgttctatttcttttttgttgtttgtttttatttttgtttttttgagacggagtcttgctctgttgcccaggctggagtgcagtggtgagatctaggctcattacaaccctgcttcccaggttcaagcaattctccttgtctcatccttttgagtagctgggattgtagcacccaccaccacacctggctaatttttgtatttttagtacagacggggttttgccatgttggccaggctggtcttgaactcctgacctcaggtgatctgcctgcctcggcctcccaaagtgctaggattatcacaggcatgagtcaccatgcccggcccatgtcctgtttcttgatgtctcatttagacagtgccgtcagatccattatttgtcagggtatctttgaaagtcttagacaacatctgatatcccctggtaccaacaatgtaaggcagagggctttttcctgaccaggttccctttggtctcagagtggcccgttgacaaacaccaggctataggatagacattaatgttacagtggcctgatgaggaagagctactcatgatggtcccatgcaggcttacttatcatatcaaggattcaactcttagaaaaagctttttagtgcctggaatcagagtgggactcaagggctgaagctttatgaagttacacaaagagacacataaagtgggtgaagacttttttctgcctgatttccaggagtctatacgggggaaggcataaaccctggctcttgctaaaatggagaattttggccctgcagaagccacaacaaaatacctggaaaagtgggtggtgacaatacattcaaaacagtgctttctcagtgctgggtaccccctgggggaaaaaaagacaaaaaatagttgtttgctcagattcaatgaaataaccactcaaggggatttttttttttttttttttttttttttgagatggaatcttgctctgtcaccaggctggagtgtagtggtgcaatctcggctcattgcaacctctgcctccgggattcaagcaattctcctgcctcagccttctgagtagctgggactacaggcgcatgccaccaggcccagccaatttttttgtatttttagtagagacggagtttcaccatgttggccaggatggtctcaatctcttgatctcatgctccttctgccttaccctcccaaaaggggatttttacaaaggaatatggcaagggagaaaaaccctgttgtgtcattattttttattctattttgaaaatcaaaaggaagggaagtgcaacctgttacatggaactgaaattatcatctccctggtgcctccatggggccctttgctgttgtgatggataaattgcagttcgagaatgtgtttgagtgcaatctcattttcatatcatcagaatcttctgggattagttaaatctcattgaaactgaggatttgttcaaactatgcatatctctcatatcttatgaaaagtaaattatctagtatacacattacgtctgtgtaattttacttttacgtagagcttcacattctgagatccaatgaggtggtttcatcctgtcgttatgggaaacgtgaaatgtcaaccttcagagagggtaaccaattaatggctgtggcaaatgaggactgcatgacagagggaaaatccaaaaacaggaaagagtaagaagaatagaaagatgttaaagcattgccaagaggatctagcatgggccccagaatgacactgaaaatttatttaccttccatgtgcctcagttttcatccagagaagtagatttcgacctggtccagtggctcatgcctgtaatcccagcacgttgggaggctgagtcaggtggatcacttgaggccaggagtttgagaccagcctggccaacatggtgaaacaccgtctctactaaaaatacaaaaattagccaggtgtgggtggcgcacacctgtagtcccagctacttgagaggctgaggaagggggatcgcttgaacccgagaggcagaggttgctgtgagctgagatcgagccactgcactccagcctgggcgacagagccagtctccttctcaaaaaaacaaaaaaagccgagcgtggtggcacgtacctgtaatcccagcttcccagctactcgcgaggctgaggcacaagaatcgcttgaacccaggaggtgaaggtttcagtgagccgagattgcatcactgcactccagcctgggtgacagagtaagactgtctcaaaaaaaacaaaacaaacaaacaaaaaaaacaagtagatttctacttttctaagatggctaacttaaattaattgaaagttttgttaaaactgttactttttttttttttttaccatttaaagttaaaaattttttaatataacccagaaacacttgactttgagagaattctgtttattttcccctttcattggattatggccaacattcctgactggtgcagaatatggtatcaaaagaatgtctgcagtatgtagccagtgacctttataacaactgtgtgcattgcatttggtggaacagtgtttaccatcttactttctttattaactttgggccagtagaacctgcttgttttagctttagccatggcaacaggccaaatatcagaatgactccctatactacttctgcaaatactttaaaaataaatgtgtccttcctcctataggagctagagttaaaagtaaaaaagtaaaataaaagaaatgtgcatggaaactctactctatttttctggtagactatgatttcttaaagaaaattttatctggagaaagaatttaattagcaaaaggtaatactccttccgtgcaattagagaaactagagatagcaaagagaggccaactgactgctcaggtggagtttaccagcaggtagtactttgatgggtgttatgccattcccacccctttttttttttaacttcctggctaattcgtcactcattcattcattcatttattcacttgttcactcatggaacagatattaggtgcttatcacatgtaggcaccaaggatgcagaaatacatgacaaatttctttgcttaagagactgtattcagcaagaatctgctgaatagcacattctgagtcagaacaatagatttttaatatggaaattagtttcttggtttttgataagacttaatgagaggctttcaaatgcacactgtaatatatgtgccctttatggaaaatagttatttgtgctgaatggggattatagcatcacaaaatgtccacgcttccatcctaggccataggtggtttgggactctgccccaggctgggctttgagagcctgaacgtggccaccagaatggggcctggcctgccccactgctgtgggcagtgatgcaaagagagaatcaaaggtgaaagtagatgcaggagccaggagagagccaggtagtcaggagtctgacccctcaggggcttgagaatcagatccacagtagagtcttccactggggcagtgaataggggcaatcactgcatttcaaacaaattacagataattagatggtaactcattatggctgtgttttgcacactaggctctgtgaactgctggggatctgtatacctctcagagtctaagttctctctataatttttaaatttgatattttcatttttgttatgatgttaagaatgctaacaagataaccttgatacaagtttatttggggttatcagaatgaccaccttatgactcaccactgacacccaactttagtgtttgagttggcacttggatttatgactgggttgaccgcatatcagttgttatgagatattgagtaaatgacagaggcagcttgactatgtaacagatgcatttgggcaaaagaagggcaaatgattttgcagcacactaagcaaagaatagagaaaagttgtggtagagtaactgctttgtgtaacaaagataatgtggtatgctgaattcaggagaacttgggccatgttactctgtacagcatttctgatcaagtcgtgatttagttttaacaaaacaatctcatcttgcacaataagtaaatgtggttatttcagactttcattggttttataattttaccatatttatttttaaatatagcttggttttataattatattataaatgagctttgaacataagaagtttatacttggttttatgtttgtgtgtatttaagtaacaccatttcaagacaaggtagtattgggggtaggggtgttgtgagaatgtctctactttcaagccccataattcacatttaggaaaagatgtaagaggagaaaagtttgcgcatgttgaccctgagcagctgtccctcaagcatcccctaattcttgaggttaataatttattagtgttctcaacaaagaatgtatttgacacaggcacaaatatactttttaaaatttttaaaatttttttttttctgaggcggagtctcattccgtcgcccagggtggagttcagtggtgcagtcttggctcactgcagcctccacctccaaggtttgattgattctcctgcctcagcttcccaagtagctgggattacaggcatgcaccaccacgcccaggtaatttttgtatttttagtagagacggggttttgccatattggccaggctggtcttgaaatcctgacctgaagtgatcaggagtttgaggtgatcaggagacctgccttggtttcccaaagtgctgggattataggcatgagccactgtgcctggccaattttttaaagttttgagtaacaatatatttatatggttcaaagatccaaagatattaaacagcatacagtggaaaatttctcagccctattatcaccgactctaggtcaccattgtatttattttttcatgttctccagattctttttgcatgtacaagcaaattacaatatgtaattttatcccacacttccctgaatcctttgtacaaaaaggtttttccataccgtgcttttttcagtgaacaattgccgtgcccaacccctattaactccaggagggaaggcaccaggctcaagaggccaaagatgagatccgcatccagcaaacgagatatggggttttactagagggaacttatttccagagtggtccagtgtcagtgagctggacaggagaactgccaccagttgtaaaaagcatgcactttatatcacattttaacttagcactctccccgtaacaacctccacccagcaaccttcatttaaactaaaacaaagggcccccatcccctgtacagctcttgttccgctggacctgacaggggttcagatgttcctcatagatgaggaatgaatctccaggttggctcctcttgaattccttaacttggaactctgaacacacaatcaggtgcatagaccatacagggtcgttctcagggtatgcttaagttattgctgtcaggttcatctaccgtacaatggtatatctttctgtatcaaaacatagcatgtcatctttcttttgctttttattttttatgattgcacattccattatatggcaatgccatcattttatttactcctctgttaatggacgtttattctatttttcggcatatactataaaactgttgcaataaatagccgtgtacatatgttatttggctaattgtgaaatatatttgtggaaaaaatttcaacaagtgaaatcgtagggccattggtatatgcatttgcaattttgataggtattgccaaattccccttcctaggggttttaccaagttgcacgctcacaaaccatgtgtgaggaatgtctgttttcccagtcttgcaaaacagaatgtgttatcatattatggatttttgccattctgacaagtgaaaatgatatttcagtgtacttctaatttgcattttcttttaagtgttgttgaacattttttcatgtttacaagccatttatagatttttttcctataaattgtacttgctctttgcccactttgtttttggtggttgctccttttcttattgaccaatttaggaactttgtatattaggtacatgagccttttgtgtgtgatctgagttgcaagttttttttttttttccaatttctcttaatttaatggtgtttttgacatgtagaagtttgaatttttatgtagaagaatatatcaggtttttcatggctttgggattgtgagtcacagttagaaagccttcaccactctaaaattcaaagagaatcttgaagaaaactttcaaaattttgtatgcatcagtgctggttaggttgccattgagaaaatggccgctgtgtacctgggccagatcatagttatgtgaggctggaaatttatggctcattctacatcattcttgtctgtagcatagcttcagggagctggtgctggacaaagctatatccagttgcctattgaactattaacagaccagctccgtccttagcttgtatcccatttctttttcttggtacttttgagtggatggtgagaaagaagaggtagagtagaaatgaccagctggtccgggacactgtgccatggccttgcattaatcaggcctgtttggtcccattcacaaatatgccatcatttgttatttttatgacatttagtatctcaaatgcgttcagaaagcaatgccacctcaatagttgagaagtggctttgatcttttaacttgacatttttggctggctcacacctgtaatcccagcgctttgggagtctgaggtgggaggatcgcttgaagcaagcagcttgagaccagcctaggcaaaatagtcagactttgtctctataaaataaaaataaattagctaggcatggtggttcacgcctgtagtccaagctactcaggaggctgaggtggaacatttgaacccaggagtctgagctatgatcacaccacacactccagtctgggcaacagagcaagaccttgtttctaaaaataacatagataaataaatatgaattaaaaataaatatacgacagtttgtggggcttatatgttaaaatttttctcatttcagtaattctaagagcctgtcccaatttgaaggaatctatgttaaagactgggaagtaggccgggcatggtggctcacgcctgtgattccagcactttgggaggctgaggcaggcggatcacttgaggtcaggagtttgagaccagcctggccactatggcgaaaccctgtctctactaaaaatacaaaaattagccatgcatggtggtgcacacctgtagtcacagctacttgggaggctgagacaggagaatcacttgaacccaggaggcggaggtttcagtgagcccagatgacgccattgtactggcctgggcgacagagtgagaccatgtctcaagaacaaaaaaaatctgggaagtaaagacctgaagccaggtctgtggctgacaccttctcttactaaacccttcaaggacactggcagtttggtaacgcaggttgaagccataatgatctaagttgtggaacatggacatcctttgtattcatgcaggttacccagggtcctgagaagagaagctgagagtacatagcatgtaacagtaattactaagcattattagagtttgtaattcaagatgccataatcactcagacacagtaaggcctttcttgtttggaagaactctaatgagtgggtcctgtgatttccattatacaatgtcatttgatagcctaagaaaaggttaaacatttaccccctcacaaagaggttgaatcaagtaaagagtggggaagggacagaaaagaaaaagggggattgagaggtgagagagaaccccgaagagtaataagctataactcaatggggaggagaactcccggtgaaatccatgttctgagaaggaaaggacaggggagaatcagaggcatgtccaggagggggtgagagtgacatttcagacaaagtagtgatgagagtcttttcctagtaaaatttaaaaaagaaataacaccagcctggagcagaaaataatgttttatttgttttaataataattgaagagtaaaaagatagtttacaagggtatcatttttaagaattatcattaggtcagaattttagtgttctctatcattatgtgatttgccagcctagcttctccccactcatcccaaggttccttaagatcaacatggcattaccaggacccagcccagtgccagacacatggtaagtcacttagcaaatgtttcccagatgaacaaatgattgaatgataaatgaatttgctgtttggagtatatttagacctctgccccaagtttaataaaaatatttatggtgctggctttaagacattgagttacctgcctatctgcagtaccagatggaaaggttaaggggaaggatttcaacaaccacacttggttgcagtttacattgctgcttctctttatttctgagcttttttccccctctttcattaatggaaaatgaatgagtgaaatttaaaagtgattagtggaatttctcaggcatgttcctttccttgtttccatgccatttgaagctattatggttgaagcttggtctgagtaaacattttctcaccccccataggctcccctgctactatgaattgaacttcagttaactacttccattgattaaaaaacagactcctataggagtcccaggacaggggaggaataaatcctggcctggtgatgggacaggccagacctgggagaatgggctaggtatgtagatccactgaggctaggcatggagtctggtaagggctcagcagaaggcagttggttaaggtctaggccgagatgagcagatgtgagcaggtagaaggactacatgctcaggagatatgaggtgttgggcaagttatcaagacgggcattcagtcacaggagaacaattctagacactgggtcaaaatgatcctgttattaataaaaccagcaggaagatgggggtttggaatctatcaacattccagaagttacacaaatggggattacggagaatactgaaattgttatagattatcagctaaaaataatgaaaatgggaaggatgctgtggaatctgaagtaggtagggattgaaataaggttgaattttctggaagctagagaaagtccaattattcctctttgtatttgtgtgacttccctcttagcatcctcaactcccttgaacttatcctagaagctgatgcatcgacactccacaggctctggagtccagccgccctggcccaatgactggagctgccacttagtagctgccacctggtagctgcatgccccagtgtcctcattcatcaaatagggataataattgcatgtatgtcttaggatattgtgaggattaaattagaaaatgcacataaagtgattaggagcctacctggcgtaaggtcaccactgttagctattactgatgatatttgattgttgtttcaagggttaattgaaatagtgtatgtgtggcgtatctagtacattttagtttcacttctgcctttttgtaacaaagccaaccagaatataaacaagatttatagtgcaaatggagaccatgttccccagaccccgctgcaccctcagagaggggcccccaggatctccagtcttccccacccttctaggtccacttatctgcggccagttaggtgcggtgcaagtccgggaaccttcttcaaagactggctgagctgagtgagggctctgacctcggtgaaagagcactttccaggagcaaagagagaaaggagctgcacttgcctgttgggccactgtggctcctgtctgggcgcacacacaaagagctggtctgtggtctcacctacaagggtcatgttgttcccttccagagaacaaacagaaaatattaaacctgctgaggctggaacttgtcactgaggttagaagcttacgggtcaccttagaaaccagctcttcaaaggttactcctccaggaagagggtgcattaaggagcctttcccctaacagaaatagcaacagcagagaacttgccctcttctctgggatggccaatattaccacccaggtaatatgctggtatcctcactggccctgacgggccacagcctgcatttcctgtgtgtgggaagcagcagaatagactggcttggacagttgagcaaatcccagctttgctcacttaatgtctcagcctccatttcctcatctgtgaaatggagataataattagctggggttttgtgcagattaaagagataattctgtattaggaaacctcctagcctaaaagaaggggcttaataaatctcctcttcctcataagaagtttcctaactggtcttctgctcctgttgtctctttcctaactaccacacactgttgttagagtggtttttatacaacaacacatgtgactcctgagcccagaaactttttgttttattgataaagtttaagcagtttatcttgaggctgcccaccacaatctgatgtctatcccaaacctttcaagcactcccttgctattgagctgatggacttactgctccccacacatcccatgtgccttcccaccttgggggctgccttcagccaccgcaatcggtactatttattgaacacctaccaagtgccaggtgctgtgcaaaattggttcatgtgcaatatttcctttaatcctcattacaacctctcaggaagatactattatcttcattaagtgggtgaagaaattgtggtttttatcagttatatagcttgccccaaggtcatgaccctaggaagcagtggaacagggattccacccaggttcttaatgcaaagcctgtggttttgaaaagctaccttccaccaaacccaactccaggaggcagttcaaaacagtctcctgcatgagtatgccagccttgggtaagtaccgtgtaacatcttctgtattacccttgagctatgtacccttgaactgactgagcaaatgaccattctaatgattgctatttgtatgtgctgcttctttcttcgcagccagatcctattctcaaagacatcagtgatagattatatttctagtgcccagcaaagcttcctctccacaggtgctcagtgtctatttcatgatgctaaggatgaaatcacatcatgcctccaggactaaggccatatttttcctttacctcttctagacactaataatcatggtgactacttcctgggattcagaacataactttagcaagcacttccttccagtgcccagcttccttctctgtagaaaaagaagatgcaagtttatgtcttgacgctccttccctgctccaaaattaagcattatttaaagaaaaatcctagttagattacatgagtgagagactctacagtttttgaagcactcccatacacagtatgtcatctgtttctcagcagccctgggagactagcagggaagatgaaatatccctgatgtagtggcaggaaactatgactcagagaagctaagtgacttgtctgaagccacacagcttgtgagtggggaaatgaagacttgaatccactttcttttatttatttatttatttatttatttatttatttatttatttattttgagatggagtcctgctctgtcgcccaggctggagtgctgtggcatgatctcagctcactgtcacctctgtctcctgggttcaagtgattctcctgcctcagcctccgagcagctggaattacaggcacccaccacagccagctaatgtttgtatttttagtagagactaaaaatacaaattttttttgtgtttttacaaaaataaaaacagccttgccatgttggccaggctggtcttgaactcttgaccttaagtgatccatccaccttggcctcccaaagtgctgggattacgggtgtgagccaccaggccaagactgaatccactttctctgattactttacacaacactaggtaggaatattagggacattcttattgctgtcatagaaataggccagaacaaacatctaaatgtttttccttagactgctgggtgctctttcggatttaagttaaatgagcttagtttttctaggggtttccctggtgatcttctggaaattatttgaaaatagccatgttggtaatttcctaatcatgtggcttgttcgttgtgaaaatgttcagtcattgttgttgcttattcattggactgtctgggaagagctaaggaggtatgaggccctgggtttatgtggggtaattattacatggaggattatatagggtagctctgactctgttttcctcagggttcattcagaggagagagtaatgaagaccagagatcctcacacttttgcaaagaggggattgttctgtcttaataaaaatgttcaaagaactagcataaagatcaggcaaatgtcctgtgagtcacctcccaatgtgcatagctgaatgtactttttttttttttttttctgaaaaaaggaacagaaaaaaaactaggtatatcacatttaaataaaataaagcatatttcatttaactttttaaaagcaaactatggggaaactatatactatttactcaattgaattagtatatactaattactcaattgaatcccatcagtatgcattgaaattaaatgtatagaaatattgtagagtaaagcactattatctaaaatgcttttatgctttatttgttctaatacagagctttctacctattttcatatcatagcatacttagaaaatgatagtgtttgcagggcacaaaaggtatcctaagagccaagagaacaagtatattgctagcttgtcatcatttcctggggtaccactgggaagttgtgacctgtagacttaaagaaataagttggggggctcctggggataccatggctttccagtctgtctttcatgactgcactgtgttctacccagtgggaaccctgagaacatgaaacacatacttgtcccaatcacataatcttcacgctgcacctgagctgtagaaagaatctgtttccctgatctgtgttctagatttcatagaggccccggccttccaccagcaaaggaaaagttttgaagccagcaagttctgagatgagatgcctagtgctgcccttgcccattttcagctgaaagtgaaggtttattgtacccagtatatgcttcagataaattaatttgatagtcataaatgaaatattgtcccaacaggaaagctgagtcatgtctaaaaggattatgcatggtgaattagccattaacaaagaatcattgccattattgaatcatttatgtcatagttattgaacaggaaggcctctacggttagaagaagcagcttaaatgttgttgtttttataactggaaaattttaaaaacaacaacttgggcttttcccctctccctctctctttcctgacccctctcccaactccggctccaaaacaagacaggaaagttgggcaaaagctcctgtctgcatctcctggttcaggtaacatatgttgattctctaaaggattatgacttttatttagggtgatgtaacagaacgtgaggaagaaagtgaaacctttgtttattcaaagaggatattctttgagaaacactggcataaaataaattcttgcaggtgactgtcttttaaaaagtttcaaaatatttattttgatataacccaagtctttcattgtattattgttttattaaatgcagagataggttgagaccaaacctggagttgctttttttgttgttgttgttgtttgtgttttttttttttttacagcccccattactctaaactcagtttaaatgagcatgttttaaatcagcatagtgggttgtagagggtgtgggtgtgtgtgtgatttttgctttaaggaactaggtgtagacaatataattaagggtgaaaaaaacgtaagttcttcattactttaaatttccccattcactaatcaataatataaaaataatttctcccaccttgtgtttttgctcatcagtttctaactgaggatgtaaggagtcagtgatactgttggtatcctacccctctgttgtgacaagtttatagcatgaaaagagaatggtttcctggaaatgactttgtaattactttgcaaagaagggcccccaactctagtacactacttttgttattgccaatgatgatttcttctcatccattattgatatttttttttcttttttgagacagggtcttgctttgtcacccaggctggagtacaggggcacgatcatggctctctgcaacttccatctccaggttcgagggattctctcacctcagcctcccaagtagctgggactctaggcaagctccactacacccagctgatttttaaaaaactttttgtagacataggagtctcactgtgttgcccttgctggtctccaactcctgggctcaagcaatcctccttccttagcttcccaaaatgttgggattatgggcatgacccactgtgtccaacctattatcaatgtttttcaaaacaggtttcaagctatcttcaggccatgactaaactacttagaaaatttcagttgggcctaatatattctgtaagggacttatctacatttacaggtcatttacatttattgaaaacacatcctgttacaatagacatcttgataaaataagggtgttactggttaccgtacccatggttttgcacagtcaaaccatctttggtgagcttctttgttttgtttctctcccttgttggtgccagggtgttttctttattttcaggtcttccgagctcaattttctctttaaggctttatctagactttagctgaagattgctcccacgttatccatcacaaaatgaaatttgtctgtgaggtccctcagtcttatccaggtggataaaggctaagatagaaatggaatgcaggtggagttgcttgccctcaaagtgatgaggttccacgaaactcccaggaatcaagccaggctgctactgtatctctcccttgcaaatagcatgattgttttaattacagtctgtagccactatttttatctgtgttagaatatttggatgcaagactggaaaacattattgctgttaatgcctttgcaccttcttatataacttgctatagtgtggaagggaacatttactcaaagagcctatccagatggagccaaaggggttagttagggtttttgttggtcactttgggttataaggaacaggagtcattcaaggtactatgaattcaacttgctgggctttgttaccaggatgtatgcaaactgcagccagtctgaaagaccagaagcaagataactggagggtataaactgaaaattctaagctcccccaactgattgattggaccccttctgtcagccaaggggattccaaagtaaacctgaaaaactagttcaggccgtgatgagaaaggggggtcagacatgcctcattatactctccttcctttggaattcaggcacaactgaccagtattaatattaaaacagagatcttaagactgacaaaacagacttgctttgtttgtttgttcgtttgtttgttttgagacagggtctcactctgtcacccaggttggagtgcagtggtggggctactgcttactgcagcctcgatctctcctggcctcaaaaaatcctcccaccttagcctcccgagtagctagggctataggtgcacaacgccacacctggctaatttttaaatttttttgtagagacaggatctcactgtgttgcccgagctggtctcctgggctcaaacaatcttcctgcttcagcctcccaaaattctgggattacaggcatgagccactatgcctgctccaaaacagactctttgtagcagtaaggtgcctaattccaacctgactctagtatagcatcacatgacagagagcagactctgaaaaaattattttaccccaaaatgtatttctttagcatgttttaaaatggtcctggaaagctatctcttatggaggaaatgtacattttgtagaaagtcttcccttttcaggtctttttctgatcctgaagagattagctcagagcttagcaccttgtaaaggtctgaagagaaaacatttgctgtctgttgcctctcagagtggccacctatgagacatcatctaaataataagaattttggtctccataaccccttatcttaacccaaccacttctttctaacgattagaagtctttagatcataactttcaatcgccattaagaaaatccttgaatccaccaaagacccagaagcccccactttgagtggttcctcctgtccagaccaagttgatatacaccttacatgtgttgattgatgtcttatgtccctgtaaaacatataaaaccaagctgcaacccagccaccatgggtacatgttctcaggacctcttgagactgcctcaggccttgaacactcatatttggctcagaataaacctctttaaatattttacagagcttgactcttttttgccaacaagggaagtggctcatcttttcatcctaggccacgttttagccttgtgtgtttgcactaatcaaagtccctggtgaaaggctgcacaaggttgccttattctgtatcatcttgcattcacctcttcagccccccaggctaatattatgccaagggttaccgattctgatttttgccagtgacctttacagaaagcagcaggagctgattggttaagtggcttcatcatttacaaactcttatagtaggatctttaatgtttcattgatcctatagtattaaaaactgcaattacttttgcaccaacctagtggttcattatttgattataatacatgtacattgtacaaattataaaagtacaatgttttatagtgtatagttccaatagtatagaaattactttaaaaaatatagttttttttttttaattctttttcagagatagggtctcactctgtctcccaggctgaagtgcagggtgtggtcttaactcactgcaccctctacctcctgggctcaagtgatcctcctgcctcagtctcccaagtagctggaactacaggcatgcaccactacaccttgcttaatttttaatattttttttgtagagacaaagtcttaattattgcccaggctgtctcagactcctgggctcaagtggtcttcccaccttggcctcccaaagtcctgggattacagtccactgtacctggcctaaaaatatatttcaaataataaaaaatgtttctgatttctgccatatcaatctcattcccaagaggtaaccattattaagtttaatatgcatctttcctggcatttcctttgttaatataagcacagagtggctggtctcctgggcttttttctttgtcttgcttatatgtagctgaaggcaacaccatgggtacttagagatttaatgaatactcagtggaaggcccatgaggcggctcacacctgtaatcccagtgctttgggaggccaaagtgggaggatcccttgagcccaggagttgtagaccagcctgggcaacgtaatgagacccccatttctataaaaaaatttaaaaattaacctcaagactcagaccttagttatagattaaaagaagttaatcacctatgtctttagatgaatgcacacttacatgtagacatatagcttagaaggtatataagctctggaaaactgtaattttgagttggtctggtgataatttccaggccttctccctgtaaccggttgcagaaataaaaactttcttcctccccagttcatttgcatctcgttattaggccatgagaaatagcagcccgaccctcagtttgttccggaaacaatcatgccactgcattccagcatgggcaacagagcaggatcccatttatctatctatctatctatctatctatctatctatctatttttttgagatggagtctcactctcttgcccgggctggagtacaatggcgtgatctcggcttcactgcaacctccgcctcccgggttcaagcaattctcctgcctcagcctcctgagtagctgggacaacaggcgcccgccactacgcctagctaattttttgtatttttagtagagatgggctttcaccatgttggctaggctggtctcgaactcttgacctcgtgatttgcccgcctgggcctcccaaagtgctgggattacaggcctgagccaccgcacctggcatatatatatattctttttttttaaagagcatattcagagaatacttgataaaaatggtaaaatcaatttgattcattttgacactgtaaacttcctgacttgagataaactagttattaaacatcaagtgcctgcaactggagtaaggaatgtgattcagtgtgtatgaatacgtaccagtttgtagcattgatgaactccgtataccagagggaaaaaatgaacttcaaaaaaaaatttctaaaatgtaaacgccaggtccctctccaaggaagtgtgtttttgagggagcctctcatttagatatggactcttagctagcatgttgcaacctagcaacaagatttctaacctgtggttatctgttgtgaagtagcagcgttagtataaccatggtaactgtctgtttgcttgatggcatgagctctctttgagtaaaaaaagcccaaaataaaaggttggaggtaattatatattttttgttttctcatcataaatgtattgaatgtacatttgagatatttttgaaaacacagaagaccataaaatagcagaattgtcatctcacctactaatgttaatattcatatttagttttgtattctttaaaattaatacatgtattgtaatttgtaatataggttatattatacttttttagacaaattgggatcatacagaatagtaattagttttgtgctgtttttcatatgctaggtgcatttcaccatgtcatgaaataattacttgaaggtatgattttaaatgtctacatattatatcaatgtactataatttatttagacattgtaggtcattacctaaatgtaattttgaattcagaattatttctatttcatattatttcgttgccaagttgttcttcagcttatcgatgctctcaattattggcagttgaattacgtaagaggatacatgaattagaagaagggttgacatctcaggacagtgagtggcttctgcaaatgtggccttcctgagagaagggatctgaggggtattgcccccaggtatccaggaggggattgatatagctaatctcttagaaacagaggtgggcttcatagcgatgaactcttcctaccacaccaaaaaggcccctccttcctacctctcaaggttgaccttggctgaccttgacctttgagttttaggttttcagacccgcctctacagccaagattagaatcaatataacttcctgttgcacacagaagcagctgtaaatctaagacaatagcatccactttcctattacgggacttgaggggaaattaaattaagcccccgccttttgaggggcttctttgaggaattagatcacacaaggcttggcgtaattttttaataacttcaatcacattgtcctcactggtccgtatcagagcagatttgagtcctgcacaaagtctgaaagcagcaagcttgttcgtggggaaagaatgagccaacacactgctggggtttcaaggccagcttcctaggtatgcttgtacacaggaacctacacttagaaaagcgctgggcttggcttaatattctactgctgctgccttgaaattctgaagaattttttaacaaggggtcctgaatattctttttgcactgggccccacagattatgtagttggtcctgattagggtgtagagcaaggtattgcagtaataaagtatttgaatcattccttcctcagaccacccccccacccaggagaaggaaaaatccattccaactgttctcactttatgcaggagcaggtgcttgtgactttaagagatgggcttgcaggggaaatggaacagctcctggaagacatggccttttgagggtgcttaggagatttgagcagcacatactaattggatacagataaaatgctcttcagattttagttttctgctctgtttgtttagtcataacccagcctgtgttttatcttttgaggtggaaaatatgaaagtcacggcttctctctctcttgttgagcatttactttgtgagtacttatatgaacatgtatatcaaagaccctgtgatccagaatactgcttaaaattctacagagtgggcgctccacctctcttagctttgtcattcttctccctttagctcactcccctctttgtaagaaatgaggcaggggtctctcggggatcacctaacacactagttcatattcccagcactttttaaccagtgcccctcgggataaacatacaacaaaaccctcatgcctccttcattcacatatgttgagttttatgttagtttgttgagttttatattggtttgcattgtgaaaacagtcattttttcccaaatgagagttatagaattgcgtgtgctctgtaaagctatataaatgattctaagaaacacagtcccaagaacatgactgccctagagcctctcctcccctaatttaatactgtttaaagcaggggttcctgactgtcaggctgcagacaagtacctgtcagtccgtggcctgttaggaactgggctgcacagcaggaggtgagtggcaggtgagggagcatttgagctccacctcgtttcaaatcaactgcagcattaggttcttacaggcacgagaaccctattgcgaactgcacatgcaagggatctaggttgcaagctccttaagacaatctaatgcctgatgatctgaggtggaacagtttcatcctcaaaccatccccagaccaccccacccccaactctggtccatggaaaaattgtcttccatgaaaccagtccctggtgccaaaaggttggggactgctgacttaaagtaccaaattttaaactgttaaccagtctgcctccagctaagaacagatattgagattaagcatttaggaacctagaacaattgtctgttaaatttaatcaaaaaattggaagcttgtattttttatgtcttttttttttttagtattccatatgcatcatatttttacaaaagtgtcagtctgtaacagattgaaaactaaaaaacaaagaaaaactgatttttttcagccccgtcccccagttggcaaaactgattcttagccacaatgtttgagaagcactctcctaattgagtcaacagtgtatttcttagacttcttaattcatcttttgacgaacaatgatgaattggggtgtgtgtgtgtgtgtgtgtgtgtgtgtgtgtgtgtgtgtgagagagagagagagagagagagagagagataaggctggttccttccccacaggtaacggtgtcatccttgaaggcagccatgatacaggggcagctagaatggggttatgagaagcagctattgaaattgagaggaaagagttgtggatggccgtttaaaacaataacattccatagtaggcttgttgagaaccatttttatctagagatgctggagagtggaagaatgtatgatacttatgaaaacaaaattgctcccaccattcgacactgaaggtagtatccaagtattgggattggttacatgtctatccatgcccttctaatctctttcccctattgccaataatacctgcgcctgagaataatataatactctttgaggtcacggaacagaacaatacattgtacccatctcctgtcccagccaccttccctgacaaacctcccacatcccccacctccttacccatagaacagccaccacctgtattcccctttcatacataatgtggctggccaacattagctcacatgtaccttcacattggctatggtgcctctaggaactctggcgcatttataattatggagctgaccctcacctggccatttcagcattcttcacacctgcacacagaaccattttcctaatccctcccttggtcccctggccagtatggtgtgcaaaccgtatttaccagtctgtgtgttgggcacaagggtttcaattggttaattaaatctgtgaattttcttgtttattgacaattgccaaagtaggagaatagagacttgtcttttccctgaatatttctgcttttgatctaacttaattccagataaatttcaatactgattaaaaagtaacaaattacttctgaaattggagaaattgatttcccaaggtaagcagtttcagatatgagtttggtttgcattattacctcacagtctttgaaatgggatttttagctgccttctcaagtctttgtctcctttctaagattcttagacaattttaattatttaaggcagatttgctagaacttataatattggaaactatggtacaaagatgaattagttcttaaaataattctggtttctcccaatgttcatcaaattgagaattttgtggtccacattataaatattcagcataatgtgctgaacattattgtaggctttgagactcccaagataaataaggcagtgcttgtccttaaattgcccagggtctggtgggaggaaaccatactttttttttttgaagtaggaaacaatgtagtaattaccttagtgtaatataagtcaagatggttggcagaacccaaaaaagctaacagttaattgccaggagatttggggggcttgagtgttgagaacattggttgggagcgtgccggagaaaacagggacacatgcattaggtgaccttgacctggatattgagggaaatagaagtttgccaggatgagaaacacttgtacaaagccttggaggctttaaaaagtaacaagcagacaaacaaggctcattaaagaagtgtaaaagttatggtatggctagagagtttgtaggtatgtcagcagctgcttctgaatgtttccatttaattactttctgaccagtatcatgtaagtgttaagacttctagagaatgtatcacttacatctaaggagcagcagccagaagaacaggtggcagcaggtggcctacagaaacctaccatcttcgcagatagtaagccaggcatggaagtgatgcactggagaggaagtactgagccaaaagtcttgcatgtgtatagaagatatataaagaagtaaatccaaggatactgcatctctggctttagggagatcagtgaatatttgctgaaatgaatggaaatccagtatgtatataaatggaagcttctagatggtgaactctgaatgtctaatgggacctcttagcaaatgtcaccacaatgggaaaggcaaataactcacaaaaaaggaaattggaatggccaataaacaagaaaattaattagtaatcagaggaatgcaaatttaactaacaaacaggtaccatttctcactctagagattggtgaaaataaaaaaaaaaacctggtaatactaagtattggagatattatggagaaacaggtattctcacactttcttgagcactttagagagcaattttgtaatatctaataaggtttagaaatgaacttaccctaggacctgacaattccattctaaagaaatgtgcttaggtgcttaaggatttatgcaaacagaatacgattacagttgcataatagagcaaaaagtgtggatagatccaatgtcctttactaggaaaacagataagttgtaatatacttatatagtggaatattgcacaatattttaaaatgaatgaatcagatttacaagtatattctggataaattttacaaacatattgattgaaaaaaataagctgcagtgtaccttgcagacaaatttgtaaaatactcatcagttttaaattttttatatgaaaaacatggctcagtaaaagtataaggacctggataggaagaatacaaaacaatttaagaatggttaatggagagagggaaatgggattaaaggagtgcaaagggaacctcactgtggctgttaccttttctttctgttaaaaaaaaaaatagatcggaagcaggtaaggcaaagtgttaaaaaagtcagagtagtggtacatgtattttgtaatttcctgtacttttctattgttttgaatgattcattacacaatagtgcttagtgcatactaagcactttctagggtagatactattatttctttatcaggaagcaggggcacagagagattaagggactggctggtatgtgagccaaagctgagcccactcccctgaccactctgccatggatttcctggatctctgcttcattttggaccagcgtcaggactaatggagtcggggaggccaagtgatctttaggatcctgtccagtttaactttagccctgatcatcagtagatggatcgatcatttccatgagcacatttctgcatggcagcacactcctgacatagcccggcctgcagagggctgacgggggtttctctgcagcactgtggacctgccacctgtaccagctcccagctaggctgcagttgtgcagtggtgactgtgcatcacacatcttccagtgcccacaaccaaatgggaagcaaatatggaacaattttgccaagtgttttctgaatctccttgaaaacagcacttttacattataagatgccactgtactaatgtaataggtagatgcagagaagagttattttgagggctgtaatttgatttcgttatcttaggcaatcaagattgtttaacaccagaaatagctgactagaacagctgctaaaacagcgctttgtgtgggaaatgaagaaaaggttcagtattttgacagccatttccaaggtatgagtaatgagacttctaagaaaatcgtaattgttgctgcttttgcagtggggcggggggattctctagaccagatttcccatctcctagtattctacatcaatagaggacaaaggaggagtatttcctttttcccagggtcttgacttcatgtaccaacagagtttagatagcatggtgataatttattatttaggtttaaaacgcacacacacacacacacacacacacacacatgcacacacccctcacttgtccatttatcatcaaccatgtgtttagtgcttactggactccaaagtgcagggcctgtgggtccaaaataatcaattagaccctgccctcaaggaactctcagtctggagagaagaggaaaaaatgggacaaggcaaaatgtgcaagtaatcttaaacaaatgtaataggcattatagaggcagaactgggaggaagagtagagtaggaatgagacggcattaaaagattaggagtttgctgctgtttgaggtcgggggagacaagagcagacagacaagcacaacattttgagtgatcagtgttatccaggcatgaaaggactcagcacttctgggttaatatggaaagagtctgtttcttgatttgactggccaactgcatacctcaattcacaatattactttctgtttggatatccagtgccttaaatgttcagggaattttcacagaaattctctcatttaaatgtatctaatgtgaatatcctgatattatactttctgtaatttacttgaaaatatttcagcatgtacctgtgctacgtacatgtatatctgttagttttcatccaagtcttagtggaagttggtggcgccagttgtgaatgcagaggtagggttggtgaacttgcatctaatgagaaaccctcactccagggggctctgctttaagcaactgggttttctttatctctaattgacaccagaggctttgttaattagaatagtttatgttgaggttggattttagttgggaacattgtggtggtggagatatgtggattgggttagaccttttcagaggtcttccttcttttgtgttacagaggacaaaagttcagtgagccattaaggatgataaaactgaggctccaggaggaagtggcagagtcagaattgaagcattctagaaccaggactgcccctgtccgctgctctgccctgcccagtcaattatgcttgcccttggaagagtcttggtctttgatgatactcagaggcttattaaaccacacaggccgattcttttttgtccttttcttttttttttttttttctgattttttgttttgtttgtttgtttgtttgtttgagacagagtcttgctctgttgcccaggctggggtgtagtggcatgatctcagctcactgcaacctgcgcctcccaggtttaagcagttctcctgcctcagcctccctagaagctgggattacaggtgcacaccattgtgcctggctaattttttttggatttttaatggggaagggtgttcaccatgttggccaggctggtcttgaactcctggcctcaagtgatccacccgccccagcctcccaaagtgctgggattgcaggtattagccaccgcgcctagcccacaggctgattcttgattgcaaccctctaaacccagactaaagtttgtatgccttagaaccaacatatatgacacttgtagtagtttcagcattttatttcttattttgattcaagatgtgagaggtattacaaacactcaattatgagtgatgcatttatgtgtcctattcttccatctgtagataagtgaaaagtcatttaagaaattagaggtctctgtagtaaatccaagtcacagtaaagcaaacaaaaatgcatatgtgtgtgatataatgtggaactctacccccttggaagactttgcaggctgtaagaatttcatttttaatgtatttcatacaggccggagctaacaagttaatttctattgagcaaaagttttttgtttgtttttttcctggtatgttgaggtcagctaatggtcactgtggtttggagtgaatctaaatggattttttgcccttggacaaagaccaaggacaactgtaggacttctgcatggtctacctcacttaggcttcttgattaataactctggttcaggaaggcaagggcagttatgaccactttacaactgaggaaatcaaagcaacgagaagttaaatggcctgtcccactccacagaaatggttataacagagtcagagccagaactgagctcttccgaacatgagttgactagattatggctccttccgtgacaccaggatgccagagcagtgggaagtgaatttcagtggcattgtgcatatcagggtcttatttggtatggccagaaccaaacctcaagacattattacaaaataacatgaggtactggtggcaacattttcagaatttgtgcctcagattcagcaaaacttcaggaaaagcctgcaatatggcactgagctttgctgctttcagtatcaacagttgcaaacaagggaggctggggcctttagcctccatctcccagcttcaaataccattagttctatcccaaagtcatcctctataaacatgcaatctaaataaaggtaaaattcgataaaagtatcttagcaggtttttttcaggtggcctaatccctcattccaaacagcctattacccctaagtcttattaccttcagtcttcaaaaacaatcctggggtagtaatagtgtctccatttggcaattgagaaaagggagatttttggaaataaagtgtcttgggctaatattgtcagctggtctgagctcctgattggtccttctgagtccaagccctgctctatactgggttccatgtagctttagagtaactgtgggcatttacattatgggaatcttttggattcatctttccaattaagggatctagtttattataccttggagaacgtatgtgtgtaatctgtgttattttaaaatactgtagaaaatgtttggtgccaatcccgcttcagtgtggttaaaaggtggttaaaagagaaatttgcactgatgacaggttcccagtttgaagctgtcagaatccttgtactgtcaccaccatacctgacaagttgtctgggaacattggaaaaagattgctgagtgagaaacagggttgtgcgttctccgcatggctggagtgcctcagccgggtcatctgggcagacttcaccttagaggcaccttccacctttgctcactaagctgccttctgctcttaatttccttttccttgtcaattttcctcctagaaagagaaggtacagcctgttcttaagtgagcattggtatactgggcatttgtattccttacaaataaattgctaaattcttttgctgaacattcaggcttgtctggacttggacaatgtgaacaagttttcacatgggcctggtaaaccctggataagtggatcactggggttcttgactgaaagaactaaactttgtgctaaaaatgcagaccctgatcctcaaccttattcctgcatcatttcatagcataaaccaggctctggttagccctggttatcgtgactgatgtcacaaatggcagaggactctgctgtggaaatgggaagatccctctgtttcccggccctagctcacttctaaacacagtaccaaagcactgcctgaccttcttctccacttgatgataaatgccctggggatgctgtcttcttcagttttgtgcccacagggtttgttttgcacatagtaggaatttaattagtgtttgctgagctgaattgtactaattttttaaacataaatggaaagtggggcagatgaaaataacatgtggggcagcctggcagactgaatcagatggacacgactgcttctcgtgaccttgtcaagttgtgcaacttgtgtagagccagcatcatcctaaaatgaaatttttcaaggtgtggttcagtgggagatggggttgttggaagatctcatgaaagggcatgttcatgctgcccctgggaatgtgggaaagtactaaggcaattcttacctgtttctccccactttccaccctcaggcctgctggtgggtacccttgatgttgtgttggactccagcgcccgggtcgctccttaccgaatcttgtaccagactccagactccctggtctactggaccatcgcctgtggtaagcaaccacatccagaaatacacaagttttaaaagaagcgttagggttaacaactttttatcagaaggaaaggaacgtgtacttgctgaatgcaatcactggtattttagggtaattaaccgtagccatttcaacacatgaacccaaagtctcagtggcttaacacaatgaaagtttctttctcactctgatagagtcgtgttgggatcatgtggcctcctccatgtgtagtgacactctctggaacacaaggcctccaaggtcagcatacaagggaagagtgtgagggtggagcacatctgtgtttaacttccttggcccagaagtggcacactccaccttccatttcactcacacttagttggccgagactagtcacgtgggcccaacctcactgcagaggaagctgggaaatgaagagagttgtgtggaatacttggatgtactaagtatatatcctagcacagtacttcctactgagtagggattctttatttctcctgatgataatcagtaatgctgtgctgtgcttaaaatagtagtcaacaatcttgctttggctggtccgaaggtcatgagctatctccattgatcacagtcagttgcagatggaactccttttctactctttccccacttctcactgctgcacttgactagtcttaatttttttttttttcccagacggagtctcactctgtcacctaggctggagtgcagtggcgtgatcccggctcaccacaatctccacctcccaagttcaaacagttctcctgcctcagcctccccagtagctgggattacaggcacctgccaccatgccagctaatttttgtgtttttactagagatggggtttcaccatgttggccaggctggtctcgaactcctgacctcaaagcaatctgcccacctcagcctcccaaagtgctaggattacaggtgtgagccactgcacccagcaaaaaaaattttttttaatcttgcttttattggatctctcataagaacttctagtccaaactgggcaagtttttttttgttttttttttgggacggagtcttgctctgttgcccaggctagagtgcagtggtgcgatcttggctcactgcaacctctacctcccaggttcaagcgattctcctgcttcagcctcccaagtagctgggattacaggctcatgccaccacgcccagctaatttttatatttttagtagagacgaggtttcaccatgttggtcaggctggtcttgaactcctgacctcaggtgatccgcccccctcaacctcccaaagtgctgggattacaggcatgaaccactgcgcctggacttttatttttttttttaatataatttctttttttgtagagatggtgtctctctgtgttgcccagcctagtcttgaactcctgggctcaggtgagcctcctgctttggcttcccaaagtaaagggattgcaagcatgagccactgcaattggcccaaaatggccaagtttttgtttgtgtgtggcttttaaaataaccataagaaaagtaagggctctatatgaacactttttttaacttttatttttttgcctctacttgatttacaggaaagttgagcagattgttcagagaactctcatctataccaccccccatgcagagtttcctctattattaacatcttactatggtacatttgttataattaatgaaccagtgttgatacattatttgtaagtaaagtccattgtttgttcagatttccctcattttctttttctgtttcagtatcccatctggtacaacattatagttagtcggtcatatcccgttaggctcctctgggctgtggaagtttctcagattttcctgggcttggatgatcttgacagttttgaaagatactgatccagtatattttggcatgctcctcaattggaatttgtttgatatttttctcatgattagacaggggcagtagatttttgtgaggaagatcacagagataaagggccattttgtttcaccatgccaagtgtacattttatcaacatgatttatgactgcgggcctccttgatcacctccctgaaatagtgtttttttaggtttgtccactgtaaagttactctgttcttccccttttcaaagtattctctttggagggaaatcactatgtgcagtccatacttaaggagtagggatttttctctcctttagggtagactattgacataatttatggagaattctcttgcacagtaaatttatcttttctccctcatttatttatttaattatttatgtcactatagactcatgcctatttattttgtcttctgggttataatccaacattactttattctttgctcaaattgttccagctttggccattgggagctttttcagttgacttcattcatttttaaaattgatctttacttggtaggaagtgctgtgctgggatctaaaaatataaagacaattatatttggtctctgctcttgagaaacgtacagtctagtgaggatacaagtaaatagtcaattacagcccagtgtgaaccagtgccttacagttccatttaatttctgggcatccaactaaagagaggaatataggctagcctcctgcagaattagaggaggttatctgggtgtgatttcaggctgctggcaagctccattgcctgggtaattctccttcaaggatttagtagtacctgaaattctaacattgtaattatgtctttcccccccccacccccgagatggagtctcactctgtcgcccaggctcgagtgcagtggcacgatctcagctcactgcaacatctgcctcgtaggctcaagcgattctcctgactcagcctcctgagtagctgggattacaggcacgccctgccagtttttgtatttttagtagagacggggttttaccatgttggtcaggctggtctcgaactcctgatctcatgatccgcccacctcggcctccaaaatgctgggattacaggcatgagccaccgtaccaggccataattatgtctttttaaatgtattctgagatgcaaacagcccagcgaatgacaattgactataaccattgtttacacagcccatgaacgaaggcatggcttcaaggtttagagctgcgggaaaacccatctagaagtgaagaatggggattgagtgagaggaaggtgataaaggattaaggaagaggaagctgggactctgacctggacagacttaccagtgtaacctaggctcctggaagacagtgttccagtcttctctgcacgtttacccaccacagagggagcccgtagaagtgaaagtgccatctggcctgccgtagttgattgggaaagcatcacatttagttggcaaacaatctagaatcgtttcatagtcagcagatgaagaactaaaaagaaagaagttaaaagttagggagagccaccaaacccctccacctcatgacggtgtgaaaaggacgctgcagccttcttgctcactttccagcaatcccaccatgagtgccaaactgcctgcgagatcctttgcaggcagcaggtcttcagagccctcagatctctccttacagccctccaggctcggtcttcccacctcaatttctggtgatgtaaggaactggtttgtgtctcctgtgacttttcctctgcccctgagccattacctttgttgtcattgacatttataatgtcactgcctgacgttactactcctcagtctgattctggggctttgccatggtattgctatgaaacagatcttcctgtgaatactcctatgagatagaattgtatgttacaaagctgagttattcctgaattatttgctgagccaaggctaaggaacactacgctgtgaatgctgatggcataaattattgtccaaagagatgtatagttttcttttcccagtgacacttgtttcattataataaacccagaatggttttagtttttgtatatattgattacccatagagatagctccagaatttccttatggaagactgcacagaaggaagtgacaggcgttgtgaaagtggttttttgttgttgttgtgttttgttgcattttgtatttttttttgagacaatgtcttactctgtcgcctaggctggagttcagtggcatgatcttggctcactgcaacctctgcctcccaggcttgagtgatcctcccacctccacctcccaggtagctgggactacaggcacacaccaccgtgccctgctaatttatttatttatttttttgtagagacagggttttgccatgttgcccaggctaatctcaaactcctgtgctcaagccatccgcctgcctcagcttcccaaagtgctaggtttacaagtgtgagccaccacaccaggccacctattaattgttctttcttactgatttccatttaaaatccaagttactggctccttttcatgataagattttaagagcagaagcttctcccttaagatttttaaaatatatctgtatcttattgtttgtaaatttaatgttatttttcataaactacaaagttagtatggcataggaaaatatattaaaaacttctaatttgctaggattttatgaaatattgctataaaagaaacttctgcagataattgggtaagtctaaatcactgccttgtagaatccatgggattataaaacctttttctataaaccttgatcttgtcatgtgttttgtaaatctttaataagcataaattgaattaaagggagcatctgcgaccaatgtcttgacatagaccacatagagcagtagtagtgttagtggtaagtcctagctgtatgatttgccttagacttgagccacatgaaatcaggcaggaggactgttttggaccatcttactgccactgtaataagcacctggccctcggcaatatgaatcatatagaaagcggggtggaggtaccaagagttatttgatgagacattattttcatatgcctctttttatcttttttttttttttttttttttttttgagacggactcttgctctgtctccaggctggagtgcagtggcacaatctcggctcactgcaacctctgccttctgggttgaagtgattctcctgcctcaacctcccgagtagctgggattacaggcacctgccaccacgcctgggtaatttttgtttttttagtagagacggggtttcaccttgttggccaggctggtctcgaactcctgactcaggtgatctgcacacctcagcctcccaaaatgctgggattacaggcgtgagccatcacgcctggcccgcctcttttttatcttctgttagtttatccaagttggtctgaagaagttgatcgtttacatttccttgacatggagaactttaattgggaaagggagccaaaaaactttcctaaacaacgaccatttcatttcactagtacccaaaatgtggtttttattctttttggctaatatgccattatgtcaacaattctagcctacaattaagcattatgcttaatagtttgtacagtaaattctaccttttatccagccagttttgttgagctgatttactgtactctgacaattctgtctctcatggtttaccagtgaattgactattttgcacctggggctcacattggagtaaaaataggtacagatatgctaccagcagctcttgttttggatatggtgttccagaggcagcagagagtccagtccattgtcttccttggccttcagttggcacaggtagaaagccatttggctttctgcccattataaggactagaaggttctaacagtaagaagggttggttatatgatctccatgggaatatgggcacataggaatgcaggtaattccaaggatatgatctaaagaaaggagttctgtgacagctcaggagaattagaaacaaagatacagaaggagctgctggcagttccctctggatgcatctgaccttcaaaaagggctaataaaggaaagcgtggagaggatgtgtttgacggacagctcactgacaacagtgccgaacggtgccttgatttggctgtgtattgattgagtttcccttttctttaccattccagaatgtcatctggtcctagatggtcattgtgtttcagaaatgaaagatagagcagctatcgtcttgcctgcccctcttattgtagtaggatgcagaagcaaggtgaattgtccaagttcacattcctggttataactagttatgtggtgctcagaccaagttctcaggtctccccactcccatcccaggacttcttaagtggcaccatgctggcttttataattaaatattcttttagttagcggctggtaagacccagagtttaattaaagattactaattggttctgctcttattctctactgtagataaagaaaatgttgggtaatttagttgccttctgcatgaggcagacgtaatgtgaaagttgataggtatttttataattatttcttggtctgtgtaactcaaggactattctcgtatctttagaaacacagtgagttaagaaagcaaacaaaaataattgctccttttttcttcaagcaatacatgtttattgcaaaaattacaaaatatagatacataaaatgaataaaaaagaaaacaaaataccacatcacaaatcatcactttcagactttaaaaaatctccaatatactttatatacctatatatacaaatatataggtatataatatatactatgtgtatactatatatttacagtatatataaatatataacagatatgtatttaaatgcaaataaaaatggaaaataatatattgaaaataatttttatgtcaataaaatgtatttccataccatcaattttcttttttcttttttttttttttttgagacagggtcttactctgttgcccaggatagagtgcagtggcacgatctcggcctactgcaacctctaactcccagcttcaggtgattctcctgcctcaccctcccgcatagctgggactacaggtgtacgccaccactcctggctaatttttgtatttttagtagagatgaggtttcatcatgctgcccaggcagatctcaaactcctgacctcaagtgattcacccacctcggcctcccgaagtgctagtattacaggcatgagccactgcgcctggcctatcaattttaataagtagatattttatgtgaatgtaacataaattatctactcagtatgttattggaaatctagggttttttcccctactattactgtattttgaacaatcttagtgaatattctcccaacaaaatctttgcacattctcttaattatcaccttaggataaatttatggaagtagatatcttgaatcaaagaatatacatataattaaaatagcaaaaataaacaagttaaaaaaaggatatgcatgtaattaatatgtctagcctgattgccctccagaaagatagacatttatgttcccactatccagtaaaataaggatgttaactactgattcttattgccaaggctgaatgagttacctaggactctcttctcaaagtgattataaagctgtgagcatattattatgacccataagagattataagcagagttatgtcagaatcttatcagagttacacaagagggcctaggcatataatatgcaccctttgcaatcaaacataagtgttccagggcctgagaggtttgtgctaaatgtatgttagttgggcaatagttaaacagctagtttcttttcttgacatcagaagttagaaatattttctgaatcacatttcaagatgaggtctttgtgttctgctgcttatgataattccaaaagtaactgtttggtgttttctgtgttctaaggacttgacgtgtattacctgacttaatctctagcacaaaccagtgtgttaagtgttgttccttacatattacagacaagaaatctgaaggacaaagaggttaaagtaatttacccacggccccagagttagtatgtggcattgtagaagtttgaaaccaggtgtactttctcgacatggtctgaggcattaagtaatatcgcctcactcataaccaggcttcttcttatttcagataatttaacctttattcatactcactgcacttgtaaaacatgtaagaaggcagcaaagtgtagcaatttagagtgcagactttggatgtgtgcagtggcttgtgcctgtaatcccagcactttgggaagctgaggtggggaagatcacttgagcccaggagtttgagaccagactgggcaacatagtgagactctgtctctattaaaataaataaagaaatgaaaaagattattaaaaatacatatatatagacttcagagccagaaaaatctggatatgtttgacagtttttttgttgttttttgttgttttttttttgaaacagggtctcactctggagtggagcaagccaggctggagtgcagtagcacaatcacagctcactgcagccttgatctccccattcttaggtgaccccctaccttagcctcccgagtagctgggactacaggcacacaccatcacaccctgctaatttttgtaatttttgtagagatagggtattgccatgttgcccaggctggtctcgaactcctaggctcaagtgatccacctgccttggcccctcaaagtgctgggattacaggtgtgagccaccgtgcccggtctgtttgacatttcagtagttaagtgtgatgcctattcttggtaagcacaaataatagaaggcattatcattatcatcttacttaacctgattataattataactttagttagatgtggattttgaaaaagtatattttcatttgtttctaaaaatgtttcaaatcaccatgttatttttgggttttgtcttttgccctctctgaatataagtttgtaatttttctggatgtagaaagtacaagggtggcttggtaaatacagggacagattaaaggttgctccagtatatggagtaatactcttgccttcatttggtatggaaacttcaaaattatcatctttgtgactaagattatattggataaggccataatacagatgatttattcatttggttccctttatttaattagcttcaagtgcaattcatgtgaactcagtgatccacatagcctgttctgaatctgaaaatactaggtcagttgctctttaatccttggaggcttattgggtttttgttttgttttctgctatgtgatgagtggtttttatttttgtatgcacatacaaatgtacctacacatgtgcatacatacacttatgatcaatgagaattcaccattttagttattctgcaatacaggtttttctcaagttctgcagtcccagaaacaaaatgtattattcctaggaggtaggaagaaaaaaatttattatgaatcatgcatcacaaaagaaatatctgccaaatatctatcagtggagccttaaacctttgttcttaatcctcagaggccagaagtgatagaatcattttggaggtccatcttctatttatttcaagtagacttcatgactttaagatagatttcaaactagatgaataattagactaggatgatttcgtatttttcatcattgcagacaacattaaaaagtttgcccaggtatatatttagggcctctggccattaccctaaaaaactgcttgaaatgataattgttcttattttttagaagtcaatgtctaaaccttaagcctatcaagtgttctagtttttagccacagcagagtgctttaacttgcatttcctgaaggattctcatacccaacatcagggttctttgttattccagctgattacacaatcgggtcagcttgtttttcctgctgcatctctgtaaatggggcctttccagaaaatcaacagccaagcccttcctttctcttctgagtgtcctaacacagtttgttcaagctgctgggtaaatagatcagttccttgtcagggtcatgacaaaggagcttcatattatctcactttaataagttctaagacttgaattactgcagcgcatgtacttaatctgcttgagaaatggaagagccatttataaggaacatttgggattcaaacacgtttcctttggagtctcaggtttttaaggagtggtccagaaaaagtggcatttgttctgatatctctgagaggtaacttggacccttttttctggggtgagaagtggacagaagtggccacctgcttccagaagtattttttactggattggcatcttcagatggtgatggtgaattcagtcctggctcgtacttttcagtatcctcgtacttttagtgaccagaacctggagctggaacacctgtcctcactgcttctttgtgcatttaggaaagtgttcagagaatatggtgcatttgtgcagtaaatataaattttaagatacttttacattattctccccagaaagtatctgttgggtctagataggaatccatagttcaattcctaaagctgctgtttactgatagtgtttgtcttttttcttttctaaaatagcatatgatgataatgggttcatataataatacacaaagttcttctgactcgagtagtgctctcaccatgctctgccctttaccaagtcgtcacaccaggacctttacttttagagttcctgctatactggtcatagaatccagtcttctgaaactctttgtatcttaggcttggatgtagccagaagaaacttccaaaaccccttttggcagtaccgaagcagccccaaagcactgagcatgctgaaagacttgaagatcctgagacttatggtcccagcacctctcctatacatgggagcagcgagtggctggcgatgactccaaaaggccagccttttcatgtgacacaagtgaggaaggaaggacaggagacagaggacagaacaaaaacagcacaagcagaagcaataggtttggggctagtgctggtaaaggaagatagacatgtaggcattacctacctcatagcgagcagtagagaaaagagccagtggtgagaacaatgttggaggtggatggtggggattatggaaatgatggacagtgggcagtgtgggacagcaggtcctgaggcagcagaggaggcaacaggtggggaaacaatgatagtaaacctgaacttcaatgcaagattattcagatgactatttgaagatggggtgggaaagacaattagcctgtggactatataatgtcagtgaaggctggaggtacaagttagatgtttattgaaggagtgcattcatatgggcatataccatttctgctatgggagtgtgtgtgtggtggggatgtacatatagaaatgtgtgcataaagaaacctttatcctttctttatgcataaagcacacaggccaggcactgtggctcaagtctgtaaccccagcacttcaggaggccaaggctggcggattgcttgaggccaggagtttgagacctactaaaaatataaaaacaattaacagggtgtagtgagacacaccagtaatgccagctactggggagactgaggtgataggatctcctgagccgcaggagtttgaggatgcagtgagccaagatcatgccactgtactgtagtgtgggcaacagagcgtgactctgtctcaaaaaaaaaaaaggggtgggaggaagggaagggaagggaagggagggggaagggaaggaaggggaggggaagggaagggaggggaggaaggagaaaggggaggggggaaggggagagggggggagagggaaggggagggaagggagaggaggggaggtaggaggaagggaagaaaagggggaagggaagggaaaaaggagaagggaaaggaaaaagaagggaagggaaaagggggaatggaagggaaaagggggaagggaaggaaagggggaagggaagggaaaaaggggaagggaagggaagggaaggggggaagggaaggaatgggaggggaagggaagggaaaagggggaagggaagggaagcggggaaggaaggaggaagggaagctttgaaagcagcttgtgcaaagctgataggtcttatggctgatgggcttttctatccacgacaaccaaggaatagtgttggattccatgggattctgaaagtaaagtacctggtgtgataacttggtaaagggcagagcatggtgagataccagtcaagagccagattatcctggctgagccgaggctcagactctacaaggcatatctgtgatcaatgtaggcagggacagatgagaggcaaaacagagatgaattatgcctctgggtctgcagaactcagtcctgtggttcccaggagtacctctgtcctgaggtgcagtccatctgacagtgccaacaagcacagatggaacaatcgggtggaggattcatggctggcatttattctgcacagggctctctctgtgtctgccgcatgtcacagctggtgatggtggtgacctggttacagacaaggaagggctctgtatgtctgaaaaaattttccagttagtatttaaaatttttaagtttaaaatattttaaagctttcaaactccaaaatgactcattccctaaatatttcaaataggcattgtaatttgcatttgaacagtatttttgctgtccacaatgtgtcgacagacattagcccttgtgattttcatagtatttctctgagatgggtaaaggttgttgttgttgttgtgttggagtctctctctctccacagggtctcactctgttgcccaggctgaagtgcagtggcaccatcatggctcactgcggcctcaaactcttgggttcgagctatcctcccacatcagcctctgacatagctaggaactatgggtgtgtgctaccactcccagctaattttttaatttttttgtagagatgagggtatcactatgttgcccaggctggtctcaaactcctggcctcaagtgatcccctcacctctgcctccgaaagcactgggattagaggagtgtgctactgcccccagccagttttgtgtttttaactgatctcaattttacagaatttgagacagagattaagcacttgtctaaagtcacccaggtgactggtggcagagaaggaggaggtacccagctgtcccaatttcaaggtcttgccatgacattgtaggacagttatcccactgcttttacacgtggtagcttatggccatgaaagagcaagtgtggaaaatacccaggaagaggagcaatgtatgcttcagtgttttcactggactcttctccactaagatacctgcttttttttttctttcttttagacagggtctcactgtgtcattgtcaaagctggagtgcagtggtgtgatcatggctcactgcaaccttgacctcctaggctcatgtggacctctcacctcctcctcccaagtagctggactacaggcacatgccaccatgtctgactaatttttcttattattatttgtagaaactgggtctccccatgttacccagcctggtcttgaactcctgggctctagtgatgctcccatcttagcctcccaaagtgccaggattacagtcgtgagccactgcactcagctgatacctgcttttcatccttcacataagcatcccttgtaggcaagtttgatgtttagtctcaaagtaaaagaaagtacatgtgggttttgttttgcctttcctcagtgtatctgaaatttctcattctctctctctcctgaatttctttctctcattctctcagcgattttagttctgccacagttctgagtataattgcagatacatttgtgtctcctgtctttcattctttgtcaagaatcagagattctgagatcttactgatgacaaagaacagagagaaaagacactttaaagaaatcaattaaaatataacttggaaatcgaaggagaatcctgaagggtgaatcaatggaatcacaaactccttctttagttctggaatgagcagtgcatactatatgtttatatatatatatatatatatatatatatatatatatatatatatatatatatgacacacacacacacacacacatatatatatatggcacacatatatatgatatacggacaaattataaaaagccatttttctataagatcattaacaatcattaggggaatttagtccagtatctttatacccccaccctgatggcatacctattacaccctgcagctgtgagcaaaaacagagtagtgattacatatactataaagctgattgtttaagtttggaggttgctggaagagttatcttaaatgcttcttattattgaccaaaatgtgttgacttggttgaggctgcaaggatgacctcatcccattacatttcaaggcaactgtgctaatgagagccaggctgctattccctagtgatagtccattttcacatctcattcataattgaagtgagtgagagtaattttttgcccattataggaggtggttacatcagttctccagtggcataccaaagctctcatattgttgcaacttaacaactgtaacctagtatcataagatctatgttaccctgtaaagtgcaaattctagaagggaggaaaggggagggatgtgctaaactctagtccagaaaagtgaatttgagaaatattgctgccttctgatctgaaacagtgtcctcaaagcctctgcactcacctaatcaaacttgattataacacaacttgattataatattactcttgcgtttccacatccttaaatgtcttgtgtgtgtgtctcctctggaggagagaaagcatttaaaggcaaagctcttggtccgatagtctcctttgatggtatagactataatgaaaaagtgagcctggtttttaaaatatctttggcatgaaatctgacatgaattattattttcatttgtacaggtggttccaggaaagaaatcactgaacactgggaatggcttgagcaaaatctcttgcagacactctccatctttgaaaatgagaatgatatcaccacatttgtgagaggaaaaatacaggtagtgggataaaagaaaaacattttaattggaaataatttcaaatttacagaaatgttgtaaaaataagaattgagtaaaacatacctgtataccctttgcccaaattcacctgttaacattttactgcatttgctttctcatatgtgtgtttgcctcctctcctgaatacttcagtgtgtattttctaagaatagggctattccttttttttcttttattgataacatgatattttacatatttctggggtacatgtgagtgttttttacatcacagaatgtggaatgatcaagtcaaggtatgtggggtagtcatcatatggagtatttattatttctatgtgttggtaacatttcaagtcctctcttctagctactttgaaatagacaatatattgttgttaactatagtcacctagtcactatggaacattagaacttatttcttctaactgtaagtttgtaccattcaccagcctctctttgttccctgtcccaccttcacaactttctgaacctctggaatctatcattctactctgtctccatgtgaccaagtttttaagctcccacatgtgaatgagaacatgcgggatattctattaaataacaacactacatttatcacctgcaatatttaacattatatgtaaatttaacattaataccagaatatttgacacatattctaattaatttcattaactggccgacttaatgccctttatagccttccccacccccactccagtacaggtaattatctaggaagacattgcatttagttttcatgtctttagtctccttcagcgtggaacatttccatagcctttccttgtcttctatgacattgaggtttttaaagtatacaattctggttttttactagaatgatttcattttgcatttcgtcagatattatgaatcgattcagttgttgcattcctggatggaatactgcataggtgatcctgtgtccttctcaagatattatttcttgaggcacatgacactcatttgcccctcattggcattatgagcccaaggtgttatatccaatttctccattgtagagttactaattttgcctttgcaaataataaacagttttctgtaagaaaacattttcaggccacacaaatgtatcactccttgtcaaaatttctgtcttgatttaggattgatccattgatgatttttcatctgaaccagtctttactgtgacagtttacaagatggtgattttataaaataatgcttgtccaattccaggcctctcccacatttaccatttggcaactattattctactataagcaagagtcttccctccatttatttattatttatcgattattaacatggaatcatggattctgtattttccagttgtttgtgtttcattactggacttaattattttggtgctcacactatcccagatttagagggagcccctacaaattgcctcctttgtccttgtcatagtctcctttatttatttatttattgagacagagtttcactcttgttgcccaggctagagtgcagtggtgtgatctctgctcactgcaaactctgcctcctgggttcaagcaattctcctgcctcaggaggtcaagactgcaatgagccatgattgcaccactgcactccagcctgggcaacagagtgacactctgtctcaaaaaagaaaaaaagggctgtaggaagaagctaaagcttagaagtgacaatagccaggagaaataagtaaaacaaacaaagaccaattatgtcaaacagccattttcctttttgtttgtattacaccaaaaatgtcagatttaattcccctgaaaccaattatgaggagggatttgctattaatgcagttatgtgtgaaagaatgtcattcatgtgcagatgaatggtttaagcattcacatattgtccaataatcaagggaaccaacaaagttatttgttttgagacctaattaacttttataaatcataaatgtaatagttaactacagatgcaaccataatccaaacaccttatgtagcattttgtgtatttcttaccagacctcccttttcttaactttttttttttttttaattagggacagagactcactacattgcccagactggtcttgaactcctaggctcaagcaatccacccacctcagcttcccaaagtgctggaagtacaggcctaagacaccatgcccggcctccccacttctaatatgcatattgtcataatagaagtctcatgtacatataattttgttctcgtctttttttcttgaccagtatctacaatattgttatataatttttagttattattccataattgactttaccatttctgtctttctagaagtcaccttagcttctagactagtggatggcaggtacaaataaaaatccagttaatacttttgttcaaacagtgtaactttacccacaggctgtgtttttccccctttgggatagattacaaaatttggatgaatgggttaagtagtttaagtatttttaatagaccttagtagatattgtcagttagaatctctgtgtgattacagcattgcttgctttcagcattttggttgttgaaattatttttcaaatataataggtagaagttaaagccttaatgttttagttttgtctttggttattatggggttgaatattttttcatgtttgctaagttaaatttctcctttttgtaaattacctgttaatattcttttgcatatttaaatttatattgaacatctgatataataggattttccaaagtcatgagaagctgttgcctagaactggaatgacctattttatattatgcgaaacctgtagaaaaacctgtagaacctgggaaggagctattctatccctgtattccataatctagtctacctggctaaaaaattatagccaactaagaaagggttctacattctggattatttccttttttagtgttgagaaagttggtattttagccttatggagactattagccttactgttgaaatgagctggcaaagccttgtctcttgatactagtatattagaccctagagtgtttctgagtgatggttcttgactgtatttactctcatatataaaagcattttctctttaaaatttcaatgagcaggccaggtgcggtggctcacacctgtaatcccagcactttgggaggctgaggcaggcagatcacctgaggtcaggagttcgagaccagcctgaccaacatgcagaaatcaaaaatacaaaaaaattagccaggcgtggtggtgcatgcctgtaatcccagctactcgggaagctgaggcaggagaatcacttgaacccaggagatggaggttgcagtgagctaagatcgagctattgcactccagcctgggcaacaagagcaaaactccatctcgaaaataaataaataaataaattcagtgagcactctagaaatgtggtatttaatagatctttagatagcatacttctgcttatggtttgttatatgtcactcattctcacattctcctcattttgactttaggtaagagcgctactacagtgacccaggagaatagcatgttagcccacttgagggtctccaggcttctctaagttgttagcctttggtgattccctggaggcccagctgctgctttctgttagcaggttctcattcagttatttttatttactcattcatttatttaatctttcattcatagatattttttgatccttctctaaaggcactgacaactttgaaatgtcacataggccacaggtgtatttgccaactgcgaaaggcatttttcatcccttttcccttctgaattgacttctccttcccacccacgggtcccatgccctcatgctgccttcagttgtctgaagttcttaaagtaacactaccaacgcctgcttgtccctagaatagcctgggtccaaaattgagctccctcctggccttcatcgagcttaatgtctttgttctcttggtagagtgatatcagtggtaaatagaggaaaatatccttatgttagatatttttccagggaagcacattgctacttctattgctatccataatgccctccagtatgacagaggaacagaagttagcaacttggtacctaatttctcaggcattgctaactccaaaacaattgtagatttagaaatctgcaactctggattatacaataaagactaagatatggccccttaagatatcttttaatttggaaaaacaacaacatggattcatttagtaatattgaacatcttttaggtgctagatattggtgattaaaatgttcgagacattctttttatctttggaattcatatttagtggtagaaggacatataaacatgctattttctgccagcatgtaaattaagacaacatagacgtgagaatgcttagaacccatttggaattgggctggtttcacagggaaggtggtatttatgctggacctggaaaggttgacttgggaagattgagagcagattttatgggttaagattcagtgcagatttcttttctctttcactgagagcctgtggaagattataaggtgggaatactgtagtcagatctctgtttcagaaagtggccatgtgaagtaaattggagtgtggagagtgttgtcaggatgccatttgagaagctattatatagtaattcctggactgtgtagagggactttgggatgcttttgttagaagaataggataaagacttgtcttggggctgtgcttgcatcgtaagcccaccatttgctgttatgattattgtctacatgcttacttttaactagaataggacagtgacagagattatagaagactgaagccctttctcctgccatccactcagcagcatcacaactaccggcaacagggtgaaaggtctgcagtggaaataagactcaggaaatgatttcaatacataatgcagagagaatcaacattacttcatgtggggggaaaagaatgatagttgagaaaaggctcacaagagactttgagacttggtaggattcacgaaacagaacagtctgattccagatttcaggcatgtagaatgggagggccataggcaaaaaggtgggaaagtgcagaaatgacatgttcaggccccaagggtgcctcaggctggctggagcacagttactaacgggacatttgggtaggatgtagtccagtgagaaaaagttgcggcattggttggatccaaaaatgtacatgggtctaggctactctgggcacactgcctgtgggttaccctgcttcacaaggagcagccagtctgcaataaaaataaaaattaaaacattaaaacaaacaaagtgtacatgatctagatttttggactttatactggtggtggttagaaaccactaagtattttggtaagaattttgtggtcaaatccattttaggaagacaaatttttagggagcatcaaggatgcactagaagctttaagagcccaaaaagcaggaattctaggtatgaggaggcagttgcaattttctatccttgggctacagagagctcagtcatgtcaatgagaatctgagaagttggccaaggctacacagatacagtgatgcggtgggagcacgaatctaagacttgcatgctctaaaggtcatgcattttcagttctaccttgagatcagagaaaatgaagatgaggcgggagggatttgaggattacaaagtcaaaggtggaattcaagggagcattttccatcgagatatatgtagaagccaattttcagggaattacagaggaactgggtaacagtgaaatggcttctcaagttattataatgattgaatggtagattaacctggtcacttgctatgcagatgtttcatttcctgtctaactgtccaaaaatcctgcatctaatataatttttgctctcatatctaccccttttctgctcagatgattactcgtttttccctgtaggctccccagtgttattcatggccctgagacagtgagtgtggagctgagtgtcagttggtgacatgtgtttggtctttctttcctcactggctcattcatgatgaatttttattaatcttggagaaaggcagaagttgacttttgagacaattctaccataataagcttagtaaaaacactaggactagcaaaatctttgtatctcttcatttgtaaagtaaaactataggcttcattcctagtaaacttaacaaaataaaattagcaccaataaaaatataataaaatctatattatgtgaaaatattttagtacacaaatactactcaataattggcttagaatttgggggttgccattgaagggcattcctcaatttttttttttaattctagccttagaaattttttcttctggaatatgtacatctctagtcatattaataccagttgtgtgctttgtgttttattccttattagggcatcattgcagaatacaacaaaatcaatgatgtaaaggaagatgatgacacggagaagtttaaagaagccattgtgaaatttcataggctgtttgggatgccagaggaagagaaactcgtcaactattactcttgcagctattggaaggggaaggtcccccgtcagggttggatgtacctcagcattaaccacctttgcttttattcttttcttatgggaagggaaggtaagtcatctaaaatttcagcaggaaactttggaaagtctactgaggtttgccctgaactcataaaccacatcaaaatatcagaaataaatctatagttataactaagtcaatactaatttttttttactactgaagtgaatttaattatttttcagttcaaaatggtcactaagtaataaagattcactaaaggtgtaattaattcagtagacatggattaaatctataattctgacctcagaattcacatggcccagatttacctcttaaaatgaacaagcaaaacaaatatggtattataaactcaaaggagttcagtgggatgggggagtggggttgtgagactgcaatatcttgaaagcgttttcaggaatcagatgttgacccaggcttgttccttgtgctcagcgaaactggtcatccggtgggtagacatcactcagcttgagaagaatgccaccctgcttctgcctgatgtgatcaaagtgagcacacggtccagtgagcatttcttctctgtattcctcaacatcaacgagaccttcaagttaatggagcagcttgccaacatagccatgaggcaactcttagacaatgagggatttgaacaagatcgatccctgcccaaactcaaaaggaaatctcctaaaaaagtgtctgctctaaaacggtgggtgatagagaccttgtatcttccagactttagaaatgagaaactcactcattcatttattcagtgtaaccttctctgacgatcttcaagggttctgaacactcttctgtgtatagatacaaaactaaaaaagactagctgaggtgctaccagttcagaaagtgagacagacatgacctgctccaacacaaggcagcaggcactcttctggtcctgtgaacacagtgctgtgggtgcacacatggggagtgatagcctcagcccagatggggaagagtgggtaagaaaggcctctcagtggaggctgctttgagctgggctctgaagaggtgatagaagttacctgtgcaggtacatatccatgcctggatatttcaagcagagggaagatgacgatgggggaaacacaagggaaaacacagagagaagtaactttgtcacatggctagtaggtggcagggcatgggatgaggagaggctgcagagaagcctcaaagtctgaatgtgagagcagagctagagagagggtgatggaaagttgatgccccatgtgcctggaattacccttcatcaacacagggaatgagagaaggaagagcatgtccaagggatacgatagctcagctttgattatgttgaattgaggtgcctgtagctcatctaagtagagatcagtccagtaagatatacaaaattggaaatcattgatgtgcatttggtagttgaaatctaaccagaggtctttgtaattaagatgtccttggtgatttgagacatgttcaaaagagcagtgtaagatagatgctgctactgcagcggatcaaataaaaaataaaagacaaggaaagggaactaggcaaatacagacttcattttcaagaaattcagtggtaaaggaggggaggattgcttttttttttagaatgaaaaagatttgaacatagtatcaaatgaaggaggcagatgggaagagcattttggtgagggtaggtgtggagacaggaagggacatagagatagttataagaaagttgatcatttaagaagtgatattttgtagagaaagcatggaaaggatgcttgtgtgtcctgatataccttttcctttggaatggagaggaagtaagagtaggtgaggatggaggtgactttggagacagaagggaaggaattggagggggcttctgcatcatggacctttgctctatgaagtcagagactagaccatcacgaggctgatgtcaggtagaagcttgaggggagaggtttaaacaactgacatgatgagcaagaacaaagaactcattagagaaaagatagtagttaacagaagacccagctaaggtcagaagccatagttgcccaaggtgagttgttcctgtgtcttttcctgcagctttgttgtcgatttggggtggacactgaggcccagtggatttatatggctggtttgcattctcattaggtcttaaaagataaggccccccctaaagtggcttggataagagtaaatgcagtgacctctttagagtgtattgcatttctttagaaagaggaagagtttcctgttcaggcttatttttgctatgattctttaacatttacagacatggattataagtgactatgcaagggactgaaatataataagataattttattacgcttttgggtcattaggttggggttaacttcaatataaagaaagctgagaagcgggggatgagtctagcaagattgaggaggtggaaaatgggctgggggaacttccgctgctgcataatttagaaggtatggaaacatttttcttatgtgaattgtaattattgctttccagtgatcttgatgccagggcaaagagtgagagataccgtgcacttttccggctgcccaaagatgaaaaattagatggccacacagactgcactctctggactccatttaacaaaatgcacattttggggcagatgtttgtgtccacaaattacatctgttttaccagcaaggaggagaacttatgtagcctcattatcccgctccgtgaggtaagtatctgataaaaattgatattttaagtttcatttgtaatacttttctgggtgaaccaggaataatttttttaccaacaattggcttttgaacacaggtgaatgttcatgcgtctttggtggcacctgcattctttcatttgttgtcactgctgtgactctgggacctgtgagatctcttcttccagaagctgcatgggggttttttaatgtaggttttgtttttattttattttattagagacagtctcgctctgtcacccacgctggagtgcagtggcatgatctcagcttactgcaacctccaccctccaggttcaagcgattctcctgcctcagcctcctgagtagctggaattacaggcgcctgccaccatgcccagctaatttttgtatttttagtagagatggagtttcaccatgttgggcagactggtctcgaactcctggcctcaggtgatccacccaccttggcctcccaaagtgctgggattacagacatgagccactgtgcccggcctaaatgtaggttttattacaattcaagcttaacgaggccagcaatcaggggatgagtgctattgaaatagcttgttttatgcacagatcctgaaaggcaagggcatgccacgcgatgtgctgggccacacgtggaagcaccatggtcagaggaggcaggagggaaagaaaatgtgggcaagatcctttatgtgatttcaagggaagaaatgggctacgccgagtaaataggcttaggcttggataattggaacaattttggtgggctgtggggcataggggttgtccctagttgtccatgggttaaaaagggcaaggaaatagtagtcttgagtgtgagcattcaataaaggaagtggttgaggtgtgggctccagattggttgatttgctttgaaagcaattttctagaaattggctagccctgggaagggtaatccctccagggtcagcaaggcccccaagatgccaaagcatcaaatacagaaactaggaaacatgtttattgtacctggctcaaggtctgagggcaccctggtctaaaggagacagtctaggttgtgagtcagaaagccacgtgtttgttgggctctgctcggctgatttcctgtgttagaaccatcatgctgctgcttacaatggtagattcctgagtccatcccagatcttctgaatctgtatctctgcaagttttagatctctgttttaatacatttacaggccaattcttatgcacagtaaagtctaagaaacattattattgttctggggtggaggtgggttccatcctaactccaggatgatagcttactctggtacttgtctggaagctttgctgtgaggcttggagttgacaaagaccccaggttaggatgtcagagaaagggcagtgcaggggccagcagccctgcagtttctaacctgacctcttccaacctaccctggtcctttctggaagctaaggtggccagaggctttgggtatttgatcaggattgtccccttgctaacatccctttagcaaaggattcgggtttctctctgccttctttatctttttctttttttttaattaggcatagtttcttcttattttcttgttttaagagtaatatatctttatcccagaatttgtaaaatacagacaaataaagagaaaagtccgccctagttccactgttcagagaggaccactgttaacattctattgtacagctttctagttttttctctgcattgctgtgtatgtgtcatttatataatttagatgtaaaacactttatagggaatttttatttttagttatttcctttaacattgagtatatcttaaagtgtccttcaaatcattaaatattcttctataggccagatgtgatggctcacacctgtaatcccagaaatttgggaagccggggcaggaggactgcttgaggccaggagttcaaagaccagcctaggcaacatagcaaggccccatctctattaaaaattaaaaatttaaaaaaattagctggggatggtgatgtgctcctgtagtcctagctacttgggaggctgaagtgggaggatcacttgaacccaggagtttgagatcacagtgagctatgatcgaaccactgcactccagcttgggtgacagagcaagaccttatctctaaaaaataaaaaattaaaaaaaaatatatatatatatattcttctacaatgtaatttttttttaagagataggggccttggtctattgcacagactagacatgagctcctaggctcaaatgagcctcctgccttagtcccatgagtagctgagattacaggcatacaccatcacattcatatcacaattaaattttaaatcctgcagtttattccgtaaagtatatacataatttattcattcggttacctatggttggacctttccgttgcatctagttttctctcaaatatatgtataattttctttaagttataaatagcaaacagaagtcgaactgtgaatcaaaaagaatgaaaaatgttaggcaactgacaaatctagctctccttgtcgtagggtcaactaattggagttataacacattttgaggccaagatatgttgtgggtaaattctgacaggaataatgtaacagttttacatttgactgtgaaatgtattttgtaagttttttcaccaaatttaccttcttagtagtttttgctataggatgttactaaacataattttcttcacccaattctgaatgtaattttcttcatcatgtgctactcaaatgtagtaaagcagcattacctgtaccagctagggaaaccaattctgtgattcagaataccataaatgtgctatttatgacctgaatgaatcatcactctcagtttatccagagggaaatgaggagcagagagggtctggaagccgctatcaagacatctgctgtcctgctggtccttctggcttccccctcccgggtgttagagccaactagctctgtttacattttagtgcgatttagagtacactgttgagatcttggaggaattgagagaatggtgattaatattctcaacctctattctgcttgctagttttctctagtagagcagagataataataaatatgactatatttcagggtaaatcagaagagaggcagtctgcagaggtagcatttagaaatcaagcttgttgtggttggaaggcgcagctttaaagaagcgctcagtgagacggcagtgccttttctttgaactgatgactctgtgatgtattaatggtagagccccaccccaactaatggaagaagcaaaagacttaatgtaatttttattacctttaggtaatgataatgtcagaagagcaatgggggcacccccaccatccatgtggggtctgagtggagggtgccctccacgtgagctgggtacctttcagaaccgagtcaggctgcttgacatccctgggaacattacatcctacacggaatgcccacttttaagattgtatagaccaagaattgttgtttcacttaatttttttaaataaataagctgaaatattgactggaggtttttaacacacattctacatattgacttaaggtagacccagtcaacagatgttaagcatttatccaggatcatgttgctatagattttgaagaaattattaagccagcaagagaaggaattttttttttttttttgatatggggtctctcacacagtcatccaagctggagtgcagtggcacagtcttggttcactgcagcctcctcttccacctcctgggatcaagtgattgtcctgcctcagccacctgagtagctagaattacaggcatgcgccaccacccacagctaatttttgtatttttagtagagatggggtttcatcatgttggccaggctggtcttgaactcctgagctcaagtgatctgaccacttaggcctcccaaagtgctgggattacaggcgtgagccacgtgcctagccttttttttcattcataaattactttccagtgtttcatattaaacaccaagacttgattaagttgcagtctcttttataactcaaattggtcatgaaaatatgtctcattatattgtagcagactctaatgtaattgttctcctttcctggtggcggggagcttatgtgatagagttctgctagaactcatttatcagtgagaaacattttataagccgtctgagcatttatatgttttatgtgggagctttcttgtttctgcatacatgctccagctagacgaaggaatttttcactttgactttatcaagatccacatagctaactgcgttttagacacataatgtaacctttcatctccttggcattttccatttatcccagacacctcatgaccaaaagagccagtaaaaattttatgtgagaaaaggggcttttgtggattttaaaaaataagtattctttaatacatgccttaagtgttatgggaaaattcttttcaggaaaaggaggtatttccctctgttatatagcatttattgcattagaaagaaaatccttatgtacaacttcaggtgtctcagaagattcctttaatatatataaatatatatttttaatattctataatgtatgtttaatatataatgtatattatatgtcatatattaacacatatatttaatatagatattaaaagaatcatatatactctaacacatatattctgaaaacagcagtcagatgctacactttttcccttgatggaccccaggcagacctatttttttagatatgcaagagtttttagacaacttcaataggttacttagtcttgagtagggaaaacatttctaagttgtgctttgaaggaaatatatttcacatgaaaatgctaatgaacaacttaaagtttaacctgtctagactgcttgcagtagaaatgaagaagggaaaaaagatcttagctttaagtatattgtcagagctgctgcaaataaaccatttttctagtgcttgccttgagatttgttttctaatgtgctaaagagaaaagttttaatgcgtttatcctagtttctagttgatgaaaatcctattataaatcacccgtatatgtcttcagtttagagctaaatttccccaatgtggtaggcttcggcacacacacacacacacacacacacacacacacacacacacagtctggtagttcagataatgttgcaattaagctgtttacattctttacatgtctgttcagaatagaacctttaaaactttgcagtggtagaaggtgaaggatgaaaagccctggagtctaaatgaaacatttgaaggattggtggtgttttgaaaaccattccaacattaagcttggtaaaaggaaccagtatcatgggttgttttctgtctcttatggctgatgaagcagcgaggagccctctctcttatagctccatgaaattttaatgaaaatcaaataattcctttatagcaaggtttctcaaccttggagctattgacattttgggacaggctttcgttgtggtggagtgggatggcaggggctgtcctgtgtgtcgtaggatgtttagcagcatcccgggactctgctaccagatgccagtagtatccctctacctgtgacaacccaaaatgcctccagatgttgccagatgtctcctgagaggaaaaaagtcccattttgaaccactgatttggaaaaaccagcaagacggttccagtttctagtataagctccagtttgattgttttgagctgttttattttactggaacagagtcaaagagtctcagttttgcttcaataaaatataggtggttcctatagaataatgaaagtgccgccttcctcctttagtgctgcatataggctgctattgggtaattcttggaaaataatgctctttgtttcccacttcttttcaggtgacaattgtggaaaaggcagacagctccagtgtgctccccagtcccttatccatcagcacccgaaacaggatgaccttcctatttgccaacttgaaagatagagactttctagtgcagaggatctcagatttcctgcaacagactacttccaaaatatattctgacaaggagtttgcaggaagttacaacagttcagatgatgaggtctgtgggagacacctgaaagtatttttggtttatcctgttcctgtgcccaagtgtgttcagttccttgcccattttgtttgatcttcaagctttgcgtctgacgcccaaagcaatatctcagcaatatctcatttaaatctcaaggactttgtatttggggtcatagatttagaaggaaccttatagatcacctggaataacacttttattttatagttgaagaaattcttaagtaatctgttctagttacatagcaagtgactcaggtccatatagtgacattgttgagaatggtacagaggtcactaaataaagtctcaaacctgaaatacaaatcattatgatgatttttattatgatagaatacatattgggtccctgtggaattcttccctggaccaacattcaggaacactggaggcctgaaaagataggtgactatctgaatggttagaggaagttatggcagataaaacatgtttcgaaggtggtaagctcacacataacatctctgtctctgttcacctgctccaagcttatgtggacatttttgaggcgccagaaactcaatggggtgatgaggctgccatagctgctgattcaaccatgacatgctttgcatacatgcaaatcagagaaacaaatggccaagcactttgttgcaaatatacatataaaacatgaagattcagaaacctattgtgagcattgaagtgctgcggcctgggacccagccacctgtctaatccctgccaaaatgatggcttgctgcttttctcgtgtttcttcacatagcaagaaacaccatgggaaaaaaatgatgtagcttttgataaccatacagaagacactgaagaagtaggttctattgcccgtgtcctcccaatgtcttgttcctctctgtattgacaggtgtactctcgacccagcagcctcgtctcctccagcccccagagaagcacgagctctgatgctgatggagagcgccagtttaacctaaatggcaacagcgtccccacagccacacagaccctgatgaccatgtatcggcggcggtctcccgaggagttcaacccgaaattggtgggtgcctctcacttttccctgaaactttgtagatttgaacaatgccattaacaatattttttactgtaagtaaattcacacatgcctatgtaaatggagattttcctataagttaagcagatttttgtctaaatatgttataactttcacagtggcttcatggaaggagatgagttatagagggtacaggtgacttcttttggtcttgttttgtttttaactcttgcttaagttaaaccaacaaataaatacccgatttctcagcccatatttaaacatcattaacttactttcacttgggggtgcagacataaaaccataaatacaatctcaggtaagtaggattctgactctgggcccaaaagcttcatggcagagctgtaggccatgatagatgtataaaactagagaagaactccagaaaatctgagttcctttttctcatgacttctttctggaattgtcactccgttcagcagggaacatgttctgaccttccatcactcttctcttaccatcctcagggtactttggatgtcataatgtttcattatccctttcaggccaaagagtttctgaaagagcaagcctggaagattcactttgctgagtatgggcaagggatctgcatgtaccgcacagagaaaacgcgggagctggtgttgaagggcatcccggagagcatgcgtggggagctctggctgctgctgtcaggtacggccgctgggctgggaatgctggcgtcaaagtctgtgggactccacaccagggcctccctgtgccttcagtcatgcctcaggggttctttcaaatatgcatcccccagttgaaagctacatcatgtttcctcaccagagtattgaagttcctcaattattgttccctttgtaaaactataggacccataggaagcggaccaaatgttgaatccaccatccttcgagtctttataaatacttccatttcttcagtcaggctatttaggaataaaagagaacctgaagtaaaagaacagaatactttgtgacttcagtagttcttttttccttgcccagctacgtcaacttcattgagaatgtttaagtgtgacacttcctcagagcagtcatcgggtggggaattgggaggaaagaaataagaggaataaaaaggcccaggtgtttgatttttgccacctcctgaagtctttggtcatcattggaaccataaagatgaggccagagtctgcactggaaataaaagcttactcagatcataccttgtacttcaagccagagatgccaggaaggacagaaggggacacttccatggaccagtggtgaagaggcatccatctttactggtccacagacctggctcttgtgcctgtccatcattctgtcacatcagatctttgagccctgctacagaaaccagagatccttcaggctaagctcacactgcttcctcccatccgaaagcactgagtgtatcccagggatctctaatatctcagacatcagagcactccttagtttcaccaactttactttcacatgtaaattagttgctctatctggattgaagcctgaaatattatcattctaaataggcttatgtgaatatttttatttgaacctaagatggtctgacacaaatgctattattaaaagcttttattcttaaaaagtgatactaaaattaataattacgactcacaggaaagcctttaaaaaaacctatagctctttgtaaaagtagatgtaatgcccataatgagatgtataaatgtctcagaaatagggacgtataatcctgaaaaataattggttttgtctatttcatgtaaaactagtttgttctatatttatttaatacatgtcttatttttcatttttctttccttctttctttttgtagagataggtgtcttgctgtgttgcccagggtggtctcaaacttgtaggctcaatcaatcctcctacctcagcctcccaggtgctgggatgatagtcatgagccactgtgcctggcctcattttccctaagtggaccagccatagctcctcatttagaaacctaaatttgagtcaactcatctctaattataattcaaacccaagaagatcattaccatccagtcttttcttgtcttccctgtgtttagtgaactagtcaccttgacaaccagattcagatcactgacagagtaaacagatttccattttcatcctccttgttcaaattagaagttatttatagctgcattttaagtgaaaatgaaactcaaaacgagtaccaggaaactagtgtatacaacaatagtacacagccctatctcagagataatgttgagagttagacccagtgtttcctttaacggcagatggaccatgtgagaccgcagggtggtctccacacggccctctgttggggtgataactgagcccgtatttccacatccaggaatggggttcgcctgaaggccagcctatcatgaagagagcacagctccaggccagagcccaacttgggtctcacctgcttcctgtgacccttagggtgacggcatcatgacctgaactctgtacccgctgaaatgaaatgcaggtcagatgacaagaaatcacagtacgtctcccacatcaacagagcaaaagccagcgttatgtccctgtcagctgggttggcttttccagggccagcgtgagtggtgaggccagctctctcagtgaccatcagagacaaggccttggccagtccaggggtcttggggctccacttttctgaattatgaaatgttgagtgtttaccctgtcaatatatatatcatttatatattttttgtgatatctttattgagatataattcacaacttactagttaaggtgtacaattcagtggttttttttttttagtatattcacagaattgtgcaatgatcacaattatagaacatttttcatccccccaaaacaccccataccttttatccatttggaaaatagatataggctgggcgcggtggctcacgcctgtaatcccagcactttgggaggccgaggtgggcggatcacgaggtcaggagatcgagaccatcctggctaacaaggtgaaaccctgtctctactaaaaaaaatacaaaaaattagatgggcgcggtggcgggcgcctgtagtcccagctactcgggaggctgaggcaggagaatggcgtgaacccgggaggcggagcttgcagtgagccgagatagcgccactgcactccggcctgggcgaaagagcaagattctgtctcaaaaaaaaggaaaataaatataaactgtttggaaatacagactggtagttccattcccctcaagccccctcccagccccaggcaaccaccagactactttctgttgctagacattttgtataaatggaagcatacaatatgtaggtttttgtgactggcttctttcacatagcatactgtgttcaaggttccaccatatcatagcatgtatcagcatttcattcctttttatggccaaatattatatcattgtatggacatactatactctgttcattcgtttttcagttgataaacatttaggttgtttctactttttggttcctatgaataatgctgctatgaatgttcatctacatgtttttgtgtgggctgggcacagtggctcatgcttgtaatcccagcactttgggaggccaaggagggaggatcacttgagcccaggagtttgacaccaacccaggcaacatagtgagaccccatctctacaaaaaaaaattttttttttaactagctgggtgtggtggcacgcacatgtagtcccagctactcaagaatctgagatgggaggattgcttgagtctgggaggttgaggctgcaatgagctgtgatcagacctctgcacctcagcttgggtgactcagcaagaccctctctcagaaaataaaatatagatttaaaatttagaaaattcaaaagtttaaaatttttttaaatacaggtttttttatggacacctgcttctatttctcttgaatgtatgaatgaagtggaatttctggttcgtatggtaactctatgtttaaccttttaaaggttaaacattattttgatttgcattctcctgaaggataatgatgttgaacattttttcatgcacttactgaccacttctatatcttctttgtagaaatatgtactcagatcctttgcctgctcttaattgggttatcttttagttattgagttgtaaaagtttttaaacatatttgagatacaagttcattatcagatttttcctaaaaatgctcccattctgtgcattgtcttttcactgtctttgatggtatccttcgaagcacaaaaaaatttaattttaatgaaatacaatttgtctattttttcctttgtcactctgctctcatgacatgaagatttacactactatgctttcttctaagagtttgtagttttagctcttatagttaggtcattttgagttaatttttttttttttttttttctggagactgagtctcaccctgtcacccaggctggagtgcaatggcataatcttggctcactgaaacctccacctcctgggttcaagcgattcttctgcctcagcctcctgagtagctgggattacaggtgtgcaccaccacgcctggctaatttttgtattttcagtagacacggggtttcaccatgttcatcaggctggtctcaaactcctgacctcgtgatacacccaccttggcctgtcaaagtgttgagattacaggcgtgagccactgcacccggccttgagttaattttttatgtggtgtgagatgcaggtgactgtctaattcattcttttccgtatggatatctagttgtcccagcaccatttgttgaaaatactattctttcccccagtgaattgtcttagcacccttgttaaaaattaatagaccttaaatgttaggatttatttctggactcttaaatctagtccattgatctgtatgtctatctttatgccagtactacactgtcttgcttactgtagctttgcagtaagttttaaaattgggaagtgtgagtcctccaattttcttgtccttttttgagtctcttgaagttgcatatgaattttaggaccagctagccaatttttgcaaaaaggacagatgggattttgataggtattgtgttgaatctgtagatcagtttgggagtttttctatcttaacaacattaagtcttccaacccataaacacaggatgtcttttatttaagtctttgtcaatttcttttagcaatattttgtagcttgcagtgtgcaactcttacatgtgttttgttatatttattccgaaatattttattcttttttgtatcctgcagccttcatgaactcattcatgcgttgttgaggtataattgacaaataaaaagtatatatatttaaggtgtattaatttgatgatttcatatacattgtgaaatgattactataattgagctagtttaccatatctattacctcacattgttcccatgattttttctttttgtctttttttcttgttttttttttttttttggtggggagagtttggtgagagaacacttaagatctaccctcttagcaaatttcaagtatacaatacagtattacattagatcttcagaacattttcatttcttataactgaagctctataccctttgaccaacatctctccatttttccccttccttagctcctggtaatcaccattctagactctgtttctatgagtttgactatattagattccacatacaactgagaacatgtattacttgtctttctgtgcctggcttatttcacttagcataatgtcttctgggttcaaccatgttatcaaaaatgataggacttcccctcttataggctgaatatagtatcccattttgtatatatgccccattttctttatccattcatctcttaatgggtatttagattgtttctatatcttggctattgtgaaaatgctgcaataaacataggatgcagatatttcttcaggatactgatttcacttcttttggatatatgcttagagtgggattactggatcataaggtggctctatttttagtttaaggaatctctatactgttttctgtaatggctgtagcaatttacattcccaccaacagtgtacaagggttcccttttctccacatccttgctgacacttgttatcttttgtcttttttatcatagccattctgacaggtatgaggtggtatttcattgtagttttgatttgcatttccctgatgattagtgatgttgagcacctttaaatacacctgttggtgatttgtataccttcttttgagaactgtctattcatttcctttgcccattttaaaatcaggttgtttggtttaggctattgagttctgtgagttcattatatattttgtatattgaccccttatcagacatatggtttgcagatattttcttccattaagttgctttttgattgcttcctttgctgtgcagagctttttagtttgatgctatcccacttgtctgatttttgcttttgctgcccgtgctattggtgtcacatccagaaaataattgccatatcagtgtcaagaagcattttctttctatattttcttctactagttttatggtttcaggaattgaaatttaatttaatccattttgcattaattttggtacatggtataaaaaaagagttcattttcattcttctgcatgtgaatattcagtcttcccaacaggaatgtaattaaaatttagattgagaggtagatacttgcatatagggtttttctgtcttgaagaatcctaaactgtaagtatctcaaatggatgattctcagtataaccctccatccccatccccaacacctgaggaacttctgtcaacaatgatgactcaccactgttaggaatactcttaccactctgcaatttgaaaaactccaagtatctccctcaatatggctattaaacccttcagagctaacacgttagcaggcagttttcagacttattttgagagacagaacctcctatttcaagtgaaatcttaatgaaaccacaataaaataaaagcaaagctgctggggttgaagagagtgatgagaaggtgaagcctcagcctggcttgttatgatgacctccccacctgtgctcctaagcagcccttcaggactgtctgtgggagttcctcagagcatggttttgtagcttgggaacctctaccttaggaaagtttttaagtagccagcctactatggagctgaaagagggaaggaggccacaggcaaattcaccagtctagccacgattgcaacataccacatctgtgatttcaccttctcttgcaagtttcctttgagaggtaggaaagtaaagcagttcaatcataagctgtagttgcaaaccaaaaggcagagctctcacgtttttgatactgtatctgttggatatatctcaggtgccatcaatgagaaggccacacatcctgggtactatgaagacctagtggagaagtccatggggaagtataatctcgccacggaggagattgagagggatttacaccgctcccttccagaacacccagcttttcagaatgaaatgggcattgctgcactaaggagagtcttaacagcttatgcttttcgaaatcccaacatagggtattgccaggtaaatgtcacaggtggtttttgctaaaaaaataaaataaaatttctattcatttggcagcaaatagtgggaaggaaggtttatggttaacagaactatcactttaccagggcctctcaaccttggcactgttgacactctggactgttaactctttgttgtatgggctgttctatgctttgtagaatgtttagtaacatccctggcccctaccactagatgctggtagaaaatccccagttgtaacaaccaaaaatgtctctagatattgccagatgtctgagaggcagaatcatcctgggttgagaaccactgcactgaatggaggagaccttcctggattcaccactgtctagctaggtgacctggagaagatccttctgatcactgtctgcctcaaccttcatcccaccctggagtaagagagggcatcctcagcaccaggcctgtcactgtggttcgccacagtgttgctactttgcatcctcttaagtaataatgtccttgaatagagcttttatatgctagggttatgtcttaatacacattaaaataagtgcttaacttagtattaagaaaagttgcctacataccaacaaaagtcatctcttgtactggtatagatgccaaaatttgggaagctccaaaataacgtgaccttagaatcaaaggctatatcggccaggtgcggtggctcacgcccgtaatcccaacactttggtaagccaaggccggaggatcacgaggtcaggagatcgagaccatcctggctaacacggtgaaacaccgtctctactaaaaatacaaaaaattagccaggcgtggtggcaggtgcctgtagtcccagctactcgggaggctgaggcaggagaatggcctgaacccgggaggtggagcttgcaatgagctgagatcataccactgcactccagcctgggcgacagagcaagactccgtctcaaattaaaaaaaaaagaaagaatcaaaggctatatcattgtagaggccttccctgaccatccagcaaaagctaaaagaggctgaactcctacttcaacacacaagtgcacgtacatgcacacgttagtctccctctactgcattattttacctctttataacttccaatttaaataaccccccacatagactagttaaccttttcatctttgttttatctaacactagcatttaggacctgcaagatatcaccactctgtcccccatcctccaatacctagtccagagcctgttacaaggtagacccctaaaaaaacctatctccgctaaatgactaaggaactggcagggaccatcatcatgtactaggatcagcaggttaattctcaagtggaatttccatgatgatgtcacttgggaacataatgagtaagacttacaagaaagagcctattaaaccaaaataccttttttgaaattgaattgtagaagcctgatgaacagttaccggtttctgggagatcaaaagaagtacaggaggtagttggcctctaatatgataaagttcatatttaccttttgatcttcctctttttaattaagaagactattaaagtagttgagtctagagtggttatgaggtatctgataatatcttttaataaactacagttactttagaatttaaatcactctcagttatcactaccatctctctccgtatggaaatgttgggtgaggactccaagtctgaaaggtttcgttgttctctcaggagagcctggagccatgtgtacctgattatagaaaccattacggaaagttacaaaggaaatgtttacctcactgaattaaggattaagaacactgagagattttagcaggttaaaagctttgtgaaatagcctttgggcaaatttttggaataggggtttgccagcatgagttcggggctctgtctggtgaatattggtgttaaggaagaccctgcacacttactggttcaaggactcaggtttttatgtttttacagggtcataaaacaaaactcagaagaatatatgacagagactatgtgtaaagcctccaaagcctaaacatatttatctcgcttttcacagaaaaggtttgccagcccttgtgagaataactgagtaattttaatatgctaacagaattgcttatattttcaactgtatttgatgacatcctctttcacttttttaggccatgaatattgtcacttcagtgctgctgctttatgccaaagaggaggaagctttctggctgcttgtggctttgtgtgagcgcatgctcccagattactacaacaccagagttgtgggtaagtggagatgcatttaacatttcaacctatgtctcgtcaagaagatgcttttagagaggtgccagccagaacactatttctggtcaccataagccaaaagagtttcagactactccagtttttcaaaatggaaatgagagaggttgaataaatataggttgtatacaaaggagccccgtggagtttaagggactatacacatacgcctgctccagaaattattttagaaaatatttcatgtgtgtgtgtcactctgacatgtgagagctacaccaggtatgtgcaccattaacacaaagagatttgataaaaaaaattaataaagaggatgggaacctacgaaatacagaggtgttgccaaaaaaaggctatctggggtggaaaaaatagaatatagaggtttattgaaagctaggtttctaaggtatttttcaggactggttttattgcaaagcaaacacctgttttgaggatttaaattattgctgttactccttgtaattctctcaaatatcagtgattcattttagcaggacaagcttttcattgcttgggttgtacagtatattgtttatgcttctcacttgtgttctttctatatttctaaacatttgcacatgaatttgattattgaaaatattgtcaaaaatgtccttacgttgatcatgaatgtgtacaacaggaatgcttttaagtttttttaaaaagtaattgttttaaaaaatgattaatctgtgggcaccatgcatccagaagtgtgatttttttttttttttaagaccatctcgctctgtcgcccaggttggagtacagtggcgtgaatttggctcactacaacctccgcctcccaggttcaagtgattctcctgcctcagtctttgagtagctgggactatacagactcccaccaccatgcctggctaatttttgtattttcagtagagatagggtttcaccatgttagccaggctggtctcaaactcctgacctcaggtgatccgcctgcctcagcctcccaaagtgctgggattattattattttttttaattaataagagtttgccagctaagctgcttaaatgtacatttggaactgtagtcatgtgttgatgttctggctgaggaaggactgcatatacaacagatgtcccattagattataatactgtatatttactgtatcatttctatgttttgatacacaactgtttaccattatgttatagttgcctacagtatttagtacagtaacatgctatacaggtttggagcctaggagcaataggctataccatatagcctaggtgtgtagtaaggctctactgtctaggtttgtgtgagtactctcaaagatgttcacatgacagatttacatgacaacccatttctcatgtctccattgttaagtgaggcatgactgtacttggatgtacatctcataccaaaccaaacattatgttgccaacaaaataactaattgtatgtcacgaaaaccttataaactggctttctcaacaacccttataattgtcatgtgattgttcttttttggaagggaaaacaggacaggaagagcccagaaagagaagatgcagccagaactaatctggtgactgagctgtgttgacaccttggtctagtaacagtcacagcagaacagtcagcagaaaggaacagagtcctgtgctagcagtcaagttgtttgaatggattctttagttacactgtgtagttggctaagctgcgcctttttgtatacatcgctgccacaggtgcactggtggaccaaggtgtctttgaggagctagcacgagactacgtcccacagctgtacgactgcatgcaagacctgggcgtgatttccaccatctccctgtcttggttcctcacactatttctcagtgtgatgccttttgagagtgcagttgtggttgttgactgtttcttctatgaaggaattaaagtgatattccagttggccctagctgtgctggatgcaaatgtggacaaactgttgaactgcaaggatgatggggaggccatgaccgttttgggaaggtattgtactaagcctaactttgaaaaccatctccggttttcttcctcatgctttctcttcatttcatgagtcttaactgatttgatggtgatcataatgcccgcttcttcctgtggctgaggatttattttcatatgctttttctttagaaattaacagaatttctttctctctttccatctttaaagaaactctagtcctttgttttaaaatgtagaacttgcagaaaatgattggagaattataatgggaggattccagtttcttctcctgtgacttctgatgcattcttcttccaggtatttagacagtgtgaccaataaagacagcacactgcctcccattcctcacctccactccttgctcagcgatgatgtggaaccttaccctgaggtagacatctttagactcatcagaacttcctacgaggtaggtcttgtctcctggctgagcagggcttaaccatgcattcgacacttccactgctgcctgttttgtgctgctataacagaataccacagactgggcaaagaacagatatttatttctcagttctagactttgggacgccccaaatcaaggcattggcaggttaggtcctggcctttctgcttccaagatggcaccttgcatgcagtgtcctccggaggggagaaataccatgtcttcactggcagaagagagagaacccatgctcataagacctttttatagtgccattaatccatttgtgaaggcagagtcttcatgacctaaatgttgcaggtgattggcaactatctgaggctggtatcaggagggtagtaggaagaatttaccaagacagttgtaagtaaagaaaagcagatttattaaggaaagcatgaaagtacattgcaaggatgcaatgggcaagttagcaagagaggagttaactgcaaagagacaaagccttgctggggattttataggatggttcttgtgctgtgtgctggagagggctttgtgcagtactggtaacgctgaggttgtagtgagctaacttgcatttttctgtcagcccagggtctggtgatagctgggcgcaggaagattatgagttatttgcacaggagacctatgtgttctggatcatgaaaaagggcagacttatagcttatctgttttgattatttatttatatatttatttattttgctttccctgggtcttgccagcccgactccttttccctaattaggactccacactaaatacctcctattagaccccactttccaacactgttgtgatggggattaattttcaacatgagttttagagggaataaaaacattgagactataggcttacctgcttccttctacattgagaactacttctacattccttctacagtgagaactactggccagaagtaagtagttctgtgctagctgacagctttggcctccagagatggacattgaatggagcctggatgtcttaatgggtctaataccatagtagcacatggcaagacaagctgtggctctccagtgctttaccattcacatcctgaagcctgatctagtagcagctcagattgaactctttgtagattaagtaggggctgttgagagtagggatggggaggctgaccttcacaaatcaatttgctttctgttcccatgctaagtacttagggcttctttgaagtagatagtctgagacacttagtatagcctgtatagcccagagtagaccagagtcctaggattcctctaaaattgcttggcttggatgggggaggatgctttcttgtccatgatgaccctggaatcagcctgatctgccgctctatctcacaacagaactaatacgctttttggggtgaaggaaccacagtgccactttcccccttaacacctggtggtttgtggggccccaagtgctcataacacttgatggtttcttcatttcctgatccttgattctctaaacttttatagaaatgatcactgagaaagcctgagtattctgctgagcgcactatgctctctacaggtgttttgtgattttgattggtgattgtcatattccagctagcaacaaagtggataagagacaaatagtgaggaatggagtgagatcagaaagtctctcttaaagtaaaaaatttagtgcttttaaaaaaaattgctatggatatagaaatcttttcagaaatgtgtgtccttaactcataataagagaaagactggtaattattttttaaaatcttcattgaaactccatatatattgaaagcaaaatactttgttttagaatcataaaagcaatacatgttcattttagaaattgtagggaaataggaagaaaaaaataaactgtatcctataagcgttttacatttcccttaagtatgtttttatacttacaacatacactttaaaaaaaagtccttctaaatacttgctctgtcattttctatgtataccatgagcattccctaatatattaaatattatatgaaggcatgattttactaaattgtattctgctttaatgaggtaacaaaatttatttacctagttcccttttgttagacatttacttcgatttcttccaaattttcagtattatatagcattctaagataaacttgtacccaaatatcacatctctgattattgtcttagaatcctagaaatgaatttacattaaaagtttggattaaaaaaattagattaaaaaaaaaagaatgatcaagctattggcacacactgtctaatttccatgaaggatgtctcaatttatgtttccactattggagataaagaatgaatgtttcaccttactgtctccaaaactatttccatatgcatttaaaaaagtcatcgccccaggactttggaatagtactgtatgatgtaagcaagagcttttctatctgtgggttgcttttctaaaggaatcctcagacctttattgttaaaagaattctggaccaaggttttgtgggatataatggggtttctcttcaaataatctgatcaatcttttattctttaattcgtagtacccccccccacccctttcttctttttctccttttttcttttttcttttgttagatgcctaggcatgcctcagtaccaagcattatcagtaccagctcacattcctttccttatttggaaagaggactaactttctagctcattacagacacccccttcccctttctctctactttcttttacttacccaccctatctaaaaaaatcaaatgtttagccaaccgggattagattgtacaacccgaccccagacaatggggaaagggtacaggggcaggacttggtgtcaggaataaaggctctcatgccctttgttcaggtgtgctctcatggcaactggccaaggaggcacccctctgtgcagaagtaaaattgctttgctaagaatcttttgttcaagtgttcaatttccttagggttttgagcgttattcctaacagtattaaagcttagtatgtggcaactcagcttttttctcaacagcagataagctagcttcatgctgaagtcagcattttgcccatttttaaagcgaaagcaaagaaattgagacaaggccaacagctgatttccatttacgtcttcttgggctgatccctaatggtggccctcaggctgccagacatcctatcacaggacaaagccgcagttcccttcctctgcctggaaagacaatccttttaatttatatcagtgcctatattaccaggtctttcagtgcgtgataactaggtttttgttttctcttctctgcttaagtgtcactactctgcttatgtttccagtggctctctaatgccttgtagatcaacttaaagagaacaccacgaactcttgctgattgtttttttccctcctaaccattaaattggtggttttcaatcctgtctgtgcattacatcacttaattttttttttaagctaagcttttaaaaacataaactcctaggctccatcccagaccaattaaatctgaatgtaggcatgaagcccaagagtacatatattttaagaagtttccctggcgattccaaatgtccggtgagggttgagattcactgcgctggatgcagaatggggctaatcactgatgtgggtaagaatctggtttgggctcaggcatgacacctgagtgttctaagatacacaatgcatttctttctgttcttcaggataattagccgtgacaattgaaacataggaaagaaatactgaaagcacattcatcttttgaaatttagttaagggctccctaggttgctagaaattagtctgatattgataacttcgcttcataaatacctcctggggaaaatctcactcattataagttcccctaagcctctgttgaaaggaattgtgtaagtggtgtgagactccagttttcttctgtgtagacccttgtgtgaagccctgcactttgagcagagtaatatagaagtagaagacaaagtcccaatcttaaagtttgattcatagactgagatgcccctcctggaaggcacaagaggatgttaataggccttaaagtgggtacacagctatcacagagctgcttcatgttcgagatgacccagcccagtgtgtttagtctgaaaagtgttaagcagggaaaggatgtggctaataaaacagaaggcacaatctgtgaagatggataggcatttatgaaagcttagagtaatgtgtctctggcttattaatgattactataatagctattactcatcgagagcctgccatgtgtggggcaaggtgctgggtgccttgtagacagctctgccatgtaaatgttaatgcattttaaggtgaaaatgtaagttaagagaggttgagctagttgttccaagctgcacagctagaaagtggcagccagtatccaaggaagagctcccttgcattaaagccaggaccaagggactttatttggattagaagagagatggaattatggatgtaccgatggtcatgaggtcaactggtccagtggagctggttagtagggagtcttgaaatcactaattgacttggaaggcatctaacagccactggagactgaagagcattcttcttgaagtacattatctctgcttcctgtgcaacaaattagaggagggggagagctgaaggaatagacaagcaaaaaagatagtgtggttgtatatgggaaagacccaggagatgcaagaaacagcatttgtctattcatgtattaacaaaatctttttttttttttttttatttgagacagggtctccctctgtcacccaggctggagtatagtggcttgatcttggctcactgcaacctccacctccggggttcatgtgattctcatgtctcagcctcccaagtagctgaaactacaggcgtgcaccaccaaggctggctaatcttttggtatttttggtagagatggggtttcaccaagttggctaggttgatctcgaactcctggccttaagtgatccatccacctcagcctcccaaagtcctaagattacaggcttaagccaccgtgcccaaccaaggaaatctttatttaagattgtataagcacctttcttatgccaggtatcatgctcagccctggggatacattatcagcactagatattttcaagcccagtatgagccaaaaggataacataatacatttcctttaacccatcatccagtcccaacaattatcaacatttttctgatctttgttttattactcctccccactttttttctttttttcctgaagtaacttaaagcaaagtccagacagtgtattatttcacctgtaaaagaatgtatctctaacagataaattcttcattatgtgtctctaacagataaggtgagtttcggcatggcattttttgctaatccatagctttgaattttaagtttaatttttaaaagtttgtttatacctcaaaagaaaatgtggacctataagttagttctcacccgttgttaatggaatctcagttataacattagcaagttttgagattgttttgttgttattgagacaaggtcttgccctatcacctaggctggagtgcagtggtgccatctcggctcactccaacctctacctcccaggctcaagccatccttccagctcagcctcctgagtagctggtactgcaggtgtgcaccactacacctggctaatttttgtcttttttgtggagacggggtttcaccatgttggccaggctcatctgatgagctcaagtgatctgcccgccttggcctcccaaagtgctgggattataggcatgagccactgtgcctagccaggttttgctgattttgaaaagtgttttttctatcctcttcatcttcctctttcttttatcaacaatgctgggaataataaaagctaccatactaattgttttacctatgtgtgcataaaagtcttacaccattccaaagaggtaggaattattttccctatattgctgatgaagaagatgagggccatcagtttttataaaatttatgtgaaatctgggacttgctatgtgtcccacttgctacatgtggctatgaaactgtgccttttctacaatgtccaggtgtcaaaagcatgtctcctttatagaggctgaactttacattattggtgtgtatataaagaaaatagaggccaggcatggtggctcactcctgtaatcccagcactttgggaggccaaggcgggtggatcacctgaggtcaggagttggaagccaacctggccaacgtggcaaaaccccgtctctactaaaaagacaaaaaaatcagccaggcatggtgatgggcgcctgtaatcccagctactcgggaggctgaggcaagagaatcgattgaacctgggaggcggagattgcagtgagccaagatctcgccattgcactccaggttgggcaacaagagagaaactccatctcaaaaaaagaaaaagtaaaagaaaatactctagagcagaattacaaattcacatgactgtggcgtcgctcatcaaggcacttaacaatggggtagggagtgaaggtggtaggaaagggtgggcttctggaactagacagctggagcctgctagagttgacagtctctttaccacctgaggcaaggaaccattgctgccagaacttttaatttttcaagagaagttggaactctttgttttatttgaagattactgttttttataatactccctgggccaaacaatattcatcatggactttctagcctactggctgcctgttcatgatttctgctttacagcaactttcaaaataaattctaggtaaaaatatagtgatactgggcactgtgcttagagttattttttgtaatttaatcagcagcatgttcacacaacagctaatagtttacatggagtattgaaactaaatgttttttgtaatttccatatttatgtgacaactgtttctctagccctttctggtagacaaaagatctcaaaagacatggcacctaaagaagcataaaatattaaatgatatatttttacgtaaaatataaatactgtattcaaatataaaatatgggcccacttctggcagagttatgagggtgttccctgatgggaatatagtcatggcgtgagactctttagagatcagagtaccctagaaagggccacccattcaacgaacatgggactccaccagagttttcttccctgaattcatatccttgtttcttcttatcatctcctgcctcctctgcccccctcaccctcttcttctgccctcctgaacatctactccccacctaacacataagtacacaggtgcagacagacgccacccccatagaagtcaagggggagtgtgtggggctgctccttcgaagctccctgtgtgtgagaatccctctctcgtctcttgggctctgcctcctgtaatgttaggcttttctatacctaaagcctcacattccatcaatttcttccctctctcacccagtcatccaaggcaaagcttcatttactatcttaagtatttggagttttttctgatcaaggaatgtctcaggtgtcactggtgctcagccttctgctaacagtagtgaaccccattctgcatactgggaaaataaccccacaaattcagaaacaccaaagaggcattttgagcataatttgatgacctagttttattttaaaatagaaataagccatagactttgcatattagaaccaatgccttctttttatttcagtaaattcccctgtggtgggcagactcattcacatcattccatggccctctggcctacattgagctttgttgttgctttgctgggtgttttttaagctgtagcatttaaatatttcaagttctctttggaggatttagaaaggaagggctgattgaacttgattgagcttgaccttgtggtcagtctcttttaaaaatctgtatctgttcttcatccatccttgtcttcccggtaacacagggtaagctttgaaggataaagtaaatcacagaaacactgcccagcctgggcaggggaactcttgttccgctcaggaatgatggtggggtgggaggagccagagaacataaacttgagacagactcatctctacctcattgctttatctgagctacttgttccttgttctaagtctgggggagagaaagggaacatctgcaggcaggatgggggaaggtggtatgaaatgaagggccacacacctatttgttggttggtatcagtacccacaggggcaaagcaacaaaaagaagtaccgtctgctttgaaaattgcctttctggccaggtgccatggctcacatctataatctcagtactttgggaggccaaggcgggcagaccacttaagctcaggagtttgagacatgtctgggcaacatagggagactccatctctacaaaaaatacaacaattagccaggcgtagtggcacatgcctgtagtcccagctacttgggaggctgaggtgggaggatcatctgagcctaggaggttgaggctgcagtgagccgtgatcatgccactgcactccgtcttggacactagagtaagaccctgtctcaaaaaaaaaaaaaaaaaacaacaacaaaactgcctttctgctcataaagatgttagaaattaaactgaaaaattagaaacaggccacagaaacattcagataagaattgagttggattacatcaaaacaaaatttttaaaatagttgagttggataagagatataaacaaagatggataattgtgtttattgtttaaggaagggaaattttagaaaattaaaataattataggctccctcacctccagcacaaattctgtttgctggaacaagtattattgtgatattagtgaactagcacttctcaaggaactggaatatgtggtgcctgagagaaggtattatatccacacctgtgtctttgttttgggtaatgggaagtgttggctgcagcatttactgagccaagttttgtttgtcctatttttagcatttaattctggcagagcccctcccaaagtcgggggagggagagaccccccccaaagtcgggggagggagagacccccatgtcattctaattgttcacattcctttacaaatcctccagaaataaccaagcaggaacttggagtccacggtttacatttaggttgggaccatttgctccagagggaagggccactgtgttctgtctctggcaagttgcagagtcctggctgaggaaggggccctgcctaacaaatagcagaatccatttctagttgatattaattagatctaagacacacggggctctttgaatgtcaggcttgtgaggaaatagctcttttgcttggcaccctgcaaaagattacaaagccaatgtttaatattagttactattattggaactttatctccaacacagttttacaaggacagctttggggtctcattttatagaggaagaaacagggtcagaagattcaactgagttgcccactcacataggtaattagtcaaagaacaataatttgaatcaaattttgtctagctccaaaatttatgttcttttcaacccagagacaaggaagaacttactgcctatgatagaatggtagttggtggagttacagagctatttatctgagcctcagaccacttgcagctcagccactgtggaactctgggggacttaattaacctctccaagccttggtttgcccattcgcaaaacagaggtagcagtctagactcactaaagttattgtaaggtgcaaatgagatggcatgttaatgtccctaacaattgtaggtacaataaaactgtctttccttctgtctcacagctagtgttttttattgatcacaggcatcctatggcccagtttgaagtaataaatccagttcttcatcagtaggcatgtaatttgcaatggatgctcactgcttttctgtttggatcaaaatacttaccttccttgaaagtttttctttcctagccaaagataaaaccccatagtgaattaaatatgattgcttttcatcattaatggcagcccctactaactcttgaattccagcttttcagtgcaaataaatattgcatcttcattgttgagaagaatctgattccacctttggaaggcacttccttggagataagaagtttcttccataaatcctgcttttgtaaggttgagacccactcaccacattgctggtggaacatggactgggaagattcagagatgtcagtgtactcttttgctctgattatctgaaaggaatgcctgggtcattcctttcaattccctggattagtccttccaaaacagaaagtaaaaggtactagaaaggcatagtcttttttgctgtaaactccaacttaggaaataggatagtttagagtccactacacagactgatctatagagtggtgctatttatagggatgtcagaaaaaaatacaggattaattaatattgattgggatatacttatagtaaaaaagtattcattgttttcctgaaattcaaatttaactgggcatcctgtatttcctatgcttttattcattgaatctggcatccctagccagttattgggtgcctactgtgctgtgcagcaagtcagaaaggtaaggtgccagggagtttccccgggatggagctaagagcacgagttctcaaatcagacgacctgggtttgaacttagctttgctgcttaccagctgtgtagacttgggcaagttaatgattttggctaaactacgatttctttgtctctgaaatggggataggaagagcacttacttcctggaatgatcatgaggaccccctaagttcagcaaatatttgttgagcacttacatgtgaatcagcactgtcctcggctcatgtcctggtcacacagtctctgccatagagtaagtggtgatagatttactaagcaaaaacaaaccaacaaacaaaaacaaatgcaaagtggtgctaaattcaagtaagaaggaacatggcacagtgaagggtggggacatactgtttctctgagcgtttattgttctggtgagatgacaattagcagagacacagatgccatggaggaccgaatacagtgctgtctgagagaagcacagagggggcagccagcagccggtgctcaggccgtggctggcagggagcctgcatgatgcacttggggaacatgaagaggccactagaactaatgagtaagaagaggttggtggtggctggtcagagagggcattgtgaaaggtggaaagagcatgaagggcttagaggccttggaattttatcccaagagaggatgaaaaatcactggaattttaaacaaaggaagagtgttgtctgactctggttttagaaccattcttactactgggggaagataatgatgcatgcctggaggaagtgcggagatgtatatagaggctctcgcaagagaggatagtggcttaggggtagttaaaagtggagatgatagcagtgggcaggggcccgcagctgaagcgcgacccagagaggccggagagtgccaaggcatttggatgcgcgggctctggtgtccagggtgaagcagaagtgcgacacccgcctgtgggcattgcagaaggatagtggcagcagtggctggctggggcctgggctggcagaccaggagcaccctctgtcactgagtaatgtgaaagagcacagccaagcagatgaggactgtgtggacaccgggccagacaccaggagtaatggctgctgggggcctggctggactgagatcaggagaagctgctcagagagagtaatgagctggctgacctggcccacgtgcaccctaccagctgtgctcctaaaggcctgaaccccaacctcctggtgacctggggcccagtgctggcaggctccggttgctggtctgtggaccccgcaacccatctggccacgcacccctggttgtcccgctcgggcagcatgtccatgtggcttgccggacacccctggggcttgggacctccatctctgcactagggcatggcccctgcgttcccacccagcctgggggctccctgctgtcgccctaccagtttgtcagggactcccagtcgggccagctgttggtcattcccagagatcacctgcctcactttgcggagctgatggagcgggccaccgtgctgcccctttgccccgccctgtactctccaggctgcagccccctgcaccaggcccagcagttgcagctcttttcgctgcagcacttcctgcagctgcaggagttcctgtacctgcagcagcgggcggcccaggccctggaactgcaaagaagcacccagctggagcggctgaaggcgcagaggagtaccaggcagagatggaggagaagtggagcaactggggcctgggggccgggggcaaggctggcctggccaccgcttgccctgggatgctgctgcgaaagccccccgcctggctgccggccctgcgagcatctatggcaaggcggtgagcccgccgccatcgccccgcgcgtcccccatggccgccctgaaggccaaggtcatccagccgctggaggacgtgtccaaggcgcctgcctacacctaccctgctacccctagctcccaccccaccagcctgcctccccactccctgctgtccaccccgggtatcacccgcaaggaagagacccccgacaacgtggtcgagaagaaggacttggagttggataaggaagcccccagcactttccaggccttgttctcagatatgccgcccaggtatccgttccaagccctgccaccacactacgggaggccctaccctttcctggggcagcccacagtggccgccgatgcggatggcctggcccctgatgtgctgctcccagctgatgggaccaagcgcctgacactctcgcccgaagacaagctcatcctcctgtccccctccaagatcccagagccgctgcgggaggacccggaggaagagccgctggctgaacaggaggcgaaggtggaggtggaggatgtggacgagcgccccgcagagctgccgcctctggagttgccgctgccactgcccgccatggaaaccatggctaccccgagccctgcaggcggatgcagaggtggcccgttggaggcccaggcgctgagtgccaccgggcagggctgcaccgagccctctgagtgcccagactttgcggaggggcctgaagcatgcgtggattccccgggccggacagaaccctgcacggccgcattggacctgggggtgcagctgacacccgagacgctagtggaggccaaggaggagccagtggaggtgcctgtggcggttcctgcggcagaggcagcgccggaggaaggcctggcccaggcggccctgagcgagccccagcccagcctagaaatgtcagactgtgacgtgcccgccggggagggagagtgcccgagactggagccccgggaggccgtgcctgtgcccggcagcacctgctacctggaagaggcaagctctgagcagttcctgcccggcctggaagacccactggctggcatggaggtggccatggagctgccccaggccaggcctctgccctccccaggtgctactggagtccaggccttggagaagcaggaagctgccgagagccttgtcttggagcagagctttctgcacggcatcaccctgctgagcgagatcgcagagctggagctggagaggaggagcaagaaggtgggaggtgcggagcgggccctggtggctcggccctcactggagagcctgctggcagccggcagccacatgctgagggaggtgctggatgggcccgtggtgggacccgctcaagaacctgcggctcccacgggagctgaagcccacaataagtacagctggatgcgcaagaaggaggagcggatgtaccccatgaagtcctccgtggaggacatggacgtcctggaactggacttcagaatgtggcgggccgaggtccagcaccagtacaaggagaagcagcatgagctggtgaagctgcagcggcgccgggactccgaggacaggcacgaggagtcccatggaagcttggcacgcaggccgtggaaacagacccacgcccccgagagccctgtcgcccgcccgcaagagggggaagaactgcaacagtagcggaaagctgagcagcaaatctctgccgacatcagatgactatgagctgggagcaggaataaggaagagacacaaagggcccaaggaggaacacaatgcccttattggaacagggaaagccagggagaggaaccagacttgggatgaacacgaggcttcgtctaagttcataagtcagctgaagattaagaagaagaagatggacagcgaccaggagcagttggcaagcaagctcgacaaaggccctctccctcaccaagcaggacaagttgaagtcacccttcaagttttcagacagtgctggggggaaatcaaaaactggcaggggctgcagcaagtacttaactccttatgacagcctgctgggcaaggacaggaaggtgctggccaagggcctccggcctgtctctgaaatcttccagagaaggtaaacacaaaagggccgccaaagccaggaagataggggtggggttcaaggccagaggccagcccaagtcggcccattccgcgtttgcctccgaagtgagcagctactcttacaatacagactcagaggaagacgaagaattcctgaaggagagtggcccgcccaaggcccctccggctagctccaaactgatgccttccctcctgtgtggcatggtggcaaaggacagcaaggcagctggcggcccctagctgaccaagagggcctggcacacaccccctcctccgccccctcccggactctgaaacctaagccagccaccagcaggaagcagtggttttgtttgctgcttcgagaggctaaggtgcattcctccttcagcgactcttcggaagattcatttgactaaggttactatctccaaacacaaaatactttctgtgtttcctagcgagagagtgcctgcgagtgagcgagaaggaagcgagtgggcgcacgggagagatggggggtgaggaggcccgtgcggatggccgcaggaaggccgccatctgggttcttggcagtgtagcctgctgtatcggccaaattatttttatttttgctttgatttgtactgtatcgttgtgataatatcgccggctagctctttttgagctgttatatggactgcttctgagtctgcatttttctccactttccttcctctccgccctcctccccctaccccgagttcctccccacccccatactcaccttttctgcccacccagagaccccaggctgtggtcaggctctctttgggcacgggcccagtgggggcttcccgagaaacattttataaatggaattctgtcatgtgggcgtgtgacttgatgtttgtactgcgattttgataataccaaactttattaaacatactgagttcatttttaacaacaacaataaaacaaaaagtggaggtgataaaaatggttgcaaattcctggggagtaggtattgataaagaggtcaaaggctcacaaaggcactctttttaaagcctctgttttaatacactcatgtaactgtttactcagatcaaaagatagaacgtgctagcaacctggaagtgccccttgtgcccctttcatatcactgtccatccaaccatggttaataaatctccagacttctaaaagcgtagatgatctttgatttcttttgaacttgatacaaatggaatctcacggaatatgctcttttgcttctgtttttttttgttttttttttttttgcttagtattatgattgtaagatttaaatatattgttctttttattgctgcaaaatagttgattatgtgatgatattgccatttctttatccattctgtgcatgagcatttgagtggttactgacttttggttaatagtgtcactattaatattctagcatatgtctttcggtaaagtaaaataaatctatatatatatagcatatatgtatatgcttcttgggggggttatatacttagtagtggaatatgagaatgttcagtcagtagatactgccagacagattttcagaacggttgtagcaactgatactccaaccagcagtatataagagttttggttgcactatatctttaccaacactcgatgctgtttgtcagctttttctttatcctttaaatatgcgaaaggaaaacaaaatctcaggaccccaaactcagtttgccaaagggaaaagttacgcttggaaattgagtcttgcaaaaagctgcctttccttttgttcctagacagatagctgcaagatagacggcctcatgtctcccaagggggcctccctcaccctgacaatgtaaattaacagctcttcacaggtacaagaccacagaagactagaaatcacccccacctactcccccccccaccccaccaccctaagataaggtcatatttgtcatcttcctctacgtttatcttatgtaaagtgcagatttactgagcgccagacaaatgcagagttgactgttccctcttccccaccttttcacacaacatgtgataccctccctctttttttccctttcccctttcttccccctgttgccccttttcccctttaaatattgaagtcctaaaaaccttccctggaaaaagtgcaagccacatagcctcctgtgacttgcatctctttcccaggcatttcctcaaccttggcaaaataaacctctaaactgattgagacctgtctcagatacttttttggtttccaaatatatttaactattgcagtcactgcttccatgggttaagcttcatactttaaccagggtttctttgtctttcttttgcatccctaagatatataaaatcttacaaattctttctctgccttcagatagaaagactggtttggcttttgacaacaaacatttagggggtacgaaggagcttgaagagatggctagctcacagtgtctgccatcaggagacacatagcatgcatttctgggccagatggacaaatgctcttgaacctactggtcaggagcagggagactcacacagggttggaggtttcttccaatcttctagtctaattgttagccttagacctttctgctagttgagaagattctttctttgaagcatttgttcatacacaagtagccttatttagcccttcttgacaaacttgatgacttaaggaaaatacatttgactctgaaatttaattcagctgctgagctgcctgagaatttccagatatttatttctgattgctcggtggctttaaaacagtagctaaaggtgtactgtaggatgcccatcatatgagaagtcatttctttgatgtgtcaagagtgtgttgcaggcattctgcagacaggacattgtgtgctgtaagagattttttcagagacaccaatattgctcctttacagaaattcggaactatccgggcagatttgattgaacagatgagattcaaacagagactgaaagtgatccagacgctggaggatactacgaaacgcaacgtggtaagtcctttaagaagtagcaggcaacctctgtcatcttccttcttcacactcctgctggctgtggattcctgcctgacagaactgaaaacaatttgaaagggaaaaattagggattttcccagcatggcactttttgagtttgtgaaattcattttgcttaatatttttataggtacgaaccattgtgacagaaacttcctttaccattgatgagctggaagaactttatgctcttttcaaggtgagttgcaaggtaaattcatgcccattcaaaggagtaaaggagttcaccttaataattcagttagttcttgatttttctgttaaattaagggataatataaataggaagctagagctgagagtacaaaactgtagtacttaatatgaaaataaacattcttataaccaatttaagttgatgttttagttaccttgcactccatataatattctagttgtttacttgaacctaaaaaaataggttattgcttcataatacttattaaaaacaatggtgatcaagtttaagttctgcttgaattattgcaaattgtgattgcctatgttaagctataaaaacacccttatgtagttagaataaagttgtttaagtgcccaaggaaaagcataattggttaaatttctgtgattttcctttcctaattcagcccctaccaatctttatttttttatttttattcttttttgagacggagtcttgctctcactctgttgcccaggtacagctgggattacaggcgcacaccaccacacccggctaacttttatatttttcttttttctttttttttttctttttttttagtagagatggggtttcaccatgttggccaggctggtcttgaactcctgacctccacctcgacctcccaaagtgctgggattacaggtgtgagccaccacacctggccccaatcttgattcttaataagaaagtattatggtcataaataaagcaaagtacaattttttcgtttggaaaaaaatatttttgtcataggtatcatcagcatcagaggttaaaatgtgataatcaacaggaaaaaaagtttaaaatatgccttttatgcaggtgccaatttcatcacaatttctaattaccatcagaactaaatttggctgttttgagaattgcaaagatagtacaggaggaaatagaaacgaacataaaaactagaacactggtattctacgtcttacagtcagaaaatgtggttgcttaggactgcccttgctgatgtcgcccactgcctgttcaccactggagggcaccactgttttatttatgttggtgtcactagtgcctggtaaagtgcactagtactaatactagagtctctgcctttgtaggtgttccaaacatgtgtgttgaattaatagataaattagtgattagttctcaatataacacagtccctgcatttttctgacgaggaaaccgaagcccagaaagatggaggcactccgggtgtccaggctggttggtggtgcgcttggtgcagcatcagcattatcaacagagtggacagtggcacccctgccagcctgcatccggcacttgagggtgcagtctctgtggtgtgccagctcatgaatattttattcgtacatgttaagcacctgtagctaattgttccacatagtgtaagttggagatccgtaaggcaggagaaaacaatgatgcaattcagatcaggtttttaagggatgctgaggaccagaagaaacgttctcagggcatgggggcagggccaggattctggggggagctaaacgaagtggaagtagcagctggaggcagcaagagcatggacaggtaagagaaaggactgtgacagcggacagaggaggctgactcggggaaagcaaaagaaggaggaccagggctggctgtacagaagtcctggatctggtagtcattgaaatcacatctttttttttttttccttctttgagacggagtctcgttctgtcacccaggctggagtgcagtgacacgatctcggctcactgtagcctctgcctcccaggttcaagcgattctcctgcctcaggctcccgagtagctgggagtacaggtgcctgccaccatgcctggctgatttttgtatttttagtagaggtggggtttcaccatattggccatgctggtctcgaactcctgaccttgtgatctgcctgccttggcctcccaaagtgctgggattacaggcatgagccactacgcccagctgaaaccacatcttaacctgggcactgctgcgctctctggtctgtgtaccttcagataacagccgtgtcatttgaaccctgagaatatgctgaggaaagcagttttcttatactcaaaaccctgccctaagggtgtgttgaaaacacaggttcctcagctgtattgaggacccagaagaacctgagactcggttggtgtcaggtgggacagagtctcttctactaaagaatccaatataaaacttcagttatggacacttcatggaatcattgcaacacttcaattggctctcattcatcttctcaaacatttattaagtcatcactatgtgttagttaccctgccagacttcttagtactttaaaaagccaatttctagagacaggtgcagtagctcacatctgtaatcccaggtacttgggaagctgaggtgggagggtggagtgctggagcccaggagttctagaccagcctgggcaacatagcaagacccatcactaaaaaatatatattttttacattagccaggcatggtagcatatatttgtagcccagaggctgacgtaggaggatcgtttgagcccaggaggtcgagactgcagtgagccaggatcacaccactgcactccagcctgggcaacagagtgagaccctgtctcttaaattttttttttaaggaagtcgatttctgggtatttttctggagatacaaaggaatgatgtagtcctcctcccaaggagcttactgcacagacttttggatagaacttgaggagaaaaggttaaagaatgcaccttaaggcagatttcatggaaaatgtggttcaggggccctttgccctggtttctcttgaactctttccaaattagcccttctgtttcaatctctgggcccatagtccccaaatgatggtctgtgggctctcagcaaggaacaagggagatgatctgaagggcatgttttatcctaatggttgtgagcaccatgaaagtgcctgcacccatgttcaggccaggttcagagcaacttggggtgcttaggaggaaatgctttgggtaacctttgtcaaccgatgtagctcaggttaaggggttccctcccggaatatatccccaacaccatgctgcccacagagggctgctgggctccactcatgctcgttcagagtacagctcaacccagcaggccactctgacctcagcttctgcctccctgccactgacacacccgcctccaccctgcagccaggaatgcagtcccaggaatgcagtcccaaagcccacggaactttgacacagtttcctttattctctcaaggtcgccttgcaaaaaacctgactggttctgctcaccacctctccttcctcctctcttccctactcccactcctctttttagctttttcactacaattcccaataaacaattgtgaaaagacattgatcttctttgctccttttctaagggagagcaaaatagaaatataacatactcacaattgactctcctctttttcagaaaccctagggaaaagagaaggattttcaaaagtaatttttctttcttcttttttagttttatttttttaagacagggtctcactctgtcacccaggctacagtgcagtggcaccatcccgggtcactgcagacttgacctcctgggctcaaactatcctcccacctcagcctcccaagtagctgggactacaggcatgtgccaccatgcccagctactttttaaacttttttttcatagagacagggtctcagtatgttgcccaggctgttctctaattcctgggctcaggcgatcctctcgcctggcctcccaaagtgctgggaatataggaatgagccactgcacctggccaaaggtgttttttttttctattaccatatttattcgtgcttatagtgaaatattcagacaatacaatatggaaaaagtaaaaacgaagtcctcctttttatgctcctcctttctcccccacctgccacccagagttaactataaatgcctgtgtggggttgagggtgttctttcagaactttctagcgcatgcttttttgtgtggtcttcctaaaaggagtggatatttctaccagagtcaccatgacctcatgaataaagaggctgccttttttccaaggccagcaacaggaagccctttgctgggtctggatctctattctgctcgccggagtggttcctacgctgataatttttctagagctattcacagatgtgtgaaattggatgaccacacacttgtaggttgaatactgtgtgactgtgatcttatttatgtgattttggtgagcagggaagcagggggttatgtatgatacatgggacattaaagcgggagttaagaaacacaaaatctcatcatgattctgctttaactggttggttaacctcatatgagccacataaagtctggattttaccattgtcacctagaaaacaaggcggtcacattacctaaattcctatctttttcaagtagcattctatttaagctaaaaaatttctttctctttatgggagttagttctaaaatgtatgtgagtgtgtaggtaagggggaagagaatgtggtgggggagagttccctttctttcttcacctacacccagtaattgaagcagaccttccagatgtaaactgcagaagtggttggtgtggaggcagtgaagggctggtcaagtggaggtgtatgtagaactaagagaccaagggggccctgaggccacagccctgccccaggggatgcacacagattcacctaaagccctttccaaactggaggatgggcgttttctttctggtatttgctgcaaaagagggtccccagtgatcatccattctttttcaggcagaacatctcaccagctgctactggggcgggagcagcaacgcgctggaccggcatgaccccagcctgccctacctggaacagtatcgcattgacttcgagcagttcaagggaatgtttgctcttctctttccttgggcatgtggaactcactctgacgttctggcctcccgcttgttccagttattagatgaaaatggagactctttgattaacttccgggagtttgtctctgggctaagtaaggacgtggtactattgcatgagttgggatgggatgctggagttgtgcctagtgttgcccatgctgccctcagggctacagaagcacaaggggaggtttgcaaactgattataaaatgtgtttttcatgaacatagtatatggataaatcgttgcctctacatcagacagccctcaacactagttaaaagtacattattagagaattcacaagacaatgaaatgccaacataaacactgaaaccacagacgagatagttttacaagagacaaatgtttgggttggtggattactactatttgacaaaaaaaaatagaatattttattgaatatattatatataattgcataaaacatctatttcatagtaaattttatatgtaatttcatactttcataaaacattatgaaatgtttttaataaaggagcatcacagcagccctgcggcctaaatggaagtcttttctctcccttttgctgggaggaggaaccttccagcaggagcaggcccagcctcaccccacacctcaccacagcatgagggcagctacctaccagctccctgtctggtttgctcactgccctgcatatgactgcctttttggactcttgttctttttataactgggcacaaaagcttcatggtagtggagcctggcccacttgacgtaaggttgagagtatagcaggcattatgccagaatgaggtaagaacaatttttttaaaattctaattgtgctactctatgaccttgggccatatgctttaaaaagaagtacccaaggaaagagaaaatgtcaggcatagagccagcatttctaaagaacgtctttaatctgtgagagttatatctagaagacataaaggccagaggaagctgatggttttttaaaaagggaagggatatatgtaggtaaggtccgttgaggttaaaacaaaaattgtataaagtactcatctatacgcttaaaagaggggacatgggagaactcgcatttatttagagtgcagatactgttgtgatactttagaacttttactatattaatctaaacaacagctcttaggtgtaataatgatagtgataactgacatttatacagcatttactgcatgcctggcattgccctaatgctttttatgtgcacaattcacatgcatttaatttgtctaagggcatgcaagtataaagtttgtgtttgattccacgtactcaagaggcacagtttgtgctgttactcttatgcttcgttacctacctgcttgctactattatctccatatttagctaaagaaatagaagctcagaaaagttaaagtaacttgttggaacattagtttttagcaaaccaataaatatctgttattgaactgaaatgagaggcacagctaatacatgctagacccaggattcgaacaatggctatctgtcctgaaagcttatccttttctcactactctgtactgaggataacaaaagggcattttttaggaagaaggaggcagtattaatttttagttacacaagtgatatataagtacagtctgcttttttaaaaagtggcacaaatcagataacactaaagacccctttgacgctatgctaatcttctttacttccagggtaattactgcttgtcatataggtatccatcaaaagagatatttaaaaaaaaaaaacctttgggcaaaaataaagaggagaaaaaagagacgggttctacatgtagaaagtgacagaaataaacaaaaatatttaatttacttaaattcagtcaactccagtaaggagaatgcttttgaaaatcttcaagaaggaaaaagagtcttgaagtccagcatagagaaaacactggaaaagaatatttagacttcaaaatgcagttgagttcctgggcaaagtaaactataccccagattagtgggagaactctcagatgtggttgcagagctgttgtcagttacattggtcagttatagttatggagatgggaaagtcaagcagaaatgagaaattctgtctgtgtttaaagaaactaaagaatgggccaggccccgtggctcatggctgtcatcccagcactttgggaggccgaggtgggtggatcacttgaggtcgggagttcaagaccatcctggccaacgtggtaagaccctgtctctactaaaaatacaaaaattagccaggcgtggtggcaggtccctataatcccagctactcaggaggctgagatatgagaatcacttgaacccaggaggcagagattgcagtgagcagacatcgtgccacagcactccagcctggacgacagagtaagactccatctcaaaaaaaaaaaaagaaaaactaaaaaatgaattctgaaaaacatgtatcagtaattttatatcaatccccagagagatccctctagaaattactaaacagatagatggtctttgtggaattagaaattaggggtttcaggctgaggcaggcagatcatggggtcaggagatcaagaccatcctggctaacacggtgaaacccgtctctactaaaaatacaaaaaattagccgggcgtactggtgggcgcctgtagtcccagctacttgggaggctgaggcaggagaatcgcttgaacccgggaggcagaggttgcagtgagccgagatcgtgccactgcactccagcctgggcaacagagcaagactccatctcaaacaaacaaagaaatgaggggtttctgtcagaagccataaattagctgtatctctttctccaacagtgcggctgaaacttagagtttataaacatagcataatgagttgtgatgcagccggtcattggataaataattcattaccaatggaaaaggtgaaagtatatggaaattggtgattgtgtaactggctgaacactgcacccaaaagtgtgatgggcaataagttcatttcaactgagagagcattcactagtacccttggacccagtatttggactctttgcagttgcatccttatttgcacgatagagttaaccatcaaaactaaatgaaacaattcaagtaaagttctagaagtgtgtctggctcaaaaaaatgttggttatgattgtcactatgattattactcattctcccctactggactcagcggacaccttgaaccatgaaggcagagtacacttactgaatgggtggggccacatgaaggtagaagagatagccaagggtatgttaggtgacaaaagtaggtttttaaaaattatgataggcagaaattataactgaacccaggtttggctgctcaccactcgaaaaacaaactcaagagacaagagtttcttgggtgggaagaaaaccaggtttattctgagagccagcaaatcacgaaaatggcagactaacatcctaaactaccatcttatgtcagtacagattttaggctctttttgtgttaagggcaggggaatgagaagcagttgggatcaagaggtgacagacaatgcagatatctgggcaccagcaggggtccgagaaggttgggaacttctttgtcttcagtcaggttataatgctaccatggatctttaacaaaacggttttttgcatacttctccttcaatatcagagttaatttttaaaactacatgattgctgtttttgcatattatcttagtgctctaaaattatcctagcctacatgcaggtaaaggtcccttaaacaaaacttgaattagttatgttggttcttttgctgtttcactgttacaaaatgattggtgaaaaaaaattgataaggataaatataagttctacttttaaagaaataattgttaaagaactacctaggatgtctgcatgtagtataatagtggtttccagcatggaatctagagtcagacaaatccaggtgcaaatcctggacctgtcacttatgaccttgaacaaattacttaacctcaataagcccaatttttcttatctgtaaaataggagtaataattgtgcccattttatagaattgttatgagatataagtgggattatacatatgaagtaattggcacagggcttaacacagagtgggtggttaatgtccgtcattattttcatgattagttttattaatcatgcaaacatccgggagtttagttaaccatgtgatcattaagaaactccactgtgagagtgtgaacagttgaattcacacttaggctatactaatggaagagtcaggaacagttcccctatttcctggagtggtcaagaggcttctgaactcattccagagggatattgattgagaaattaacatataaggtagatgtggataataatagggaaggataaacaaatcacatcatatgagaaaattgaaaaaattggaaagatctaatctgagaagataaagttggcccaaaaagataagcttgaggaagacaggacagctgttcttaaaatctgaaggattgttgtgtggaagagttgagacacccattctgttttgctttaaagagtgggataagagaaagaggagtagttctaaaccatttttgagtcatggactctttgagatctgataaagactatggacattttctttccccaaagtaacatatgaacataaataaaattttgcattttgaggggttcacggacttcataaagttgagactacaggttttaagggtcattagactaaaaattacagaagaactttcagtatttaaagaatacagcttggaatgaaatgcctctggttgtattgagttccccatctttgagaatgtttcagcagatgctggagtcctgtctcactggggtgtgtgagaggagatcctacattaagtggaaggtcagacaagataacccgtaaggtcccttccaacccagattctatgattcctatttttcttctttttccaaatctcatttatctttaggtgctctcagaatatatatttacaaaggattttctggttctagcaataaatatggactttgaggggaaaagcaacaggattcttccgattgaagctatggtgatataatgaccaataggttcagataaattaaggaaatacttaggagctcaaaaacaattaaaaaggatttctagaatgagtaatttgaagtgatatcaaaacacatcttgaaattatttctgaactctaatagttatttaagatgttgtgccccaatcacatgacctttctcattaataaagctattttattaggtgccaggcactattctaggtgctttatatgttttaacacttttagttctgacatttcgtggagtcctgacatcaagatcactggtagaatcttctattatcatctcaccttacagaggggaaaccgaggtacagagggtttaactctcccaacagtatgtagtacatgcagaggatttgaaaccaaccatcctggttcctgagctgttaacccaaacaggtcctggccaggcctttcaccacacaatgtcttggttggaatgtgtatgaagtagactttttagaggaacactaggcctggagtttattagcacatgtgatgcatttcacattggtacttatgtgacttctaggtgctgcatgccatggggacctcacagagaagctcaaactcctgtacaaaatgcacgtcttgcctggtgagtgagctacatggagcagtacttgtgtctgtaaccatgacctggcttgaagtctctgttttaggtgtaacctgatcgtcctctttttgatatacaccatcattcatgagtcactaagaactaactgaacaatgacaatttccataagttcttgaatcagcatgcacttgattgtatagtcatttacctgtgtgaagagtgagttgtggtaacagaaaagagcaggcaggcatctgcaaaagaaagaataaatagcacttggtaacacctgggatacaaggattgtgagagagaaaaggagcgtaggaacattgacaggaacaagtggggaaaatggtgaggttttttcaattttaaacaaggttggtaccagctgggatctatctagcaaatacttttaaaaatgagatgagattggcacgaacaatagaggtaggataaaactagatttgggaattctctttatagcgtacagtttcctaaaattttgttaatatagcattattccatacaacttggaaaattcttcataacacagaaaatatgaaggaacactttggtgtggggttgttaaaagggaaggtggagttagatggagttagtgacctcctccactaaggtttagagacagtaggcactcaaggccccatcccacctttgtaactttagcttttcatccccacttatgtcattttatttaataattaagcatactttcactggatcatggccctaccaatatgagaactatgtttcctcccctccctagagccatcctctgatcaagatgaaccagattctgcttttgaagcaactcagtacttctttgaagatattaccccagaatgtacacatggtaagtgacttttctcaccaaagatactatatttgttttctaccgagccctccattattggaaaaagacttgcctccaaagctagtcaatcaaagaagtatgtaaatatggttgccttaattggttactttcctttccagtttttgagattaggcaactattgggcagtaggtacctcagcccactgaaggaaacatgtacattgtttcccagtaggttaggaaacttgtgtcctatagagctgtatactttgctgccctctttctgccaggatcagcctcattaataatatcctgttaggcagccatccagaattggaactagcatttctgtcagaaagcattctcttatatctgtgtttgctctatagcagaagttggcaaactatagcccgtgggccaaatccagcccaccacctattttttacagcctgtgaactaagaatggttttttacatttttaaatggtttttaaaaatcaaaagtaaaatatttttgccacatgaaaagtatatgaaatagaaacttcagtgcctataaatagttttgttggaagacagccaagctcatttatatatgtattgcttatggctgttttcgtgctgcagaattgagtggctaaaacagagacagtatgacctacaaaggttaaaatattcattgtctggtcctttacaaaagacatatgctggctcctgctctctgtggatgataggtctacaaagatgtgattcaactcatatatgtctccaaatttatatattaattcatatactgttttgtcttacattaatctagcattgtcttttggcttgctactgcagtaagttaccttctaattcatcattaggtcaactttatcaactcacctaagtccaaaagtaaatgtaggtttctcctgggttcttttgcctcttaagttttgccatccccaaataagcacaacagagacctgcaccaagagaccttacttttagactgtaagcaccaaagtgatttctgtagagagagtgagccaggctcagtcttatgactggcaatacaagttgagggtaggagctttggacagaacactagctatgtatagtgttgtctaggtgagtgcaggcaggttcctatgtgagcctcagtttccttgtgtggagaatggagatgatagctatcatattgggtgtaattaggacctaataagagaatgtaataagacattttgcatagtgtcttagtgcatcctacatattcttaatattatatattggaagtaatggcaaaaaccacaattacttttcaccaacctaataccattagcagtcacattctggctacaaaatgttctccacacatttcttagtagacatacatctcagaaagggattctcttgttttagaaatgcttcagaaatggtcacatgccaatagcatgtaatatcattgaaatatgctttttgaagaaggttttccagtgccaaagatgctattgctttgcatggaaatgtttcaggtacgggtaaaataagtaagccaaaactgtcttagaatcttaccatataaagataactaataattcaccttgaaatatttcagttttttattcaaattgtacacatacacaccacagatatatgtatatagaactgggatcaaactacctatacagttttgtatcctgctttttttacttgaaatccagtgagaatattactttgtcattaaaatttctttgaaaatgtggtttttaaatggctatatagtatccattgcatggacttaccatacattaaatattttttaaaaatccacttgttgcctacatcattttcaacattaagaggggaggaatttcccaacaacacatagtacactttcctcactgtgtcttaaaagctactgagattaatttgacacgtaatacagtaaaggccacatctctgtctgaccagccagctttgggtggttgaagaagtgctggaatgcaccctaacagccaacaaactgcatgggaaactgagggcattgtacacctctctattttgaagtccctatgtgccctgtaatgtctcgttttaagaagacaaaacagttataagtgggttccttaaaagtcatatttttgaagtaccaaattataaatctgaagtagttttatagcatgtaacattttagcaaaaaaaaaattttctctcttctgccaacatagattttaatttccttgaaagagtgagttctggatcttttgcagggtctggcaaaaaaaatctgtctcatatatgcaaagttaaatgataatgtagaaaagacaggagagaaatcaacattcattggggcaagcactaccattttttaagtactaaaggctatgtggcattatcccattaatttttttttttttgagatggagttttgctctagttgcccaggctggagtgcaatggcaccatctcagcccactgcaacctctgcctcctgggtttaagcaattctcctgcctcagtctcccgagtagctgggattacaggcatgtgccaccacatccggctaatttttctatttttagtagaaacagggtttcaccatgttgaccaggatggtcttgaacccctgacctcaggtgatctgcccaccttggccttccaaagtgctgggattacaggcatgagccacgctgcttgaccctccattaattttttattgtacactgaaccccagctgtgagaaagaattctgcggaggtcctttacctggagatagtgttgtcagataaaattatgggacatgtagtaaaatttgaatctcagatacaaaataattttcttagtataagtatgtcccctctaatgtcagggttatacttatcccccccaaaaattgttgtttatctgaaattgaaatttaactgaatgttttgttttgttttgaggagtttttttttgtttgtttgtttgctaaatcaggcaaccctacttagagagtcttctattttccactacaaatgctaattccatggtcatattatataacattctacttttttcttctgaaccatttcttggtagttgttggattggatagcagaagcaaacagggtgcagatgatggctttgttacggtgagcctaaagccagacaaaggtaaggatattctcttctatatgtttaccttcttgctggttgtacacttgttttttggcctgtaagcacttatttcttgacatttgggttgtagggaagagagcaaattcccaagaaaatcgtaattatttgagactgtggactccagaaaataaatctaagtcaaagaatgcaaaggatttacccaaattaaatcaggtaagtgcttaaagttcaaatcattcgcttcaaacctggacactcttttttctatgactgaaaagtcatcgataaatgtagactcaatacccatcaaaaataataactggggcctttacttagtatccatttggacctattttgtgcatgtatttatgcatcaaaaatatgctccattgtgaaaaaacgacttcctcagaggaaatgtgaaccacaacatattccattttgagagtaaatgcatcttattgcaatcattaaaaataccctcagatactcgaaagacaaacacattgctgttttcagatcaccgtgcttagctataaaggtgtctgcacattttccttaaaaacctggtgaaatgaggaagaaaaaaacaatataaataattataggctgaaaatgctaagttttgtaattgaagaacagaagtcatctgggtggagactgaaagcactaaagcattacttctgtccagggagatggggcatgtgtcgtgggaggagggattggagctaaccttggaaaaattgaggtgcatgctaaagtgtgtagacgtgaaaatagatgagtctcggatttccttaagatgtttcaaaaagggaaaagagaacaagaaaaaagttactgagccaaatgtatgacatagtccttcttgactcgaggtgagctgtacatggatgtttactttttcattccaactttcatagatgttggaaaattttcaaattaaaaaattgggaaaataagctgggtgtggtggctcacacctgtaattccagcactttgggaggccaaggcaggaggatcacttagcccaggagtacaagaccagcctgggtaaaatggcgaaaccccatctctacaaaaaacgcaaagattagcagagtatagtggtgtgtgcctggggggctgaggtgggaggttcatgtgagcccaggatgttgaggctgcagtgaaccgtgattgcaccactgcactccagcctgggcgacaaagagagaccctgtctcaaaaagaaataaaaattaaaaatagaaacatcaataggagactttaaacatgtccatccagcctaggcggaggactttccagggatctttaggcgttctcatttaaatggctttacagtccacttcagtgctgcctttctgctcccccaagatttcacattgtgtttttccaaatcgcttttcaggggcagttcattgaactgtgtaagacaatgtataacatgttcagcgaagaccccaatgagcaggagctgtaccacgccacggcagcagtgaccagcctcctgctggagattggggaggtcggcaagttgttcgtggcccagcctgcaaaggagggcgggagcggaggcagtgggccgtcctgccaccagggcatcccaggcgtgctcttccccaagaaagggccaggccagccttacgtggtggagtctgttgagcccctgccggccagcctggcccccgacagcgaggaacactcccttggaggacaaatggaggacatcaagctggaggactcctcgccccgggacaacggggcctgctcctccatgctgatctctgacgacgacaccaaggacgacagctccatgtcctcatactcggtgctgagtgccggctcccacgaggaggacaagctgcactgcgaggacatcggagaggacacggtcctggtgcggagcggccagggcacggcggcactgccccggagcaccagcctggaccgggactgggccatcaccttcgagcagttcctggcctccctcttaactgagcctgccctggtcaagtactttgacaagcccgtgtgcatgatggccaggattaccagtgcaaaaaacatccggatgatgggcaagcccctcacctcggccagtgactatgaaatctcggccatgtccggctgacacgggcgccttcccgggggagtgggaggagagggaggggagggattttttatgttcttctgtgttgagttttttctttctttcttttaaattaaatatttattagtacctggcttgaagcctagtgttttcataatgtaattcaatgaaaactgttggagaaatatttaaacacctcaatgtaggtacattacactcttgttgcggggaggggatttaccagaatacagtttatttcgtgaattctaaaaaacaaaaagatgaatctgtcagtgatatgtgtgtattataacttattaatcttgctgttgagctgtatacatggtttaaaaaatagtactgtttaatgctaagtaaggcagcagtcatttgtgtattcaggctttttaaataaaattagagctgtaaggaaaatgaaaagccacaaatgcaagactgttcttaaatggaaggcatagtcagcgagggtaaatcctataccactttaggaagtattaaaaatatttttaagatttgaaatatatttcatagaagtcctctattcaaaatcatattccacagatgttccccttcaaagggaaaacatttggggttctaaacagttatgaaagtaagtgatttttacatgattccagaataacacttgtattgaccaatttagacagataccagaccaattttgcatttaagaaattgttctgattatttacgtcaactcattagaattcagtgaaaagtaacagtcttttgtcacagagaatctgaaagtagcagcaaagacagagggctcatgacaggtttttgcttttgctttgcttttgtttttgaaagagtaaaagtactgatgcttctgatactggatgtttagcttcttactgcaaaaacataagtaaaacagtcaactttaccatttccgtattctccatagattgaagaaatttataccacatatcgcatatgaccatctttccatcaaatcaatgtagagataatgtaaactgaaaaaaaatctgcaagataatgtaactgaatgttttaaaaacagaacttgtcactttatataaaagaatagtatgctctatttcctgaatggatgtggaaatgaaagctagcgcacctgcactttgaattcttgcttcttttttattactgttatgattttgctttttacagatgttggacgattttttcttctgattgttgaattcataatcatggtctcatttcctttgcttctttggaatatttctttcaacacattcctttattttattatacattgtgtcctttttttagctattgctgctgttgttttttattctatttacaggatgatttttaaactgtcaaatgaagtagtgttaacctcaaataggctaaatgtgaacaaataaaatacagcaaatactcag

SEQ ID NO: 37823 - DNA, 6289 bp, Homo sapiens
gtacgttcctcatgaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaccagggcccctgatgccggagcccgtgtgctcggccctcttgcagacggtacttgcgggctggggtttctttcccctgggtttcgggcagagaacccgtgcggggcgcgcccgaagcgccctttggtgtcccttgctctccccatggtctcggcccccctccttctaagcgcgtgtacccgcgacctgcgtctgcaagtgctgctccacacacagcggccccatctcggcccggtcttccctgcctcccgcttggcccctgtgctgtaagctcgcctggaccccaggccgggcggtgcatagctctgtggcctgtggccccgtgctcagcatgacctaaccagaattaagcagtggacaatgggatttaggccccccaaaccctcgtccgatgacaatgggaggggaagtgtgatttttctcccctcggatggagcgtgctcagctgtaggaatgtgactcaacttgctgaaatgattttctgctctgcggactggtgcaccctgtgacccagacagatgtggagggtcccaccgctctgattagcagaaccaaaccgtgagtgaggtgcacatgtgttactcttaggaccggccctcccagctcttggtttccaatgcctgctgagtagaagaccttcctagggccattaaccagctttgctgacttgcatttaatgacctttcctctttatcttccttgttgtgcaggtaaagaaaccaagtggaagagtgtttcctcctctggccgtaaagcaggtactctctgcagcaccaggtaggaggggactcaacccccttcttgccttttcagttacatcagttcctactagggattccacacacacacagttgttgtgattttgtggtgatgacgagaaaagggttggctaagaaactgggcggcagaaaagaggcaaacattcactgtagccatttatcccgatggaagtggccaggccctgtgggggacattcagcctccgtcagaagtaatccagaaccaaggaacctggttatctttggtcactcatcagaagaataatcatgctcaggggccacaagtgtgtgaggaaatggcaccatggatgggttggtggagggtacacgggtgagtctttgtggaaagtcatttgctggcagatatcagcatcttagatgggcgtgccaggcggccgaggcatttccttcagcatgtcttcacacagcgagtgttagaagtaatgtcatttctagtggcaaaagtgggaagcaacttgtaactctccatcagtggaggaatggtcaggcaaattatgagacgaccaacaatgggatatcacccaggcagtgaaaaacaaggtagatgaagattgtcaggtggaaagaatgggcttgatgtgctgtcaaatggcaaactcgtgccctagcctgtgcagatgtgttgggaacagcagtttgccaagatggctgaaacaaaggaccataaaggggctggcttaaagaacagacaatcattgtctcgcagttctggaggatggaagtctgaaatcaaagtggtggccaggttcgtttgttctgtgggctgtgaaagacaatctggtctgtccctttctcttagctgcaggcggctggccggcaatctttggcactcattagcttgtagaagcatctcccttatctctgcgtttatcttctcatggtgttctccctgtgtgcgtgactgtctctcaaatcccccttttcataaggacgccagccacattggatgcgggtccgccctgatggcttcagtctcacttgattgcctctgtaatgactctgtttttatatataaggccacattttgaggtgctggggtttaggacttcaacatacgcattttaagaggacacaatgcaacccatcacaactgacaaaggctctgaggtagaaacaagcttggcatgttccctcaggggatggaaggcctgtgtggcttcagggtggtgaataaaggggagaggagaggacgtggctggggtgggaaaccagatcaggagggaccttgagtgccctgagaggaagtgtggattctgtgctagttggggcagggagcccttgaaaggtttcagtagaggagtgacataatctcattgtccctgtaccaagatcattccgatggcagtgtggtcacaagagtgcagaggacaagtgctgggggggggtgggggtgctatcaggagacttcttcagaaggcagggggttttaggggattggattgggattgtggccatagagattatggaaagggatcagattcagtgtcggttttggacacagtgccacgggatgtgggccgcagatgtgggaaagaaaggcagtgcagagagcagctaggtctggggcaggaacactgtagctggtgatgccactcacagaggtggaagggaggtggacttggtggtgatggttggggtcctgagtatgtatgggcctgtccacctaaggctgagtctgaaggggggtggcctgcaccacgggattcagagcaggacggtgagcaacatgggggtcccagaagaagggaaggagtgtgcccagccatgctggggctgctgagcatggactaagatgaagacaggactggcatgaggccggccatgggtgcttgtggggataggtcagtcagtggagtgggtggtggggggggtggggaataaagggagaaaggtgggggtgggggcagaaggttcagagaggaagtagagactgcgcatgtagacagctcttctgaggtctcggctgttcagggttgtagagaagggaggcagagtgggaggcgcgcgtgtgctcagagtagggatgctgagcgagcatagatggtggctggtggcacccagggcccggagtgagccagaggagcagggtccagagcacagcaggcaaccggctcagctgaggcagctcaccccagaggcgggagaaaagcaggagatctggagctcagaaggctgcagtgcagactgggaaaggagtgaataccaggcagctttggccctatcagggctttgtctcatgagggtgggtatattttcttaaaatcatagagcgtactagaggttgcgtttatgtgttgaaaggaaggacagagagaggagtaggggcagctcaagggtggagttcagggccagggggcggggccacgggcctgaggggtgagggcggccactatttctgactgttctgttaggtgccacgtactgggctgggtgctcttggtgccttatctcccttcctcacagccatgtggaaactgaggcatctcaagagtctatgactgggctgaggttctggtttcaagcccagggttccttccaaggcacagggctgtcctccgtgcaagaggaggggaccctctcccaagccacacacgcaggaggctgggcaagagttgtgggaagtcagagcccgtgtgactgtgggctggtgcctcattctcctcagccatagagtgggcctcacagtaccactgaccctgctgggttacttgaagattcaatttgatgatctgaagatcatgccatcccagaggctggcacgtggaaggcatgtgtggggggttgccagttgttctgattatcattcttcttttctcagctcagattgggacaggggcgtctgctgacagtggagagcagtggtgggggaaggggcttgaggaaggtggcacccagaggggtggagaggagatgtctgactgagggccatctgaggtcacggtgcatcctgaggacagagctgagattggatatcaacgatgtgggctcagcagccctggagtaggagctgggaaggtcagtgccttggtggcggcagggccagggcactgagagtattggcagggcacagcaggggaaagggaagagaagcagagcgtgggactgtccctctgtgctggaagagggctaacaccagccccgactctccgctctggctaggccgagggggccctctgtcctctgtgttgccctagggctcggtgacctctgtcatagcactgaccacatgctatcctgcctgtgccttcctctagctgtccccgccctactccggaccgccccaaagactccatgggatggacctgagtcagccgaatcctagccccttcccttgggcctgctgtggtgctcgacatcagtgacagacggaagcagcagaccatcaaggtcagtgcgatttaggccacctgagagacacggggggaaggtcaggccactgcccatgagcttgaagggctggcgtgtgatgcgcttctgtgcttccgcaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggtaagtgacaatgtaccaaatgcgcagacaacgcctagggctgctgcccaagatcttgcttgggaatttgggggcttctcttgtcatctgaactgattggcgtgtataacacagtttcctttggcaacacaccttcaaaggggcggcaaggaccttgggctgggggttggtatggctggcttccgcaagctctggtaaatcatttctccactctgggccgcagttctgtttctgatctcagtgagaagcctggtcagggccatgtgcacatggtgtttgtggtgtttggctgtgtgtatttgcacatacatgtgtgagtgcacatgtgtggcagagaccatgaaaagcagcccagcccgccgaatgggtcaggtggcctctagagttgggctgcccgcctggcttcatgaacctgccccagccccaccactcacagcaccctgggaaagtcccctaacctctaggtgactgaggcccgacatcagcatctgtcccctggtgacctgctcaggcatcacctgtagcttcccaggcagtggctggtgcccttccaatctgcaaccgctgctctcagaagtctggcttggacctgcctcttacttgtgtggcttcatgaggacaaggccctctcctctgcctttctggagccctccccctgcctctcccagcgtttcctgaatcgggtttggttcgttatcaaagctacggaagaaggacttgactcccttcttgtcattttgctgatgctgtcttactctctattgattgtgactttgagtaactgtgttgtcacatgggcaggccttgggctatggaagtgaaaggcattcatgtgtatctctctttgtgtacaggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga
